United States Patent 7,868,149 (PLANT GENOME SEQUENCE AND USES THEREOF) - sequence listing, part 88

SEQ ID NO: 46157 - DNA, 7604 bp, Oryza sativa
  unsure (1)..(7604): unsure at all n locations
ggctcgctgagcgactcgccgtcgaggctaaccccgcttccaagcttcacggtggcgacgaaccgccggtcggtggtgcctgcccccacggtgataacccacggcgcctcgttgacgacggtgctcggtcccgggccggtgttgccgccggccgcgctgaccagcacgccatgcatggcagcgctgtagcctccgagcgagaccgggtcgtcggagaagtcgccggcctgctcgtcgccgagcgacagcgacaggatgtcgacgccgtcctcgagggcgtcgtccaccgccgccagtatgtcgtcgcggtcgcagcccttctccacgtagcacacctggtagaaggcgatgtgcgcgcggggggccatgccgcccgccgtgccgaccgcgtagccggagacgttggcgccgggcacgaacgagccggccgccgtgctggacgtgtgcgtcccgtgctgcccctcgttgatcggcaggaccgggtcgcgcagccctttccacttccacttcgccgactcgaagtaggagcgcgctccgatgagcttgttgttgcacaccgtcttgttgaagtcgcaccggccgctccacttggccggcggcggcttcatgcccgccccgtcgaacgacgggtgcccggcgtagatgccgtcgtcgaggatcccgatgatgatgccctcgcccatgttgctggtgttccacacgccgccgcggcgggcgccgcccatgaggccgagcagctgcggcgtgtgggtggtctggagctggtacgtcttctccgggtcggcgcggatgaaccagtcgttcttggacatctcctccacctcctccggcgtcaggcgggcggcgaagccattgacgacgttgcggtaggagtagatgagccgggacacggaggaggggtccctctccagcgcctcttcgccatgtcgcacaccgacgccaccagcgacgcgtgccagctcgacacgttcttgtacaggttcgtgtcgtacgcgtacggcttgcgcacgatgacgaggtagttgctgtgcaagccggtgtcatcgtgcccggcatggctcgccgccggcgtggccgctagggagacggcgaggaggaggacggcggcgccaacggcgagccgcggcaacgagcaccgcccatggttacgattgtccattgagtgcggcagctaaacgaaatgaggtctaggagggagatgtccaagataactaacgttacatattggacgcttcttctcgcggtctaaaaatggtcgtatatgttgtgtggtcaaacgataagatgcttaatatagaaatggcatgcaaggtcatggggatcatctatctatgttctgtgaccaggagttccattgagcttagcatgttgttcctggtctcacagcagatctcgtgggtttagtccacgattaattaagtacttcactaagacgcggtcagacttggcacattttttaaaattcatatttaactttaaatttctcatatactataatgtttgtagtaacaaaatcatattttttaacgaacgagcaagctgccaatttcataacaaaatcttaatcatatagtaaaagtgaatgtaaatgataatccaatgatattattttcattacataaaatttaatttataataaaatatttattggttaaatatttaaagagttgaattttaaaatgtgtgcgccttaatgagcgggacggagggagtgttagctaaataagtgggaaaaatggattaatataattttttaaagcaactttcttatagaatgtttttgacaaaacataccgtttagccgtatgggtaacgtgtggatgaaaaacgaggaagtagaggatatgaaagtgtagagaggaacacagcctaacaatccatagaacaaatcttatgatgtctccgccccaaaatataagtaattttggatggatatgtcttattttttgggacggagggagtagcagatcaaactggttactggatattaattgaattttctttttaagaaaactactacattctattccgtaataattgtatttctatcatttaaattttatataaaagaattatatttgtaataagatgatcccgttcagttagttacttaaacagaaatttcttgccttgcactttatctttttcatcctcatctatctgaacctttctttttattctatacacgtagtgttaccgtggtcagtatttataattttgattgttggatcgaaaaccatacgattgccctgaaaaaaaaaaagaagagaaaaccatacgattgaacacggcaacgagcaacacgttgcttgtaccgagaacctgaaaatgatgtgcccaaccgtcgccatgcgagcaagcgacgcccacgtcagccgagatcccgcctggcacgatgcgacgtgccacatttgcccgcggggcaaaggggaccacctcccccacgtccccatctccgccgtccccctctcgcatccaacggctcgccacctctccctccacgcgcctcatctacccgagagaaaaaccaaagccagcacacgcatcacgcacaaacctctcgcgctctcgcgtcgcgtgcctcctgtctgccatgtgggcatcgccggggaggctgcgacaacgatgcggaggaggaggggaccacgggaaggcgnacgtgaacgggtcgtcgtacgggcgacggacgacgacggcgcgcggcgggggagcgccgccgatggcgtcgtcgtgttggggccggctcgggctcgcggcgctgtggcacaggctgcgtcagctcagcgtggcgcggcggagccgccggcacggcggaggcggcggcggccgctccatcctcggcgccggggggctcaactacgacccgctcagctacgcgcagaacttcgacgacggctgcctcgagccggacttcacggtcaccgccaggttcgcgccaccgcgcagcgccggctcgccgaggctcccgcccgcagcgccggcggcggcctcggcatgacgagtcgtggcatgtggtatttaatcttacttacatggtttgtttttgccatagctgtagctttgttcgcccagtggtaaactgtcattacgtactccgcatgttttttcagatgaatgtacatacatgtcagaattcagatgaacggatcatggcttgtaacttgtattactccgtcccaaaataagtgcagccatgagtttcagcgcccaactttgatcatccgtcttattcgaaatttttttataattagcaattttgtagttataagatgataaaacatgaatactactttactcgtgaattatgttttaaatttttttcaaaaatttttcaaataagacgagttgttaaagttagacgtggaaaaccatggctgcacttattttaggacggagggagtaagtagattattttgatatagtctagtatcagtttcgatgaaggaaaaggaaaatcttttcactgaaataatcttcgcataggctagctaatcgcgatctactctatatgttttcagcgttttgtgcagacttgcaatgattttcactgaaatgatcccctctgtccagcaaacgaattttggcaatccgaacaaagttctatcaaatttcaccattccaaatactcagtgacttattgagtaccgagtcataagcggtgtgttgagtactgagtactgaatagtgacttattgagtactgacccttcttctgttcttcatctacgtttccaaatagactgaacacacgctgctgaaacttccatctcgctttacgcaaattgtgcatacctgacacaaatgcggcttgatcgcaccgtctatttcttcaccacactacatacacataaacaaagacttatgcctactgctaatgtggaatttgttcttgcgtctcgatcaatcatatactagttgcacagaatagtactatgattctttggtggctgtttctgttaagaaaaaagggtgatgaaaagagatgggaaaggatatgccaaattgttgggggagagggtttgctgcaaattccaggcttccttttaggaaggaatattctcgcaaaaaatcatggttccagttatatctgactcacgtcaacacgcaacccggagaaatatcagcaccataaaggccaccgaataagtggtgcttaaaacttgcaacactagtagtattctgttgctacttgcgttgttaggagtattcggtgaacacagcaaattgataggagtattctgttgctacttgcgtttgctggttatataacggtcgatatgactgaagattcaggtgaacggaggaatttaaaagaattttagagaaactaaactaaactataagaaattccgtttgatctccacatttcaaggagcattcaatcttgtattctgaatttcacaactcgctgctccatagaccctcactagaacagattcggtcatctgtaacgggtctaagcctcatctctatcggatagcggcccaagcaaaagtcactgatgtaagaaaatatatcaatcgggcatccggctgtcacggatgacacatatcttaatctggccaacactatagctcgtcacggataactctcatctctaacgggcctaaactatagcccgtcacggatggctctcatctcaatcgggcctaaactatagcccgtcacggatgagtataataaaaaaaaataaattttgttttttggacacattttgtcctcactcatgtgcacccggtcaggtacccatcctaaaattgctccaccctaagtacgcttaacctcaaagttctttggggattgacttccaaagaagttaaacatccatgcacatacacaaccatcaatatatttaacacaaccacattcacataacatctattttgattacatatttcacatccattcacatatttcactagcaaaaccgagttaattggatcaaatatatatttagcaagtattagaactcattgaggaggcaaattagccttataggcaaaaataaattttgaattgaattttatgatactaaataaactcatatgaaaaaactgtcaaaaacaaagttgtagaactcattgagatctaccaattttattttggtcatatctccatccgggtttgattaaactatataaaatttgaattttaaaatacaaaaaattcaaataatttttcgggtagtaaatgattttaaatggaaaattgtgagcaacaggagggctattctttgcctatttgcggcctgtttttgggctatttggcttgttcgtaatgattgggttttcgaagataaattgctaaaagacgtgatgcaattacctcataaggtgatgtcgtttttgatgcagtggagaaatttggcgcaacagaagctgattggggagctggatacggttcaaacattactgcgtgccagcattcactcgaggtccaaggggatgcggcaagttccaggacagtggaaggcgcggttcaggcttaatctagtttctctttctcttagtgcattcagatgcaatctctctggcttgtctggctgtgcccnaggcccaaagggcccccaattttcggctcttctctcgaactggcttacccagtttttgtttttcttcattttgctgtatgaacctcgtatgctttttatgaaaagctgggccgagcgccatcgtctaaaagaaaatttaacttgtttagttcacactgaagtttgaaagtttgtttgaaattggtacgatgtgatagaaaaattatgtgtgtatgaaacgtttgatgtgatggaaaattgaaagtttggaaaaaaaaatttagaactaaacagggccacagtattattgcggttgatcggcactagtactgacatgcgtgtccaggggcaggaactgtgttttctcgaagactttcaaaatcgaattcttccccgttgtggccttgtgggtcccactcatccaaagtcccatctctcccccctcccaaattgaatccgcctctccgctccgctccgctccttccgctcgagcatctctctctggtctccgctcgccgcggcttcacgtgctccaagctcccccccatggcgggcgcctcgctcaccccaagccgaactggagcccagagcagccaccggaagcgcaaggtccccgcggccgctgccgccgccccggcccgggaggacgaggcggctgaggaggaggacatggaggagctggagcgggaggtggaccgtctgggccgccgcctcctccagcaccgccgcgaagacgccgcccgcctcctcaacgccgccgcctcccgcctcaccgccctccgcccccgcctcctcggtatgcgcgcttccggcgtactagggttttcgatttgttcgtccccttgttggtgttcgtataatttgggcgtgattagtatagtaggtcttggggtttatcgtatatacgagcaatgctagtgttacttaccaccagttagttagggctcagttgatttggaaagaagagaggacgacttatcggatctaaactgcgatttgacatttggttttctttggttgtgataatcggtgaatttggtccctaccccctggttgacagtatgcattgaaaatgtaccttcccttcccgtatcggtagattcctgttcagttacctagcaagctcgatgatttcggcatcaaacctgtttgttgatgataattatttgcaccagtcactaactgtaaaccatgaaagtatgttgttgaagtgttagacatagaaaagtgaggcttttcctgttcctgttctctactgcaacctaatctaagtatgtgaaaaatgactctcaagtttgcattgtcccagtttaattgccattgccatcaataagtaaaaaaaattaaaagagcaaattaacgtagaagatatagatggcaatttctcttggtaattccagtgtcagatgctgacaacattatgtacattgcagaagttacaactgcatcgcagcatattgctggaacaccagttgcgaaagttgaccaagagaagaaggaaaaactaaggatcgtcaaggccaaaagtgaggcgaatattggggctatgcccatggtgttgaagagaatcggtgaatctatcgcaaagatcgagaagcttgagcatttgaatgtgaatatccatcccgttttcaaaactaaacggtagtgatggactgatggtaacatgttcttgtatgattcattatgcataccatctgtagcattttgatggtaagtctttgtgttgattcagcagtataccatttgtagcattttgatgttggaataggctgattcagcagcatgtagtttgaaaagggattcaacagaagtttgtagtgggagtttctactaacaagacagctttagttaggcgtggcttgtaatatgttttctacttgtatttaatcagaaagcaacatgtagctgtttgtcaccactcttgcttgtaaggctgttgacaaaatcccaaccgaccattgtgattgtgtggaatactacaacgttgaatttgtaggatttttttttgtgtgatttgctttcactatcttaagtactggacatccacggctagattgattctggatgtaaaa

SEQ ID NO: 46158 - DNA, 3218 bp, Oryza sativa
attcagatgtgtgcttagacaaacttcttatcagatgtgtacttatccaaccatttatgctccatgaaggcttaaattgaaataattgaaggctttattgagataaaaaaaaagcgataccaagttcttcgcttatttttcccgatccaatacatacgtggtatgtcagtaagctgttcgtgaattacagaaccagttttaccatcgttttttcttgctacatatatgcagtatgctatacttcggcttcacgtctacgtgttatagacttccattgaaaaggaaaataactgtgaaagtgccaaaaatgaaacgataatactgctcttctgcacctctcaaagctttggccttggggtttgtgacggttgtcctggcgtcttcgccctcctaatcagcgcctcttgggtcaacgacatgacgagctaaagcagttgcgaagacatcatagtaagttgataaacatttccatcacagaagcaatgcagaactgaactaagctttgaaacaacgaaggcatatacctctccttgtcggttgaacattcgccctgtaacaaaaccccgcccaccgtgtgcagatgggctgtcgatctgtgtttattaagggaaggtgttgccataagaacctcaagcagaaatttagttttgtgtatcatttgagaggtaaaaatcaatggcttaccacatataaaagccaatcatcagctttcacaggcttgtggaaccaaatcctgcagaacagtaacaaacaaacggtttactagcgagttgtattaattaaaatcgcagtactgggtgcggtttgctgaaacatacgagtgatcaagactgagtgagtatgtcttcagacccttctccctatgaggatttaggctgacaccagaatatagtagatccgaagcatatgctacaacacacctgtaataccatggtttaatgtcgtgcccaatcatctataatacaagaaacacggtatagtgattagatggcaaacctatgcagtgctggatcatcagaaagttttcctctggctctaaaccaataatttaagctgaaagaaattggatacatttttttagataatggaatagatgcactaatgaatcagaacaatgtattaaattgcaatgtagcaggaaatgcgataaattcttgcacaatggaattaaaattggatgttttcacagtggaatttagaatcgtgaatatgaaagtacacaagaatttcgtggtaaacttatcagttatcaccaactaggggaggagagaaggtatgagcaggctgcactgaaagaaaacacagtgtgtacataccttggtttatgttgagatgctgaatcttcacaaaacctcatttctatgggccaaggtacgaactttttcttggcagctgagttcctatattgcctgcagatgactaacagtcaagactttgccaggtggcatgcgactgtggcacgaaccaaatacagttataattgaagcttaagaagatagaatgcttgatttactaaacgtgagaaatactaccagataatttctaatttatgtaataccagatgctagattcatctgagtaatggtgacaaatatagtgtccgagaaataaatggtgacaaatataatgctttctcaataacataaaagaagtttattctgaagattaaagatgaatcatctgagaactgcattagctaggaaactatcatcatcaaatatatggttggaagtcatgaaaattacattgggaagcgaggatcagtaagtcttctttcccgtatctcttccagattcaggagctgcatttgattacctattaattatcaattcttctttcccatatacattacaggaaaggaaaaaaaattacctcttctggaggaggaacatcaggcatgattgcagcttgatgctcaaaccctaattcgtctttctgcaacataattgatcatgcagaagttagataccatctattcttctgctggcagatttagtctcacgaaccttttggcttaatgtataaagtagtataaacatgaaaatacacatttcctcaggatttaacaagagttcaaacagttcgttatcgttgacagcgttcagtatgaatattgaatattgcaaaaagaacattctactggtccctctagtcacaaaaaaagtttataaacaatgatgtggtctccacaacacagttttgaccactacctttactgtaatatattgttaaaagtgtagttaaaattttactccctatggtcataaatatttgacgtttaggacaagattgtcaaacatttaaaactttaactatcagttttatattagaataggcttaccaaatctagtaagttcatgatattaagatattatttttaaaaataaatctgtctatacccattttttgtttttaaactaagcatttgagaagctattcatggtcgaagtttcaaaagttttaataattcttgtcctaaacaccaaatatttatgatgggagggagttgagcttgtttgcttctttgccaaacccaaccttaccaaataatgcactgctacaaaaatgtcgctcatttggtttgtaggaatgaagccacaaatttgtcattgccaattttttttggtttggttaacttaagcactagcctagtctaaaaattttggtatcactcaaaacagccacctccaccaatttttttggcttgccaaatcttgccattgccaaaaaattggcaaggctagcaatggaagagaaccaaacaggcccaaaatggaagccatcgagagaatcaaatgcttgatcaatactaatatgccaaaattttcctgaggctgtacattgttcacaaaactgggtaccagaaggataaacacctggaatgaagcaatcaaggtgaaaatgacaaggcccttttgctttgcctccacttttctggtggcaaagcttgttccatcgcgcgcccgatgaacctgatatattattggcactacaacagaggacaaaacagaaacagacatgatcagatttattctttttttcaaataaataaaattacactgcataattatttgcagcttactaagatgacagctcaaagatagactcataaaaaagtttgcacaaattaatccactgctcatttctaagtcagggacaatgcataatttggaaggcagagtaaagctttgtcttaaaccatcctttcttgatctaat

SEQ ID NO: 46159 - DNA, 20903 bp, Oryza sativa
  unsure (1)..(20903): unsure at all n locations
catgtgtggcgtgtgaggcatggagtaactcaaagctaccagtattcgtactagtatccctccaattaacttttgatatttttggacaatatataatacggttttagaagtatgtccttgattatgttttttttacctttttgttacaatatatatataacaaaaaaaattacattttttttaaagacagatctatctacgatgttatagtgcttttaaactaaatatttttaaagatattgatgatcaaataaaagttttatcttaatctcatctaaaacgtcaaaatttatgaaacaggagagagtattacacttctcatctcgcaacgaaatcaaagcaagccggaaaagcccggaatgtgtgtgcgtgtcaactttagatcagcacaagtcaatttcggaatatatgttttggacaaagaatgcattacggaatagtaatatctactttgttcctcctgttatgctgcaactttgctcctgctaatttactcactgttactacttcatgacaaaaatacaactatatagtactactggtttatttttttttataaaattagctatggtatcccaattcaataagctctgcagatagtatggcctcttctgagttctcaccctggcactgtagaaagcttcggtacacaggccttctgcttgcttccttctccaggtacatgcctgttgaaagcaaagcttcaattttgtttctaactttacttttttcttgtgaggatgggcacagggggcacatgagcaaaagttgaggcagtggactactagagacctttccttaatctaatctgtgatgatggattctcgttaagcatatgttctttccactctaagatacggctgatttgatccctcattggatttggaacgcttttcaaaatgcttgtttggttttgtcgatatctcgcccaatccggtggctctctctcagctgcagctgctcccaccactatccaacaattgcagtggcagtggcagtggcacatctgctgcttttgtctcggaaatgacatgtacatactgtttgctgcatagaataattgcttttctcggaaatgacacacagcgcagtgcgagagcatcaaagggggattggtcatgggaagcggcaccctggctttcccgtcaggcacaaccctttttatcaattcatgctgctctatgcccatgttcagtacagtttctgttactactagcattgacatggcactaaaaaaaaaaaatccgtagacagtacctcttgtacaagagacagccagccaccaaaactagaacctgtaaataggaataatgattaatcgatgacagtggcaaaagctatcggcatcgttatagtacttgcctaatcaccagcggtccagacttcttctctcctactactatgatcctatcctatcattgccgaggtgttttctgtttggacctgtttatttggaaaacacggtgcaaaagcggcctatcaccattccggcccatgccacaatccgtcagcccaacaaactgcaaaagattgcgtagcccatcaacggtcggcctgtcactaccacagcaaaaatccccacgcttctccaccgccgcggcgcgcctccgcctctctccccatccgctgcccgaactccgaccacaccgcaccggaaaaatatcccgaacacggtgaagccactcgcgccgcgcacgctccgcctacgcctcctccaccccatgtccgcccccgcgcccgcctcgccgcccgcctccctcttccacctttcccgcccggcggccgggcccagggcgcgcccgagggtgtcgcggtccaggtgcgtggcgtcgctcgcgtcccagccgccgacgccgccgcccgcgaacgcgaaccacctcgtgcagacgctgtgcgccagcggccgcctcgcgcgcgccgcggcgctcctccagggcctccccgcgcccacgcagcgcacctacaagtcggtcctcctcgccgccgcgcgggccggggacgcggcgctcgccgcggccgtgcaccggcggctcaaggcggaccccgtcttccgctccgacccgttcctctccacccgcctcatcgacgcctacgcgtcgctcggcgagctcccggccgcacgccaggtgttcgacgaggcgcccgtgaagagcatcttcgtgtggaacgcgctgctcaaggcgctcgcgctcgccgaccatggcgaggaggccctcgcgcgcctggctgacatggggcggctccgcgttccggtcgacagctacagctacgcgcacggactcaaggcctgcattgccgcatcaacgtctcatgtgccggcgtcggccctcgtacgcgagatacatgcgcatgctgtccgtcgtggctacggattgcacacacatgtcgccaccactcttattgactgctacgcaaagcttggaatcgtcagctatgctgagagtgtgtttgctacaatgccagagaggaatgttgtgtcgtggactgccatgattgggtgctatgccaagaacgagagaccaggtgatgccattttgctattccaggagatggtggcttctgatgaagaccttgtacccaattcagtcacaatagtatgcatcttgcatgcttttgctggagttaacgctctcgggcagggcaaattgttgcatgcgtatatcctccggaggggttttgactcacttgtttcagttctgaacgcattgatggcgatgtacatgaaatgtggatgtcttgaagctgggcggcatatctttgatttaataggacaccggaaggatgttgtgtcatggaatacactcatatctggatatgggatgcatggatttggccatgaagcggttcaggtgtttgaagacatgacccaaatgggcgtttcacccaatatcatcacatttatcagtgtccttggggcttgtagccatgctggactcgtggatgaggggaagaggctgtttgagtcgatggtggattataatgtcacccctcgtgcagagcactatgcctgcatggtagatctccttggtcgtgccgggcatttggacgaagccgttgagctcatacagggaatgcacattaggccgagtcctcaagtgtggggctcacttcttggtgcttgcaggattcatcgccatgtggagtatgcggagatggcttgctcacaactctttgatcttgagcctagaaatgctggaaattatgtactccttgctgatatctatgctcgagctaagttgcatagtgaagttggtgtgctaaaggatcttcttgaggagcatgcgttggagaaggtgcctggatgcagctggatagaggtgaagaagagattgcacatgtttgtctctgtggacaacaagaatcctcagattgaggagctccaagctctgataggtgagtttgtgacacagatgaagaatgatggctatgtgcctgacacaggagctgttttgtatgatattgaagaagaagagaaggagaagattttgcttgggcacagtgagaagctagctgttgccttcgggcttatcaacactggcaggggagaagtcatcaggatcaccaagaacctcaggctatgtgaggactgtcattccgtcaccaagttcatctccaaatatgcagagcgagagattattgtgagggatgtgaatcggtttcaccacttcagggatggaatttgttcatgtggggattattggtgaagatgctgcggactctattaatgttttttgggagctttactgatttatacagaataaccactgaagacgtaggaattgttgtatagcctaacatattgattagactagccatcatgactcagtctttcaggaggtacctcaaaagattgctgagttgtttgtttggagagaattggaatctctgccagacaattttgatacatttgtgatggatccctgtttaacacatcagtagtagtaacggtatcctgacacatttggaatggtgatggtactgtggataccagacatggatgtaatattgtaatatccccacctaatgttgacactgatacgagagtatctaccatctgtcatggttagaggccctgagctgggagattgatattcatctctgtaatttgttatgcaatactgcaatgggatgcattacgaatagctgctagaattctgaacttcttaagttgtgaaatgctgggaattttcgtccgagacttattggcgatttctaatataactgtctttatctaaacagatcagatacgggatggttcagttgaggctccagtctgatgattaggcttctgcgatgtgcatgtctccggcttcagcagcagaccgccctacaccagccagatctttatcatggaaagcaccagcgtcgccacgctcaggtactttcatatgtgcattctatggaaaataaatctgagatgttcatctaaagccatctagcagttttacatctagtaccatagacgtgtccatgaaagccaatatagttacatgtagctactacgacattggcataaattattcatggtacaatgaataataaggaataccacacaactacgtagcaacaccatagtacatagtactataagtttctgacctacttcgcccttcattacttcctgctttgacatgctttcgtgctcccattgcatgtcatgaagagaagcagctctcaaggaggagcacggtgagcgtctgcaaaaaattgctctacaacagctccttcacaagccacttcacctgaaaccagagatgttgaaggttagtaatcagtagtatgccatctttcaaaataaaagaacactacctacctcactgcaaagggagctccctgtgggtgtaaacaactcccttgtcgccgttcactacttgtccacttcctcgtaaaatgctatatataacgaaaaaccaatgcacacatattacatgaagatactagtagtaaatacaaaactactgattttttccatctgtttagtatgataataacatttagctgaaaaaatattgtatgatgataaaatgctagatgcagaaaacatcttgcacaatagtattgtccttaatgtttggacatgaagacaatatggcatgataaccctaccatcgagttgttaggagtccatcaacgccaacaggcccccgagcatgtatgcgccctgtgcttatgccaacctatatttgataaaggaaagaaaataggggactgaatgaaacgctgaccattcaatagtaacaacatatattttcgataactatttttttttgataactagttaacgaaaatgtccaagttataaagtgatacaaatttaaaggacatacctcagcacctagaccaaagcgagccccatcacagaaccgtgtgcttgcattatggaataccgcagcactgttgcaatttatagaagaataactccattaattaaggtatgtactaaaagcggcaaacataatagttgtgcaaaggaaattagttaaacacctatcaacttgctgtagaaaagtctctgctgcctttccatcagtagtgataatgcaatctgtgtgtgcactgaaatgaacatatatttaacacaatcaagtttagttcaaaaaaaaaaaaaagaaatgatggggatatagtaaggagaaaaactgcatacttccaaaaaaaaaaagtgatgaggatatagtatggagaaaaactgcataccttccatagcgatttatatggtcaattgctgactgcacatcatcaacaaattcgagggtgcatgccattgagttatactcatgatgaaatgaatctacctttggtagtttcaaagtgtcatgtgcaacaggcccgccatagataactacccctgcaacatgacatcaattaaaatccattagtgctcttctgatccccttttgctgatttgcacaagaactcgtgttgcaaagcaattttggattgactgcaacataataagtaaaatctgtaatatgctcccttgagaagcattgaaagtaattaagaacatcaaatctttgatgttgagctacataactgttcatcatttctcataataaaataaaatactccctccgtttcacaatgtaagtcattatagtattttcctcattcatattaatattaatgaatctagatggatatatatgtctagattcattaacatcaatatgaatgtgggaaatgctagaatgacttacattgtgaaacggaggaagtagcactttttgcagaacacatgtcaagatacaaatggctgcaatacttcaactacaagggtgtggattttaccttccttttcaagctccaccaataaatcgtcaaggccttctgtcctgttcagatctttatgaacaagtaacgtttcctgcacagaatataaaaaatatttagatatctgtgctcaaatgataaaattttccaagaaataaattaagtggacaaatatagaaagttagacttgaatagaatggcatcttccacagtgaactattgcttttagccagaagttcgacaacaatacttgtaagttagcatgagtggccagcaacgatgtagaacacacatacaattcgtaatatacatttttttaaaaaaaagtacaataaatagagaggtatcaccatatgggcacacgctaataaatttgtaaattagagaagtaccatggcattacacgctgctggataatcaacctttgcgtccaatacaatacgttttgccatgtccatgtcagctgatttgtcaatataaacatggcagataccgtctgtagaagaaaaaaaacattcattcaatgtatatcataataaaaaaaggaaatgtattatgcttagtttatgcaaaataaataaccattatcatactagtaatatttagtgacaagaattcaataacaaaaacaagcttaccagcatgaccaagaacaggaatcttggttgctgctttgatctgggaaacgagcttattgctacctcttggtattacaagatcaatcacatcatcaagctgcacagagtacttctggtttagattaaattcttaaatttatcacccaaagaatcactttacatactcaccttgagcaaatcagcaatttcatctttgtttttcactaggccaataagttttttaccaacaacatctggaattgcaccagttatgacctaataaaagacagcatgttggtattactgaagcctactattgcttcattaatcattactactaaatcagttagttaagtacataataccttatgcagtattgtgtttgatctcatagcttcttttcctcctttcaagagaagaccatttccacttcggattgctaaagatgcaatctgtacaatgttatgttaatatgataaataacgttgctttgtagttaactgatacagtttctttccaactaaaaaaatcattttacctgtaccaaggcatcaggacgggactcaaaaataattaggagaacacccaatgggcaatatgttttctcaaaaacaagatctttagcaacctacaaaacaagtccttcattggttacaaatcacatgaagctatgattgattgtagtacttatcacattgattgattgtagtacttatcacatcgtgtttggattttagaatagggtatatgcattcacctctgttcttttcagtgtatgggaaatagggtcctccatatcagcgatttcacgaattgatcctgcgaggctttttatcttcgaatagatattaaatatagtgaggacatttcatacaacagccaagaatcacttcaacaaataatgaacttaaagatgacaccgctcagaagatggcacatgtatctggcctacctttcctggctttatggtcatccgagcaaccaatgatttatcgtaaccaatatcttgcgccaaatccagatcagcttggttctcggatgtaattagatcttcatttgcttctagagcatcggcgatgtctagcaaaatcttcttacgctcctcagacgacaatttctgtttaggtgaccacatgcaacacaagtagttagcaaaggcagcaagaaaataaacaatattgatatttatactacttaaagacgacgacatgcctttgtaataatttaatatgacatgaagaaaacacgcaattatttgattgttttttgaagttatagcttgaaaattgcattgcctgattccttcacaaaaggaagtgaaaggaaagaatacctgtagatgtctggagcaatctcttgcagcaacggccatctcacgcgctgttgcttccttggaacaaccccactggtttgcttccctatggaaaagcgtaccgattttctctcctcgcatgaccttaataatgctatcgattgcaaatccacttcatggataataaaaatagttagaaagcagagttgaatcacaagactgctgttgggaaaatacacacaagctttcctacttactgtcttactgacaacttgaaatctattatattattaaaacagctttgaaaggaggcaccacgttcgctgtgggggctagaaattcccacgttaatcggagaaaaaagaaaaatctagaccgttagattatactgggactagaatttgatggtgtagattaactttgataatagaagtctgaatagaaaacaactgctagatcaaacggacgacactgatcaagtactagaatacaagtccaaataggtggacgtactcctgctttgattcttttcttatcctagatggacactaaggatcaatcaacaaatcaggtgattaggattcaaacacagtgcgtgcatatatattttggagccagtataattagaattaaaatgtgattttttttacctatggatgaaaaaaagagaaaatagaccagaaaacttatgcattggtagagatacatctctccgtccaactcgctaaggcgtgttcaaatttagtacggtcttaaaaactaaactttaactttaaatttttcattgtagcaacaaaatcataatcatataaaattaaatttaaatgaatatccaatgatattatttttaacaactaaaatttaatttataataaattacagctttgaaagaaggaaccacgttcgctgtagaggctagaaattcccacattaatcggagaaaaagaaaaaaaaagaaaaggagagtccaagtagaaatacaatctaaaaatagctgaaattcggaattaaaaataagcaatattgaaagaagtttccatataagaacccaatacaagattaatcaaaattcaaaataaaaataaaataaaatccaaaattagaaagaaaaaaagagacccaagtagaaatacaattttaaaatagctgaaattcgaaattaaaaataagcaatattgaaagaagtttccatataagaacccaataatcaaaattcaaaataaaaataaaaataaaataaaacaaaattagaaaataaaaggatagtccaagtaggaatacaattttaaaatagctgaaaatcggaattaaaataaggaatattaaaaaaagagtccacataagaacccaattacgagattaattaaaattaggaataaaaaaataaaatccgaaattagcaaaaaaaaagaagagttaaagtaggaatacaatttaaaattagcttaaatttggaattaaaaataagcaatattgaaataagaatccatataaaaacccaatacgagattaattaaaattcagaataaaaaataaaataatattcaaaattagaaaaactaaaagagagttcaagtaggaatacaattttgaaacaactgaaattgaaaataaaaaataaaaatactaaaataacacaatacgatattaattaaaatttgaaaaaaaataaattctgaaattagaaaaagaaaaataagatttcaattaggaatacaatttataaataactaaaatttgtgataaaaataaagactatttaaagaaagaccatctaaaacacatgacgagataaattaagtaagaggcctataaaggagtagagtggtggcggttgatacgacatataaaaactgttaataaaacaccaaatagaatcctaataacgattaaaaggagggacgataggcaggccgtgaagcaaacgagcaatgtgattgccgggactactagaaagtaaaaaaaaaaccccattgataatcatattcaatttttaaaatctcaatgacaataaaaagaagcagtgggcggggtgtatagtagtatagttttagagccggtgatgtttgacgtgacttctagaaaataaaaaatgaattgcaacgatagttgtgcttaatttttagaatcacaatgataataaagaaagagtaggcggcggacgggccataaaggagcatagtggcattgtttgacgagacttctaaaaattataaaaaataaaacccaacaagacaataaactctaaaaactacaaggttcaatttttaaaggttccgaacttcgaaaaggtaaaaaaaaacaatgataatcatgttcgattttaaaatctcaatgacaataaagaagggactcagcgggcgagccgtagagaagtacaatggaaaagccgctgatggtttggcgggatttctagaaagtaaaaatgaaccgaaacgataattatgttcgatttttaaaatctcaatgacaataaagaaaagagacagtagacgggccatagaggagtataatggcaacgtttgacgggacgtctagaaattataaaaacgaaacccaacatgacaataaactctaaaaactataagatctaatttttaaaggtttcaaggagaatgaatagaaatagtggtatatcgagcaagcaaataaagaaggagatgtcataaggggtagcaactggtgtgacttttaaaaaatatatataattagaaacacggggatgataaggtttaatctttcaaactcttaagacatgagatagctatttaataaattttaagtaaaatcatactaaaaaattatatgattttatttaggtgctagccgcgcaattgcgcgggctacccagctagtttcataataacacaccaaatgtaggaattaagatgcagcactttgatactattgaatactgtctctaccagagcctcgtacaggtggttaatagtagcaactaaagcagtccacgagttttctaaaacaaaattgtgatgcaggcatgcagctgctctccattctcaactattattatcaggaaagtgcttccaaaatatcaaaatattaccgtcttagtcaatgtgtaaacacttgtgtacaaatacaacaccacgtgacagtgtaactaaccatcataagtagaacatatagttcttatacactgaaaaataatataaatcgttgttgcagttgcagtatattatcttttagacatatatttattggttaacatttgtgctacaattcatgcaacgatagaagaaaacaagctttactcacctggcaattacaacaggtattccttttgatgaagcagtaaaagcagctgctactttagcttgcattccacctcttcccacacgagatttctccccaaagctaattaacttcccatgttgttcatggacgtatgtgtggataatcttcgattgtggatcgctaggtggaccgctatagagcccctccacatcactgagcatgataaggagatcagctttaagttcttgcgctaacagtctggccaaactatcgttatcccagaatatgccagatgaatcctacacacggttgatcattacaatcagtaaagtgtaaaaggttagtgtttgttgttaatggaatttggaatacgtatatatcagtgaagctcccagtgcacacaaatcacattaggaaacacacctcgtatggttgcctcctggtactgatggcgtcattctcattaaatactggtataaccttgagatctaacagagaattaacagtctcgcggagctggttcccaaaacttggatccataaaatcacgatccgtaacaagaagctgagatgatgttacgtcaagctgcagcgaaggaagtttaacgtgtcaaaatatatgcaaaaaaatcatattttttacacaaaaatccatcaggaatggcacgccaacctggctaaataacgtgtcatagatcgccatcagcacactctgaccgacggcagcgcaggccttcccgtccatgtccatctgtgggttctgcagatcagcgaaactgcaagcaagagagagatcagaaatgaatgctacagcagaacactgtttactgttcagagccaattaactctctgcaacctgctattgacgagcttccggtacttgagcctctgcctcccaacaccaacagcaccagaggtgaccagaatcacctcgtacccctcaaaatttagctgcttcacctgggaaatttatcacaccggttaactgacactgattagcacaagctcggttggtcagagcattaacctctggtaaaaaaatttggggggaaagtttacctgttcacacagagcaccgagcctgcccatagccaaccggccattcggcccagtcacaacagcggtgccgacctgtcgaattaagccagccaacagaacatatatttagagggaaaaaaaataatatccttcattagagaatggtactaattaatgagtggtaaatagttaaacctaaaaacatatttatggtaaatagttaaacctaaaaaacgtatgaatggtaaagagttaaacataaaaatatagccatagtgattttaaattaaaaaaaatagaaaaaaaggacaaatcacgggtgacagcatatgctgtcataatggagctcataaaaattcactaaaaattacctactactgctgttcttcttatggtcacgcgttgtatgaatctatcaaacgtaagtacgaacatgaacagcacacaagaatagattagaaccactcctttggaacgcatgctgcagctcccaaaaacaaaaaatgaaataaatctattgcagtttgtaaggccattttttttgtcaggttctccgatccttcgcaaatcagatcgagagagcctcgagtttcaccgatcacagatcgcgcaaacaaactatcgtcactgaaaaaaaaaggaaacaacaaacaacaacaacggcagaacggcaggtttcacaggaagggaggacacagtcgcatgccggacgccgctgacgggatcgtcaacccgcgcatcacgtcgccctcgttcactcaccttgatgatgatgcgcttcacgtccttgacgaagccgcgggtggagtcggtgttctccacgtccgccttcgcgaccgccgccaccagccccgcgccgccgatccctcctctccccatctcctcctcctcctcctccgcgagcttggggtgggattggattggattggatttgcagggagggagaaggaatgcggcaacaagtggcgtggaacttagaccagaaacgcgagagatacggggaggggcggaggcttacacaccgccagggtgcgacggctttaaaagggggagaggaagggaggtggtggtggtggtggggatgggtggtggtagcccgtagccgcgtcccgtcccgtcgcgcgggcgtcggattacgtgtgtggcgagatcccgcccgccgccgcgatcgtctgcggcgagcggaccccgtgatggcccgtaaccatcgccgaaccgccaacgggcgctttccacatgggctcccggatctgtggaatcagcggtttgctcccaaaaatatcgccatcttctgtgttgcggtctctccctctctctagtcagcccagctcacgcaggcccagccacagtaaccacttattttaattgtggataaactgtgaactgaaatactgaccaaattcctaaaaactagtacatcactgtttcgaaataagattatttttattcgctcctgtttattctaaaataagtttatttttaaacaatcgttgtattagagtttataaaagcatggggcaaagcattgggagtagataaaatatgaaataattatattgaaatttgataaaatgatgataatattttttatttgatatgtatagcacgaatgaaaaatatacttattttcgagatagtggacataaagaatgtttcatggagatatacttaacaagattattcctaccgttttcacgtacaaattcctaaattcatttacttcaatcggttgcaaccaaaacattcgacatgcatgatacgacgatgacagattttaaggtgtttatttcgtggtgcttttgctagctaacgtggatattgacaaatcgtgtgttccacataaatacacacttgtctaccctccattcatccactccattgctccagtctgtcctcgtctcctctctgtttctcccacacacacgtacaccgtaccattcgtaagaccctctgcgtgcagaggatcaaacgttcctgacttgctgctgccgtctatcattggaaccatacgtgtcacgtaggtgtgtcctatctgatcagccatggacggggacgacggatggtgcttgttgtctccacaatgcaatcattagtccataacacgcacttcccacaaaaaaatcaatatcaaatactgtaatacttgggacattttcagggtagaagacaaaatgttgaaacgtgtacagccagtcgtttcatagcacacgtgctccacggtaagaaaattggatagccgcagatcgacctccaatacacggttaacacacggtcgcactaaaatcacacacgtcctagcttgtatagcatttcgatctacatctgagattaatcccgagatgaatcccaagagaaatagggaaaatactatagttttattgattttgatttgagtggattatattgctcgatttgattataagttatgttaaatattttaagaaataaacttgataaatagtgtaaaacaataatcttagcattgcgataaaataaaggttttttttaaaaatgcatttttttaaagaataaaataaataatccattttactaaccagatgagtaatttgaaagaattggattaagaccatcgtggtacgaagtgtaaggttattatgggccagaagttcatgagcgtgtaaagtgcattagtgtttaccctcttgatagaaaaataaatggtagcgcatacatagtttgaagtctgggcatttcaacaatcaacaatttttaatgatctgtttggcatggctttaaatctccaataataacatccccatcattttatttatgtttatgcttattcacttggcttatcattaactaaaaataataatctatagctaaatgttttacagacatgttcttagcgattcaaaagtagatgttataaaataaactacgatgaaacaaaaatatcacaaaattaagtaaaaaaattatcaaaatttggcttatataagtataaacataagtgaaatgatgggattattagattcttgcataaaatagggtaacctagtatattcccgattacttctaaaaaaaacaaaatttgagctaaagatactagatttaaaaattgtatatgaagttgtgacaagtatcgctttatacatggcatgttttttttgccaaaaaagaaaagctacagctgtgttcttttggtacgggaatacatgtacagctatgtactccaggtggtactcctactccggtcacaccgtcacagtatcgccaagttttttaaagacctgataagttttcatgtgattgagttgtcgccttgtgttcaccagatgtaaatgatgttgccccctatgcacttcagattgatacagtagttcctactagtatgtatggcatcttagctgagacaacggagatcagcagttcagcacaatggatattgcgtttgcacgctgcaacatgtgcagggtgaaggtaggcgatctgtgtccaaagtgttgagtcagtttcagtagtatgtatacggccggagtaccatactttcgctgcttgattcgaacttttctgcactgtatttgcccagtcgatctgtataaaaatgaatactactactactactactacatgacagttatagagacgtgtgtgataacacatcaaataggcaaaatagctactgcaccaatagcaagcccctaacatgcacggaccagcctcagatgcacaaaagacgcattcccgtttgttttcttctattgtggccttgtatttaggtcctgctcttaccgagatgcgtgcgcatgcatgcaccgattgcttgtcaggtcgcggcgcgcagatcgtgcagagatcgatgcacatgcatggttgggaggaagttgcagacttcaattactgttgcaatccagatatttatggatggagcatgctctccgctgggtctcaaagaaaaggtaagcaactggccgatgcactccggcaaaagtgcggctgttagatgaacgatgaaaacagattttgactgttgacagcgtctgcgttgtatccgtgatctttgctttctgcaatttgttgatttaacattgatttaaaatgtgcatgcttatataaacaaaaaggtctgggtggtgtagttggtgatcacgttagtctcacacactaaaggtctccagttcgaacctggacttagacacagttacaatgtttttttagttaaactttataaaattcatcctattggctcagacacaattaaaaaattcatcctattggctcagacattgcaattatttattgagttaaactttataaaatttatcctatgggctcagacattgcaattacattatttttttgttgagttaaactttaaaatttatcctatgagaagagttatgagttttctcgagttaaaattcagcctatgattttttttttgagttgagatttaaaatttatccaatgatatgagttttctcgagttaaaatttagcctatgagttttttggcattgactttttttttactgagttaaaatttatcctatgagtttttgcaaaatttctcttctggcattgacaattttttttttgctgagttaaaatttatcctatgagttttgcaaaaattctcttctttgtatttgcaaaatttctcttattttttgcattgacatttttttcactgagttaaaacttctcccatgagtttttgcacgctcagacattgcagttttttacattgacaatttttttttgctgagttgaaattttgctatgagtttttgaactctttcaaatatggtcaatcctttcaagagctgaaaattcaatggaacatttgacggcgagcatgggcagctgcccgtggtagccggatggtggctttgccgttgctttgtaggactaattttaaattttagaattgcattctttgttggacagagggtgagacattgacaattcttttttttttttgctaagttgaaattttgctatgagtttttgcactctttcaaaatttattgctgagttaaaattctcctataagtttctgcagtctctatagtatagctgagccagaaagatttttaaccctgagcaaaactcaaactatatccagttctatggtcaatcctttcaagagctaaaaattcaatggaacgtttgacagcgagcggggcggctgcctgtggtatctgggcggtggcttcgccactgctttgtaggacaaattttaaattttagaattacattctttgttggacatagggcgagtttattggcaaaactgataaatattttactgattgagttttgtgcacgggcaaaattgataacttttttttgctgagttttgtaattgttttttcgtgagttttgtacgttggcaaaactgacaaattttctcatatgagtttctgcactctttgttggacaaattttagaattacattctttgctcgacggagggtgagttcaagtacattggcaaaaaaaatgattttttttcttctttcctctctatagctatgagttttgtatattaccaattgtctctcttcaccaaattgccagtgtgtttttctcttttatacattggcaattcatttatttcttttctcaagcaaattcatttttcttaatcttttctacattgtcattcatccaaattttgtctcttttgttacttctaaacaaagttgagtttgaactttgatttggtgtgaatgtattttacgcctacaactatttctagtaattttttttcatgaatttagagaacttttaaatccggttttcacgggtattcacatatttgatgttttttcagtgggtattccccattatcaattcaagagacttgtttatcttttgtgacggttgttatcccaatcaaaattttaaaacttccgcatatttttttcctcctaatcagtggttggggcacttagcataatctgacgacaatagatatgctagaagcctagaatcaatgtgccacacagctccgcctaacagatgctccctatggtcacttttacatagcttttaggacataaaattagtgagtgatttaatatgattttgttgtctcaaactttaaatatattgacatgagggagtaggagcatgtggtagatggtgatgctactcaacgtgcaatagtctagctaaaccaaaatgcaacagaaaggagcctcattgaagaaatggctacgaagttattctactannnnnnnnnnnnnnnnnnnnnggatcctctgccgtagatacagtagccataagcccataactgataggttaattcgatccataccattacaaatagggaaaagtctaaattaccccataaaatattgggtgagtacgaattacccccttagactcgaaaaacagatatctttcatcctcaactattaatatataccggacgaactactctcctaattcaatccggagtggttttggttatacatggtagtttagttggcattttttttctaaaaaaaggtgggaccacctgtcatattctctccctcaccctctctcttctccctctgattctcatccaaattggctactaggggtagcgagcggtgagcggtgggaggcgttgggaccatagttattaagaccggaccgataaatgaaccgattgagctctcggttcactggtttagtggtcggaccactggtttgtccggtccaaccacggtttgattagtaatatagaataaatgtttatataatagcacaagcggtacgatggtggcatggctaccgtgtggtgctctcaatcctatgacttgaggttgaatcctcatctccaccaattttcttgggattttaatctccggtttatataaaaaccgctcaagttaaccggttttctccgattttaatccctggtttatataaaaactgcccaagttaatcggtcaattttcttgagattttaatcctcggtttatataaaaaccgcccaagttaaccggtttctccaccaattttcttaggattttaatccccggtttatataaaaactgcccatgttaaccggttttctcctattttaatccctggtttatataaaaaccgcccaagttaactggtttctccaccaattttcttggtattttaatccccggtttatataaaaactacccaagttaactggttttctccggcctgattgcatgcccgatcttttaaggggactggactggcgggggctctggttccctttttttccagtcgaaccaccgccggtggcaagtggcaagcggtggaggcgcctcctcctcggcctccagcagagacgactgaaaggatggagaggggacaccgccaggcggcgttcctcatcggcggatggaaaggggacacgacgagtggcggatgcggcttcaggcagcgagtggcggaggtatccctcgttgtctatctggtgggccatgccgttgaccgcctaggaccccacgccgttcctcgtcgccctccacctccggctcgctgcttgtggagccgcctccaccccgccactcgtagctcaccgcccccagccaccaatttgggagagaatcggagggagaagagagcggggcgaggggcgaggaagagaatatgacatgtgggtgtcacccttttttaagaaaaaaatgctgactggactaccacgtaggaccaaaaccactccatattgagttagggggtaattcgtctggtattaatacttgagggtgaaagatttctagttttcggatctaagagagtaattcatacgcacacaatagttcaagggtaattcagacttttcccttacaaatatgttatttcagataaatgtcattacaattcgtttattcaaatcgtagtcatgtcattgaaattttataaaattagaaccgtgccactaccgtcacatttttcatcttttttttctttcctataagtgggacccacccgttagattaatcttctttctcccctcttttcttggggtctgtttagattgatgtcattttcaaccataccatttttttttgtcaaagttacttaaaaaatgtctacatttagtttgctgctaaatttaacaaatactttgtccataagaaatcctgctaaaattgacaatgccaaaatttggtaagatttattttggctacaatctgaacatgtccatattttcctatctacgctcgccgctggtaagggaggtggcgatagctcctcactcatcggcgccatgggcaccgctgccaagaacagctgcattgacgacgtcatcctcctcattatggcgtaggcccagcccgcgcagctcgcacctgttaggcccgatcaaaatcacagcaccgctgttgctttttcattctgcccgacgcgtaagcctccgataccgcataagccttaaaatataagtatttagcaagat

SEQ ID NO: 46160 - DNA, 4231 bp, Oryza sativa
  unsure (1)..(4231): unsure at all n locations
tagagaaagaagatagaaaacataacggcagtggcacgattataattttgtaaaatttcagtgacacggctacaaatagacgcactgtaataatatttatctaaaatgttatattttcaatgacatggattgaattaaacccttacatctaaacttgcgtgtcagtgtctcacaatacatcagtagtgctacagacaatctccagttccccgctgccaggaaccaatgctggattgcgggaatcaaccaaaaaatggctatcatctcgggtgatcatattactcgatctgacccgttgatctatagaatgggcggtcaaaaaacgggtccagtactccagtcatgtaccaacccttcgtcccaagtgccaactgcgcctgtccgatcggttccgatccgaccaagccacacgtcgccgaatccgaacagctcttccacgaaccacttgcccctcctcacgccctctcctcgtcggtttcgaaccatctagaagcgtcgccgccgactcgccatctcctctctaggtcaccggatttcctagccggcggcgagctcgtcggctcaggcggcggcggcggcggcgatggactggagctccgtgactgcggaggatctggtggacgcgctgcgggaggtggactggtcgacgccgccgcgccccgtctccgagttcttctcccgcttcaccgccccgcgatcctactccaagtggaccagccgcctcaagtgcaacctctactagtaagtagtacggcttctatctcgaatctacctcccacctctgtgcctctcctcacgaatcgaagaatgagtgagctagattggttggcccactgtgatttgggttaaatcgggttggaatagggggcgatgcatgaggtgccaactgtttagattcatttggaacgatacgttagctgctgcagagatgtttcacatttaatgtgtgtagggcatcgatctgaattctacttttggagttaaacgtggaatctagatttgattataacttgttctgtgaggtgtacgtttgctgataattctagttaggtgtagctcactaaatcgtgacttgaaatttattggtagcttggctacatcatggaattttatatgtgagacttaggggagtataaaaggtgcataatcaaaacttccgtgatgtttccatattatagtaaaccacacggttatcctctgagtgtgatacaatattttgtatggaaccgatgatcaacagtaacctataatcatagaatatgtgaacaggtactttgattttaacgtgtaaataggaaggcagcatatcgatattatttaggaatagaacctggaagttcctctaccattttacattagaacttatattgtaaatacatatttgttttgtaccatgttacatctttcaacaaagttaatttccaacgtttttgctggtttgcagctacaggacgaactacttcatcttgatcatgttcattcttggtaggcagagagacctctatgtgctgtactcccccaacccccccatccctactatttttttgactttcatatagtcatcttgtgtctctctttttgcagggatgggctttctccggaaaccagtttccatccttgcagctttttcaacaggcctcagcattgcatttctcaatgacaggtaagtttggattcaattgaaggcaccgttagtgctcttgggaagaaagatattttgcactttacaagctgttcttcctttaacctgcaaatgtgacattaacccctatttcgcatgtcgcattccttccaacacataaatgttgtttgattttgaatctgctaagcatctgctgttattattatcaatggatatagattgggagacatctgcatttcatattttagcttaagggctcatatcagcactcttgcaccagttatatgttaacaacttaacactttgttttttcttccccttaatgaaatgatacgctgttcttctatgtttttgagaaaaaaaaacttaacactcattagataactgacagattttatgctcatatgtgtatttctgtagtcaattcctatgtttgtccactccactagaaatagtgatactcccactagaactgctttttcaaatgattcatgtttgatatgcagttttgcagttacattcaatgagaaagtcacaaggacagtcagacaattttcaccacatttagcagcaaagatgaggccacccttaaggtggggatcctctccccctatttcttctataacattcttctttttttaaagagtctcagaagaacgggctaacaacattgctgatatttgcagacctgtcattcgtggccgaccaagctcaaaaagatcaattcatatttgtggccggcctcgatgggtttttgttgtattattttctgtcggttagtataaagcactgacctccatacatactattctagaccatagttttttttttataaaaaaaacaactaaataaataatgaactcaacatataatttattttatttttgcagtaagctgcttcctctggatgacctcatgtagtctccttacggttctgtgggcactaattgttggtctgcttggtaaggccaaacttgaggtttaaaattttaaaattgtgcatgtgtgcctaatatataagtttgtgccttgcagcaaccttgcttcacgccagtttcagaacacctaatctgaaagcacgcctgaacacattcagggaggaatttcgagcagtatggcggaattatagcgagttttaaacgccctttttgtctaccccatgtgagtgccttcatcgctgtcttatggtcgaaaattgaatctagcgaagggcttaaagtgctacctgttctgtcagtgcatcattgtggagctgcttattggatgtctctgcggtggtgcaatgtagaaggacctacttcagtgtgctttcgaatttcttgattttctctgcagatttatgtggtaaaaatgttaccaagttccatatctctgctgcctcttgcgactctttaattgtgggagattaaaaataggcatgctattttctccagtttatggatttggctttagattgtggattattctagtcccccaccacatggatctccatagttttagcttctggtccaaaacttctactgtattttgatacattggggaaggaacagcatgtaaaagagacagctatcctgaagagaagaaaaaagatattgttgtgaaatgcctgttatttttcatcgttcttttacagtaatggcacattttgtttcacataggtgatttccattcttttagatttctccatcaaaaagctcctcgtaggttttgtagacactctcggggtgagcaaatccatctcctctgatttgcttaacctgtccaacatgaacaatgcattttcagttattacaattccaatacaaggcctacaactacaagaaacccttggcgtatccactatacttgcattttgttcaatagtacttttttctgtactggttactaacttatcggaagttcagaactgtatgaagtttattcatccggaattgcataagatatgaagacagaagtgaaactgttttctgcacttgagacagctgaaaggttggatgcacttgcctgttcgatttcagagagcttggcacacagttcctcaggaatagaccaaccaaacagatccatgttctccttcaacctcgcctcactgacgctcttgggaagcacactctgaccctgctgaagaccccagcgcagagcaacctgagccggagttcttcctagcatctcggctaccgatggcaacaccgaatcaacggcgatgcccttcatcctgcccaatggagcatacgcctgcaagaatcatgtgagcagtgaaccacagcacaatgctactactacatatcaagtgatcgatgagctcagaaacatgcaggacttacagagagatgaacgccactggtgtggcagaacgctctgagcttcgcctgctgccagcccgggtggcactcgacctgatcaacggccggagggacgcgggcgacgcagagcagatcgcnnnnnnnnnnnnnnnnnnnnnnnnnnnnnnnnnnnnnnnnnnnctgctctgcgtcgcccgcgtccctccggccgttgttcaggtcgagtgccacccgggctggcagcaggcgaagctcagagcgtactgcccctccagtggcgttcatc

SEQ ID NO: 46161 - DNA, 13921 bp, Oryza sativa
aatgccggtcctgacctccaaatgagctcatcacataggcgtcactgacttcctccagtccgaaacggtgagctaggttggccgggagagcagccgggagaggctcggcgatgcagaccctgttgttctggtgaagaccaagggtgagggagacaccgccattgccgcctccgataccaacaccgccgacctgctggtgctgatgatgtggtgatgcaatgttgtgctgcgaggtcagcccgttgtatgcgaagctcacctgtccctggatggactgggacatctgggagagctcatccgggaagccctgggaggcagcggtgttgtggttccgagttatgctgctgctctgtccaggatgggagtccgaaggaacggagggattcccgctgcactgcgaagaatgctgggcctgatgatgcacgctatgctggcccttgtcaaccaccgagtgcttgtgcatttgcctcatctctaggttgtgaatttctttcaccattggcttccacaacctaacccttgcgttgataaaccagttcgatacctgcaccagcatcacaaattcaatcaaaatgtcctgaaaacaaacaatctagcctgatatactgtgcaatctattcttgaacacacctagaagcatttctatttacctggttgcgtgtcaagcctgtttgttttgctagcatttgcttatcaccatcggtaggatacctgcacgattggaatctgaaaatgtcactgatgcaaaattatagtgttttctaaaagaacaaagtaccagatatagcgcataatcaaataatcaagaaatttccgctattacaaaagacacttgtgatgtgcatgcttaacgatggtttacaggatcacaacaaatattttacatggcgaatatccaagcaaagatgtaggcaaacacatcttccaagtcgaaccttacaaaggatttgatcaatacgggaactaataacactaggaccaacatctgacaaataatggatttcagtgacttttttaaagatgatgactgatcctttttttaaagtaataaacagacagacaaaccccttactggatgaaaatggctagcactaaactactgtactaattatctcaaactgaatatctcgagcacatgtcaatcaacttgatgtaaccaccagtagggcttagctacagcctttagatcatatatataatgcaaaatgatcatactacaaaaactaaaaagaatatgccaaacaaactacattatgatgatgcttattatagcctaaggtatgtacttttaagatttagttcgaagtaatgcccatctggcaagttaattccagcattaacgtgttctaaaagccactctacttatgagaagccgggccaccacattcatacattacagccagaaacaacaaatccaggaagttaatacgtgattaagaatgcatcaaacaagcagcaggaatgccactatttagatcaccaagtcgaaagtatgatctctagtagtacagctcaacacacagttaggtacaggtttaaaagttatgttaatgatggattggaagccatgcctgcatgaggccatagccttctatcagacaggcagggtcgcttgctatcaccaaaccatcaacggatcaaccccacggttccagtgtcacgtactactgatcatatcaaaaaggaacaaccacactcaccacaaatgcttagggactactgttatcctcatctaaagcaagcaactgtagcatcatcatcattgtcttggaatgcgtgcagctaatgaacccagagttaaccataaagcaataagaagatcaaagggcttacgggtgcaggaagtgttcgaacagccacgcgcgtaaaacggacacagcgcgctcggggagccccctctgtgggcgccaaatattgtgcggctggccgaacgcgctcgcgctgttcgctcgctggaggccggcgccgccgctgcttcccccggcgagcccgaacacggcgatctccttgtttagcccgtccttcacagcgaccttgttgctcgtgttgcgcagctggttcagaatcatgctcttcaagcacttgaagtgcttcgccatcgccctcagcgccaatgccgcgaacggcgcggcgttgctgaacccggcgacggtctcgaacgaggccatcacagcctgaacctgctggtagtactgccggtacctcttgcaaacctaaaaaaagatattgctgttgggttagaattcgatgagagataatctaccaacaaagaatgattagataaaaagatatccatgttaggaaaaggaagcagtgtgcttttgttttcatgtggatatgacacgaacaaagcaagcgtagctcccaattatgggagagagatgttattgaagaacacaggcaaacaaaattgccttacagagggttccaaaaatagaagctttctacattgtactcctacgtagatgctcatgtagtatactcctaattgccatgctccgacatcgtagaggagagcgcatttcaaagctcgaagcttttagcagcgccactattctcaccagaggacaccaacaagagagaattaatggcatctggcatcgcccatgggtcatgtctcaagactttgaaaggacggttagttctaatttcatgtggaggactatcttttcaagcactcacagtagtgctaaacagccgatcaaaatacaatctttggtgataagacgcggaggaacactactattcatcatgaacagtgcagaactgtacaagctcaaaccactcgaggaaaaagaagagagagaacaaatcaaaagatgtatcagcagcaaaggaaatcatcatcaaatcaaaagcacatgcaaccacagtaaataaaagcaatccgcaactgcatcggtgacatgaccactatgtgcaagattcttctccacccaggagtagcgataattgtaacgccgaaacaaggtgaaaaagatggtcgccacaagaaacctggaaggaggaattgaggcggctagcggagctcactcacctcttccatcatggagatgagcttcgtcttcttccactgctgctcggcccccgagatggggccagcgtcggccgctgcgcggtcagcgccgccgaggtcgtgatcaacgacgtcatgatcgacgccgtccatcggatccgcgtcgagcaggccctcgtcggagatggtgcggtcgacgtgcgaagcagcgccgccgacgtcgcagatctcctcgaacagcttctctgccgggccgaggaaacgggaccggccgagcacggcggcgtagccggtgaagggaccgaacggccccgtggcctgcgcgaggccgccgagctgcctcctcggctgcgcctgcggtggtggaggattcgacgacgcggaggagagcgacagcgagaagttctgcgtcgggatctgcgggagcggcggcgccagcccgtgcgccaccagctgcgcctgcgctagagtagggctgtgcggggagtacgacgacgacgaggacgcgtacgagtagaacgccgggggcggaggccacgacccgtgctgctgctgctgctgcggggcatgaccatgaccatgaccatgaggcggtggcgagtccccggcgtccggcgggaaccggagcttctcgcgccggctgtgctggggcacgtggtacatctgcccgcccgccgccgcggccgctgccgcaacggccgcgccggccacgtgctgcggatggtggtggagcaggaggtgaccggcgtgcccgtggtggtggtggtggtgctccgcgcctccaccctggccgccgccgtacccgccgcccccagcggcggacgacatggcgcgcacgcacgtacggtcgtgggtctcttctcctcggcgcgcgcgcgggtgggcacgtagtacgggtggtgcgtgcgaagaggcgcagcgcagtgagcacctggccctggagagagtggagatagaggggaaacggctccgcactttccgagcgcccgggcctggcttggctggcctggtctcactccctcatcactctcccgctctgcttctgctgctgctgtagtgtagcctccctctcccaccccgacccctcgcgtcctcttgttgttttcctcctctttttccccgtttcgcctttgtgctgggtgttgttgctgggttcgtggcgcctttctttctgcaaaggcgagacacggagggggagaaagaggggggtggcgggagggagagatgggaaggaaatggtaagccgtgaaactgtgaaagcgaaagcagaaaggccgagcgcgacgggggagaggagtggagactggagagcgcgcatcgcgtgtaaaaataggtgcagccgcgcttgtcatccgagtgggtgggtgggctgtttggctgccaggacgtgtccgggcctgcagcgtacttgcccttggcgcggcgcgatcagcccttggctggctcgttacgagggaaaaaaaaatgattttcatcttcccttgttttactgcggctgcccgcggttggtactcccacctgtgggggtttgaccattccaagctacgagtagaaaacattccatgtgcagtgcgattaagtcccccattataaatgttgtcctaactggctttcgtacaaacacccatctccctgctttcgaattccacctctgctgcagcaacaatttttgcgtgttaaccccagtactctgtacagggctgtcaaacgacaccaaaatacggtttttatcgcaagcgtgtccacatcactacatctacatgacccaatcccttggctgcttgtgtatagtgtagtactggggtagtacaatactggtcgacccgcactagtagaagcggcaaatcatacgcgccctttaatgcgctgccctccccagagcaagccctccattgggcgagtcctgacgcccgggcccacgactggtcaccacccgtaactgggcccgcaagtaagcaatcacccctctgggccccacccatgacaagacctaacatagcacaccctctggcccacggcccgtctcttcctccctccgctccgagtcccccacgcgcagctccacaccgtcgtcgacgcaccaccgacaagcgggacccacgtcccctacccggttttccatacagcggcgcgcaaccagggatacgggggagagaatcccacctctctttcgccgcggctgttggctgttgcgtcgcgtgggacgtcaccgggggacacgtgccggctcctccttgggcgcggcatgattagcaaagctacgctacggcggagcccgtgacgtggctgccgctgccattaacttcaaatccacccgtccattcatctagccgtagtgcacagagagagaataagtgagcaaaagatacgaggagtacgagcagagtactggggtgtgaaggaactacacctccgggcttatgcctttgttgttactgcagggaccccctctgtagactatagtgcagctaagcacggctaagctactgcctagtgacctctctctacatggatcaacagaacaggtgaaagtgattctcactcggtcagaacagtggcaggacagtgccgccctatcgccgcgggtcccacctcgcagtgtcgacgcgcactgctttgctcaacatttcgtgcatgtgagcacatgaacaggtgaaccgaggcagctgctaagctttggctacctatccccacgttaaatatcttcacgtttccaccgcttccgcctcttctgcaaacgcgatctcacagcgttgcatgcgaccgagcggggctcacgctaagccaacgtgtgcacagcgaacccacgaagcactgctagcacgtactactactacgctccgcccgcgcggtgtttgccacagaccgtcctataccactacacatattttcccgtcgccacagcgcgttggaaatcgtttcacgggggcagacgctgtgtattggcagcggcgcagcgctgtggcgctgtgctaatcaggcaggcagagacacagaacagaggcaggagtacgcacaccgtgccgatgacacgccgcatgcacgcgtgggcaagggccacgggcgcatgcacaccgcaacgtgtatcttctccccagctcgtgcattaggccgtcgcccaagctggatggaccagcttatcaacttgtttatccgagctttccgccttgccgcgagagtcgagacgaagctgcccttggcgccttggcccctcgccgtcctcaccttttcgcgtgtcgatggtacgcacaagtgtgcgaccggctggagtggctggaccggggacccgcctgtattttcgcgcagttcctgtttcgctggatcgcatgtggacacgccgcgttttccctgtttctcgcagcgcacgtgttggctgctgcctgccatggctgccgcacacgccaaaaacgtacgtgcgtttcgtttcgtgcgaccctgctgctagctcatgtgtcccgcccgggctcccgggtgcgttctaaagccaaaagcaattatttttgacgtaaaaagaaggggtagaaccagggaattacacggagcgaccttccagctgctgtaccatagcatatttacagtggagtgaaataaggagaccgaacttttaccagtgaactgtgtgaccttgagattctttagcattaatcaacaacggataacactacttaaaaaatcttcatagggaccggtattataagagccaatttatttaaaatcgacatctatgatctttttctcaccttcccacgatgaaaaaaatatagaaccggcatatttaagcactatagatatcgattctgtttaaaaaaaactcaatacatgcactatagatgcatatttttaatagaactgacatctataaaatgaatatggatgctgatttttttaaaaaaactgacacctgttaaaaaaaacttaatccgtatatgtttgaccacccacagcacccttatcttatctatccatcccgcttgccatccatgcatctctcgtccctcctctccctttgccttcctctctctggtggagcggcggcggccctctcctaacccgggggccctccccccttctctcctcctctagggcagcgtggcgatggagaaagccgaccgatcgggcagggtgcggccggtgcggtggctgacagatagatcttatcagccccgtcctcaagtgcggcgagatggcggtggtggtggaggaggcctggatcttgctagccctctctctcctaggggacctccccccttccccttctcctcctctagcatggcgtggggtggcggccgggtggcaaggtggcggcgtggtcatcagatctcgtcggctccctctcacccaagggacctccgcccccctcccccctccaccaatgcggcattgggtggcggccaccggcgtggaagccagcgttgcgttttttttaataaaccgacatgtataggattggagcaaacgtaccgaccatagctagttcataaccgttacttatggggttttctgtcttagtgtaaaaggctcgttttaccgtccagttctagctgggctatgccaaattttcaataaaactagaaagacttaattaaaaaaatattattaattaaattattactactaattacgtatcatcttgataattgaatatttaataattaattttaatagatactaaattaaaaaaactacttccttttacatttattctactccctctgtcccataatataaagaattttaggtggatgtgatacatcccaatacaataaatcttaacaaacggtctatcctggatttattgcatgtgtcacatccacctaaaatttcttatattataacggagggagtatataacgataatgtaaaagaaagttccttttacatttcaacatcataatgtcgaagcaagaaaaaaaagaaactggtttacttcctctatctcataaaataaccaatacttagatgtggcacattctattactatgaatctggacagagaatctatcactgtccagattcattgtactaaaatgtgtcacattcaatatggaacggaaggagtaccgcgaggtactgtagaacttgggagtatgtttgaatgacacttcgacagcatccgtgccaacgtatacgatgatgcgtatacacgaggtttttgcccttttggacatccatgatatactacgcgcctcgtagtccgcaagaaatgagtgcggagtagatcgctgatcgcgtcttcccgtcgaaattttttctcatcatacggccactcgacgaccagctgcagtaccaggtaccgaatcactctactcctactagcaacgacagtaaggtcaattcagagaagcctgcatgccaccgtttctttccctctctctatcttttctgactgatggatgcttgtcgttgtacgtatctgttcggttccttctctcttcaaagacgttggctaatcacgccctgcttaggggtgttttagatccacgggcgtaaagtggatactattaggatattgcatgaggtgttcggtactagaaaaaaactaattatataatccattagtaaatcatgagatgaatttattaagtctaattaatttatcattagcaaatatttactgtagcaccaaattgcctaaccatgaagcaattaggcttaaaagattcgtctcgaaaattagtcgcagtctatgcaattagttattttttagtatttatttaatactttatgcaggtgtttaaacattcgatgtgatatggtgtaaaattttagggtgggatctaaatacccctttaccacattccatcaaaaactttacaccctgtcacatcgaacgtttgaatacctgcattaagtattaaatataggctaaaaaaagaaattacataaattgtgactgtcgacgtttgatgtcgcgattgcggtatttgtatagtatgtggatcgttggtactaggatatacgcgagactgaggtaaaagagacggagacgaggattttatacaggttcgggcccttgaatcgtcaggtaataaccctacatcatgttggtcgaagccggtcgttacttttattcatcataatcacaccagtacaatatttggggtagcctatctaactgttatcgacatggcggtttgaaagtctgactcgtagtcgacaacagggtagtcttcctcctcgagttcgtgcccggcgagatcagagacagcactagatccctatggccggcctttgtaggtaccaaatagggctgatccaggcatatctctgatgtcgatatccggcggcttgtcttggcgtatgttggcttgtatgttgtgccttctattgttccgtgttgtctatcgtaggtgtcttccatggtgggtgtgtcccctctcctcctaggaggtcttctatttatactcataggtgtctccttgtccaagtagaaatagggaaaccaatatggatacaatccgagtagtcattgtcgttttcatatagaactctggttatctttccttatccggaactccttctgtatccgcaggttatttccgtatagaacatggtatatggtgagtcctgccgagatttagttaacaactattatgtatgtggtatccataaccctgacagtgactaatttgcgagacaaatcttatgagcttaggccctgtttaggctgtgtttagttcacactgaagtttagaagtttggttgaaattggtacgatgtgatagaaaagttgtgtatatgaaaggtttgatgtgatggaaagttgtaagtttgagaaaaaaagctttggaacaggtctccaaacttcaaccaatttcaattaaactttcaaacttcagtgtgaactaaacacaaccttaattgcttgctccatgatttgacagtgctacagtaaacatttgctaatgatggattaattagtcttaataaatttgtctcgtattttgctaacgaattctgtaattagtttttttattagtatacgtacactctatacgacaccctatataatattcgatattacacgctaaaactttacatatgaatttaaacacccctcagtctcatccatgttaagagtataggattaggaatttaggagtactccacgtacctgtatgtaattggagtgtactgtagtatctccggatacggtggatggcgtggctctcagtcagctgggactactggcattcaaagcacaaagcgactcccaagtctgaaccctctcagatcagagtatcagacgctagctgctcctacccctactcctagattacgtgaagtacttctacgtcggcctcctctggagctagccgacgcagcggtagtagtagtagcatctgattgacgtgcgtcagggagcaccagatagcttgggttaacgtggagtacaggctccaaaatctctttgcttactgcctcactccttccgcatcatccccttgtcattagaccagtgatttgacaccgccctgcatgaattctcgttctccctccgatttgaacaacatcggtttcagcaatcggtgcatacagatacaataggacacggcacatactgtaggggtacgcaattgcagtatccgaaacggatgcatatacaccgataccgcgatattatctccgtactaaaatgtattccctccgtcccacaatataagcgattttaagtttttcttacaacgtttgatcactcgtcttattcaaattccttttgcaaatataaaaaacgaaaagttatgcttaaagtgttgtagataataaagtaagtcacaaataaaataaataatatttttaaatttttttaataagacgagtgtgcaaccgttgcaagcaaaaactcaaaatcccttatattatgggacgaagggagtagctatttctagcacattactttgtcccaaaattaagctatttttctacctaccttctcctctcaaccaatcacaaccattctttttcacctactttctcttttcaaacaatcacacaccttcttcaatcattctcatctactttcttaatacccatgccaacataaaaaatgcttacattttgggacgaaggaagtatgtcatatttttagaatatgggatatgatacggacgtattgtcgacgagtgatactcgtgaaccggatgagttgagtactagggtatgttggtaggagggtctacgtaatacgacatcaagcagacaaaggacaacgattatactggtttaggccccttatcaggtaatagccatagtccagtttatatgggatttatgacgagaacatattacaaagagagtagtcgaaatagataataccgacgagaccgtagtcgaaggtttcgacgaaatctcccggcgacttggctccgcgtactccgacttcgtaaactatggtgggtgtgttggtgattgaattggatgatccttcagccctccctcaggggttccttttatatcgtggatcagctcaacttgacctccaagaaaggtttgagtatgttggatctggtacggaataacagaaactatatcccttccgagtaggattttgaaaataacttgactcgtagtcaaacaatgcaagcaaaattttaaaatcgacggagagagtattataaaaaattgaacatgtttttgccggtattttgatacgtcatccgtgtatgagtcagtttttaagttcgtttgtttttgaaaaatacaaatctgtatttgagtcgatttttaagatcgttaactttcggtaatacagaagcaatcatataaaaaatctgtttaaaaaaactcgcatgctaacttgagatgatcggactccaaactgcagctcatgattttctaaaaatatatatatctaagcgaacacccacagtgaatttcatcttaactaaactatataacaataataagattaaaatagacttcatccgttgtaacgtacgggcattttttctattaaaaataaaaggctgaggttttacatataaaggagactcggctactgatcaattcgatcaataagacgttagcatattatttccatagtaaaaataattttctcgctccatatcgaaataaagcaacctacagtatcggatgcgacatatcatagaacatatacgaattcgttctactaggatatgttatatccggtataggttcttatatcgtggggacgggccaggttagtccgtcataaaaatataaattatattagtttttgcatgatctactttgaaaatcttttttttcataatataacattaacaactacactctccgtttaaaaatatactaacctaaaaccggattaaacctaacctaatactaacgaatctagatatgtgatgtatctatacaatccatgtctagaatcgtggtactagatcagatctaatcttaatcctagatttctatattttgagtcgtgtgttgctgaggagtatattcatagtactagcatcacttgaaggtattttcgaatatgaatttatgccattacttgtgtctcattaaacaaatgctcttacattagcagctcaataattagtcaaaattacaaatattaattaatcgaaatacaaacctatgatagaatgtgatatattctagtaatacaaatttggacagatggccgtctaaattcgtataactaaaatatatcatatactattttaagtttttttagacgaaggaagtacatctcttctatatatactattataaaaattgagaatgtttttgtcggtattttcgtacgtcatccgtatttaagtcggttcgcttttgggaatatttattcgtgtttgagttggattttaagcttgtttacttttgaaaatacaaaaggagtctgacggagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacagagagctggagagcaagaaagttcaaactctagagaccctctcactcctcttttctccagtcccccctttttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcgatttgcaatggctgctgtccgaatgaccctccgatgggatgggtcataccaacctccactccgccggaagcaggtgcaacatggaagcacggttgtttgctgatgacgtgaccggcgtcagtccagtcacaaactggtcattcttgtctaccacgtgtcagtttagcatgccacacgtcagcccttcttcataaaatgacttccttgtaatggttgcgatgaagcctggtatgaatctagtcgggaccgacgtgctaactccaggagttcccacgccggctccgtctagggacgagtgcctagaggctctcatcattctgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaatcctcagggggtcggggcgccccagccctcggggacgaaacgggagcggcccgacccctcggggagatagagggagggg

SEQ ID NO: 46162 - DNA, 58303 bp, Oryza sativa
  unsure (1)..(58303): unsure at all n locations
ccctcggggagatagagggaggggcagcctcatcactctcgggcccgaccccccccgagggggtcaggccacgtgggtgaccgcggctgccccaaacctctagtcaagatatccccggtcccatgtcaccgacagagtcgtataagaatctatttaaaaaaagctcgcatgctaacttgagatgaagtacagactcctaattgaaactcatgattttataaaaaaaatatccaagcgaatttccacggtgaattttaccctacctaaaccctataacaataataaaattaatatagcatttacatgttacaatgtacgggcatttttctagtgatttaataaatttgtgctcacatggtgagaaacccgaccttttaaattcttaccaattctctctcaaaaagtccggtttcccaaacagtagtaaaccatctctgctgttgttttcttgatttaatttactccggtacccaagatagcacttaccccattttaaaatatagtaaattagtatcgatacggacataggagtattatactatcacgaatatggacggacaaggttaaggttatgtcaaattagtacaggttgctactcccttcaattagttccagaatttcactcatctcacacatactaaaacaaaaatagaaaaaagacaaatacatctagtgcatcaaatcctaaaaaaaatattctttattttacctatttcgaatgcaattattttctcattcacaaacttgatacaactattacttaaaaataaacttattataggataaatgagaagccagaaaacttgtcagaattgaatatttttttacatataaaggtatattttacttctttgtccgtcttaaaatataataacctttaaacggtaaaatacgttctaatattataaattttgatagatgttatattttgggatgaaaagagtatgagtgggcaagtgctccttccatcttattttaaacgcagtcacgagtttgtgtctaactttaatcgtccattttattttaaaaaataaaagttaaaaaagtaaaataatgtataaattaatataatattttatcatttaataagaaaaatatattaatcataattttttttaaataagacgataataaaaaataaacacagaaacacgttacctcttttaaaatgggagggagggagtatatataagtcaaggagtaattgctgttggtgacgttaacctacgcggtagtacgtgcgtgtgagcagctggagcattcaagtagttttggcttgtggcagcgcctctcgagcccatgcaacgcggagacagcaagctgccgcgcgacacggcacgccgagcgagaactcgagtctattcaatgcgctagctgcagcgtccgtcggttgcattggctacgagtaaaaatttacctctttccttgacttcgccaatagagagaaaggaaaaaaaaaaggcgagagatggtccgggagcggcgagctatcggcgcgcgctgtagcggcacagggcgagcagtagtcgtcgtatgcgcggtggtagtgatggccctgaatctgagcatgcttgttggtcgcgtcacgcacgctcgctcgctgcctacatacatgggctctcatcatgccgcacgcccccgatcaattggctacaggctcctactatacacagcgtcctcgtgacggctcgtcacacacgtacgctacgccaagcagcgcatgcacgtgccatgtttgacatgggcgcccgcatgcattttggtaccatatctagcggacggcgttgtgtccgcgctgctacagtcgtcggtgcaggagctgctttgcaatatgtgtagttttctagcgaatccgatcaatacatgcatggatgcgtacagatttagtggttcatctttttttttcttttcctctgctcgactcgaccatggctttactacatgtgataggctttttagttcgtgcatgtagcagcggtagcacactagcatgacatgtctggataaccaccggtcgggagtggcccaccgggttaggccgccggccggcatggggcgtacatgcatgcatggcttttctcgggaattataatcgtgtgatggtccgctgatcggatggatcgggccgtgcgcgcgtgagcctattatggttggattgggacgatgcgtactactactacgtacactacgtacgggtagggttcggcgatgatggtattgatgtatactggacatttcatgatacacgtaccaccaaatgctaaggatctttggacgagatggctagtgtttggtgcaaagatctagtgactgatccggccggtatttaggaccgtggatacttcaaagccgccaagtaacaggaggggcgcctatccgtgacaggagctgtctccacatttcgattgattattgcatggcgaaggcgtgatcagcagggattgacaggatgcgagtagcgcgtgctgtgccaggaaaggttacacaagttccccgcacaaaaaaaaaaaaaagaaagaaaaaaagagagaagggttacacaagttgtccgcgccgggtcctacacacatatggaaaaatgaaacagtatgtattgtttcacaaatgttcctggcttaagttagatatagtatataggaacaaattaatgtcgtgccccttaaaatacatgataaaaaaacacagagaatatgaaataaaccacataaatgaaagtaacatgtttttttaatccagtaatagttaaaagcacaggtaataggaatatactcgctccgtcccattttaagtgcaatcataaattttcacgtccaactttgatcatccgttttatttgaattttttttataattagtatttttattattatgagatgataatacatgaatagtactttatatgtaactcatgtttttaatttgttcagaaatttttcaaataaaacgaacaataaaaattgtgcacggaaaatcatggttgtacttcaaatgagacagagggggtatgttcttcgattgcaccataggacggaattgaccataggaatacaatcctataaaaattcacatccttttcataggaaaaatccgtgtccttttcaaatgaatcaaaggagcatatgagaaaaaaatattaagggaattgaattatcaaaaattatttgtcaatcctccattttaaagggaccctcattgtagagatgtgcatgtgttcaatatacacagggagcacatatatatagcctttcatagtctacttgcagatttatcgctcgtagccaaaatttaaattttggaaaataaattttagagttgatttcttttacccgtactctatattttaatttttcttttaaactgtaagtaaacatatataaataaattgtttctcctactttgtttgtttttctatggcatatcaactacttcgtacagctcaagcgacaagaggcataaagcaaattaaccataagtgtttcccacaatatacccctaatagacgacacgcatgataaaatttatgaaaaaatttatgatgatctctacggtaatataatcaatatatactaccaccaacaatcttaaactatctttcattgatagtataagtcataaatcaatgggttatattatttaactaataaatatcagtagatatcaccgtaaaaatacttttcagattttttttacgaattacacgtgtgtaaatacatgcgtgaattttaatgggtacaattacacaataaaaatatacaaattactgaatctgtctcagaaaaaaaaaacaagcacatcagagctactccctttatctcaaaataaactaacatatgaatggatttgacacaatctagtataacaatttagacaacaatcgtcttctaagttggtttattctgattcggatggagtacaacctttttgtcatgggaaaggccatgtttacccctccagctgaagttaattaaatatcatcccaaacattaaagagtaaaatacagttactcctatttgctagccattacaaattcatatgaatataatatcctgatatttattaaatgctggcccgttgacatgacagcgctttcacgaacagcggtttctcattggcgctgagaaacctttggctgatctaacgtgaactttcggtgaaaactattggcataagtaaattcacgctgtgtttagatgcaaagtttggatccaaacttcagtccttttccatcacatcaacctgtcatacacacacaactttttagtcacatcatctcaaatttcaaccaaaatctaaactttacgctgaactctcgtaccaaagttaatctacagggtgatcccaacagttttgggctaggtgggcctgagtccctgttccgttggctaaaccctttataaaatgttgagttaatagaggaaaaaagcactagtttgatagaagaaaaacgatgaataattgaaaggtaattacttttacttcttttttaaataggtagttgtataaaaatataataatgtttgtttttttcttatatttagtcttgtcatgttacgcactatattattctacgttcaccgtcactgttaatatatccccatgtagaaattaaggatgaaaaatatatactttttactatctttttaaaggaattataaccctggcctctaaactacaaatgcacatcattatttgaacttggagtaaacctctagaggaaaatttgcaaaaaataaatagaccaagactcgtattggttgagctatatatcctagaaataggaatggagcaacaataaataatttgtcagaaaaaccttttgtggtttaaaaaccaatgttgaaacaaatcaggatacccccccccctacaaaatttagtactccctccgtcctataatatatgtattttaataatttgcttacactgtttaagcactcgtcttattaaaaaaatctgtgcaaatataaaaaacaaaaatttgtgcttaaagtactttggataataaagtaagtcaaaaaaataataattctaaattttttttgaataagacaaatggttaaacagtgcaagtaaaatatcaaaatcccttatcaagagacggatggagtaggcaacaagcaaacaacaagacactaaaatatctatataacctaaaagcatagtaattaagtgcacaaccatcaccggttagtttgaaaatatagagaaaaccaagcgattatatatatactttataaaaccagtcgactttataaaaccggtcggttctgatcaatacttcatccccggtagtatgatgccgtgcagtctatccccagttgtaggagcgttaagtaccagcatgtcaacggtaaaaggaacaacgatacaaagagctcaagattttgagaaatagttgtttggtagctatgtttcctaagttctggtttttatttcatctcctagattctataactacaaattttaaatctggttaaaaatctactaaactgatggtagaatctaaggacccctttgaatcacgcgaatggaaaaacaaagcaatagaaaaaatataagattctgataggattgtaaatccaaaacgagaacgcaagaaaaacacatcaatgatcgtttgattggatcgtataaaaacgcaggattcatataagaaagatagactccaaggatattttccaagatgttagttcttattaaatttcctctaaaatctctataggatcgtttatttcatagaaatttcaaataatatgatatgatttaatctattatttcaaagaccttcataggaaatttttaaatagaattgaaatcctccaaagtttccatgtttttcttccaaaagttgttgctgatagaatctctctcgaacaggacatctcgcgaagtgtatactggcccactccacccgtttcggccctagttacatcaacgataggtacgtgctaataagatcagtacggaaaatagttgcggaggcaggtaatcttacatactgccctctattagttgaaaacggagaacatgtactaatggcacccaatcatcaaattcgctattagctgctcttatcctcttttgcctacctacaagtactccacaacaggaacaatctccccgctgttaccagctgtgttgcttttgttactactgctagttttttagagtagctagggagagtgcaggcagaggcagggcaggggtggtgaatcggtagaggtcggcagcgtggtaggccacggagcagctgctcatagtcacatctgcatttccaatccaaaagcaggaagcgtgaacgaccgtgcaaaaatgaatggagtcaggaggcttggcgtcccgtagatgcagaacgcctttgatggatggttgcagcgaaggtgcgtagtttgcactttgcaggtggttgatgggaggccatcagctgatgtgaagtccattagtatgacacggctggggcttcatgtatgccatgcatgtcaagcaacagagggctggggctcatgtatgccatgcatgtcaagcaagcaacagaggccgagccaaacagccaatggtagccaaacagccattttattgacaacaagggtactggagcgatcaataaaattggaacagaaggagcatggcactcaggctgatggagtcatgaatggatcagaaagcaaccaaccgaagaaaatttgtttggtgatagagtggaacggatgggctgtttcagagttcactgtaactccggaccagaatacaagaacggctcccatcaattatttcttcaccagacagaagaacactgcaaatatggttgttagttcccgctactaggagcaaagtcaataatatagcccgctgtcggctcttaaaaaatagccacatcatttatagcatagctcatgcttacaatagaactactataacacaattattttattatctttgtgggacccgccatcttgccttatctcattctctttcttcctcctaccccttctgtttctgtgttcgtcttgcctgtggcctgagcgtgcggtagttggagatgggcacttgggcttgggcagatggccatgcgacggatacggaactacgggagacgccggtggccgtgtagaacgagggcatcatgcgacggacgcgggagacgacgacggctcaacgaccgcggcggcgcggccacggtcgtggctggtgagggccacgaccaaggctgaagcaagtgatggtgacaacgtgatggcagtggccggatgatggtcacagctgcggcgaacgcagcgacgacgactgctgcggccgcgatggacgagagccacggttgaggatgcaagcgatggcaacggcgacggccggggtagacgagggccacagttgcggcggacgcggcgacgacgacggctgcggccgcggtggacgagagccacggcagaggatgcaagcgatggcggcggcacgacggcgacggaggcggccacagggggatgaggacgcctgcggacgcaggtgagggtggcggcgtcggcggacgcaggcggacgacagcggcggcgccgacggacgcaggtgagggcgacggcgccgagagatgcatttgacggtggcggcgccggcagatgtaggcggatgacagcggcgacgccgagagacgcaggcggacgacagtggcggcgtcggcggacgcaggtgaggcggcgacgtcgagagacgcaggtgagggcggcggcgccagcggacgacatcgacggacgcaggcaacagctgtggcaacgagggcggcatatcccgacggatgcggtcccacgaccttgggccgtgcgtagagccgggcgactaattagtcacccgttcgttctctctcttcccccctctctcctccacgtcaccgaaaaatccgacgtggacatcctatcgtcgtttattgtaccgctataagggcatccaaaatgtactacaaaatagtccatagggaataatctattccattcagccatctagtaatattgtgcaactagtccattaaaggaaatagcaaaagatatccatatgcatatggactacctatatgacataaataatattatccatctttacctctctctcttctcctaatgttacattgtatccatatacattgtgattgctatagttaaagtttatttatatgaatcctatctatatagaccatttttgccatatacattggtgatgcactaacaccggcaatgctgatatgttgcggcttgtagctagcctaggcttctagactacccatctaacagcacatctagactgtagtataaatgagtacaatgaatacagacgaaactagtgctgttccattcggacggaactggaaagcaaaattgtgctggaaagaatattttgttactaggaaagaatcagtgttacatagtacaatgctcttcaattcccccaaagtatacaagcggatgccatggtaagttaattcataaatacaaaatggaaatgttttgattcaggcaggttatagtgtacggtagaaatgttccttgtgataaggagtaccagtcatgggcttcggtatgagaagacagattatgtgaaaccagtattagcctatttggttctgcagttctgcaaaaacaaacgcttcgaaagatcttttcctttagaaaagtcttttttaactagaacagcaagaaccttttgtggcggctggagcttcagcaacgttgatcgtagttccttgcatggaacgcccatttgtagacgcggattcctgagctgcaagtgctttcttgcttacaatctggtgaatttcactcaatacagtatggaatgctttctccacattaatcgcttccagagcagacgtctcaaggaaggagagaccttctttctcagagaacgcatggccatcttcctcggggactgatcgtagatggtttaagtcagacttgtttccgaccatcatgacaacaatgttggcgtctgcatggtcccggagctcccgcagccacctctgaacattgtcgaaggtttgcctctttgttatgtcgaatacaagaagtgctccaactgcacccctgtaataagcactcgtgattgcacggtatctctcttgacctgccgtgtcccatatctgagccttgatagtcttcccttctatctgtctcaagacaatagtagacttttactgagatgaactgtagacacgtatggcttcagcataatcataaacagagaaaaatggatagcattccagatctatgattggcaataacaattatggtgactttaacatgatgaaaatgtcttcatgacaatatacaaacaaatcagtactaagaacaatatatttttttctttgattggacatgggaagatctatggttgaagggtatatatcaattgattaatcaacaaatatagttataccacactaacattggtggcaactacaaactgcactgcaatcccaattactgaatgctgattgaagaattgtgtcacaggcttacaagattctttaaaaatttgggttaaagtttaacccatgttattcttttccatttactgatgtatatgtattaaaagctgaaatgctgcaaaaagaaagtgatggcgtgctagaaacaaaaaaaaatcacttaaaatgtttgatcaaacaaaaagtaatagatataaccttctttgtctaattattgatactctcagaagaggatcaggaaggacaaaacagagcataatgacatggttgtgctcaaggaatgtaaggactgagaaaaaaaaaacaaaaaagacatttccagccttataataactgcacataaatggtatggaagtgatgaagtcatctgaatgcaattaattcagagacaatacaatgatcagtgctatgccaaccaaacggagaagatggtcatactagtcaatctatgttgcccacaacagctattatgcattaggattatgaatccggcagggattgacataacctctttgacgaaattgacgttggaaggccagcatattggtgcggtagcatttttcctccaatgtagtataaaagtatgatgaatctactcgtatttttggcatttcttaacataatgtacttttggcatataatctactctcgtatttgcattgctaggaaggaccaagagggaacaaaatgcctgcatgaataggattgctcgaaagaattgacaatctagtgttaacctagaaatgacacgtatatccgttctctaatctctatcatctccaacacaaggaactcgcgaaaacataaaagaaatatgcgcggcattaccaccggtaccatcaccgcgatatcatgcaaacaaacaaagtgccgtattgccattgtcagaccaatcacgcgaccataaaaatcctgtgggtgtccgagtctgcagtcatggatccgggatctcaattcctaacgcacaagaacccgacgcgacatcacgacgcgcgccaatcgcaaaattgtacaagcaagcaaggggatcagggggggggggggggcgggtggcgtcgcgtacgcggtacctgcaggtgcgggtggcgaactcgacgccgatggtggacttggactcgaggaagaactcgttgcgggtgaagcgggagaggatgttggacttgccgacgccggaatcgccgatgaggacgatcttgaacaggtagtcgtactcgttgtccacccggtgcgccatgatctccccctcccgcctcccctcacgtcccgaatctggaacgaacgaaaatctcccctccgatcctcgcctcctgaccctctcggttcgtgcgcctgggggaatggaggtttgaaacggtgggggcagagggcaggcagatccgagggggaggagagagagagagggggggggggacgaggctcgcgctcgctctgcgctggcgcggcttgttgttgttggtggtcgcgtctcggccagccaatcgacggctggcgcggcgttttgtccctggctggggcgggcttgccagatctggggaatgtggccatgtggtgtgcgtggtcgccgtggtcggtggccgcgtgtatcacctgcctcgtcggtttggttcgtgggcttgatgagttggttatgtgggcttatctatgggtcaccacctcggcctcgacggcctgctcgtgcggaaagtatggggtcggggcggcttcacggctcggcccaatgcaagcatttcacaccatgcagatatatacagtttcgtttttttcgatagatgaatactttctggaacacaatattttctttcccacatatgcaagcattcacacatactgacatgcaaacactattacactgtcaccactaacgttacatacacgtggccacgtgggtgcaacctagcagtagcaacacgtctaaacgtgagaggttagcctcatgcatgtagcaaatagcataggtaccctcttttttcactaacacgctaaaagaaatacacgtcaatataatagaagaagacggagtttagttacacaatgcaaaacgtctagaagggtgttgcaggggggacaggggaagaaaaaatcgaaaaaggaaaaaagtgacaaggggaaaggttacttaaaaacaaaaaactcctatagcgagggatggtagaggagtagccccactatattcctagaaagcccccaaaagcagtaccactagcagatgatcacagacggccttcctaaaagacagactccaacactactgaaaccaacgagagagagagagagagagagagagagagagagagagagagaaatcgaacaccccagagtttcactccttccacagctgccaagatatcgggagtacaagggagctgaaacccttatgaggtgctctgacaagcaggccctagtagtcggccaccagacctagagtgagcaaccacgggaggggacaaggtcaggctagccaggaggagacagaacatgatgccagacctggtgagcgaaaacacaatcaagtaggatgtgattcaccgtctccatttcttgggcacggaggggacagactgagtggctgtcaataccacgctttagaagaaggttggtcatccagcggcacttttggaacgcaagctacaggaaaagcttacacttagcagggcctttagcctgacaaagtagattggcgcaagcaaaggagtgttggccgaggaaaaatgtctggtaagccaagtaacaccaatcgcttgtccaacgctaagagctggacacaaaacaccgtgtcccagatcacgaggaattgggaaatgatagggaccgtgagaacgccacggatgtcccccacccataagttgttagagagagcagaggtgattgtgcgcgatgcccggagatgtggtggcacggcaaggaggaggccaggcaccaaggaggccaccgagcgaccctcaatccattggtttctctaaaagagagacgtgtcgttccctggcacgaagaagatgaacgacgcagacatatctctcgagggggccttcaggtcagcccaatagaggtggcctgagcgctgaagccagagctagcgaaggtgaagaatgaagccacaagtccacaatacccaaaccaccgatagctctggggcgacaaacactcgtccaagacataatgcatcgtcctccctgaactgcatccatacccgtccactggaaagcgcgacatttcttatctatggcattgacaacccagcctggcgaactaactgccatagacacatggaccggaatagaagatagcatggactgaatcagcacagaacgatcccgacccatctagggagaaagtcggtgagaaatggcatcacatatttaaaaattggagacagagcagagtaggggaaggaactctggaccagggaaatatgtgatgccatttgacgttttatagacgttcgattattcatcatattaaaagaattgtgaaaaatatgtaaaaacacgggttatgcttcagcatgtacctttactgataaaataaatcacaataaaataaatagtagacatatagtttttttaataaggtgatatgtccaatactcaatagcgtttgtattactacctccatttcatattacagttagttttgattttttttctaagtcataattctttacgttgaccatatttatagaaaaatataaaaatattatggacataaaacaaagaaactatcaaaatatattcattgttagatttagtaaaattaatttggtgctataaatattgttgcatttctactttcaaaaagtttgacttaaaaaaagtcacatcgacttataatatgaactcggaggaagtatgtatcaaaatgggcatgaatattgatttagcttcgaaccaacccaatgactattacttcctctgtctcaaaatgttgctatctaagataggatttgacctattctaggacaatgaatctggacataacctctgtctagatttgttgttttaggatatgtcaaattccatccaagatagaacatttttggatggaggaagtactattcaaactgtcaatggattgataattttttatcaatccaaaacagtcattaatccccttaaaacttcacatccttatcccatctacactcctggtcatgtttaaagataacacttatcagcctctccttctaaattatcttttcgtccggataattcagcccatccagatagaccgtcgctctcagacagactcaatctaagcctagctagaaaaactaggcagagccctcagcctgctattgattaccacttaccagcccgatttgggccaacaacgccccgaatcggttcgaacaggtggcacctttccacgacaccttgctgctgcttatccagttatcccaaacccagattagacgggccgaaaaagaggtttctaccccattcatccaacacgccgcacatcgaacttcttatctagctttccgagtacttccaagttccaagtccaaccccttctatcatgctccatgccgcgcgcatgcatcatgcacgctggacgcaaactacgtgtcgaccatggatgcgacgcgacgcgacgcgaggcttgcgtatgtgctcctcctccctctccgcggtgaaagtgaaaccgatcgatccctgcaaataattcaccgcgcgcgcactcctcctcgggcgccgatgggtggatacgtccacgacgcgttggttactttcgcggagtgcaaatctccggcttggctttccccccgtgcgagccccgcggacagggacggggtttcggccccgcgcccttggcggcatcgtcatccgcatcgccttttccgtctcgtcgccaccgagccgtccccgtccacggcaaacaggatagaaagcgggagcgagcgaggcagcagcgcccgcgcgcatcgggcgtgcgtggacctaccagcccgccgtcgcgcgtcccgccggccactggactgcggccgcgatcgagagcgctagccaacgccttccggatcacgcgctgacacttgtagaccctaagacccggacggccggatcgatctccgcgaattattgagcggaccggctatatacgtcctagttaccagtaaaggcatcgatctttcgggtgggtctcgtcgtatcgtcgcgtgcgggaggaggagagaaaaatcgggagagcgaatcgggggccgtgtggatgtgcgcgcgggggctgccggtttcacgtcgattctcggcgtcggcggccccgccgccgtgccctggccttccggtgcgtggctaatttcggcccggccggagcagatcggtcgatatccgcggccgaatcctgaggaggctatcgagataaggatgaaccgcgcgagccaggactgcaggagcacatcaatgttctggctggtgttctcgctcgcgccaaaaaaggcgggcatctttttcgacgaacccaaatccacttcagataatatctccactactcgctcgccgctctgatatggcacgggcatatttagccgtgacatgatggcgtgcatggtgacctgttacggtgtttttctctgggcccctgttacagtgaaccttggcttgatcgcttcatcatcagctcgacccctgtggaccgatggagttgacgacgactttgcatctctcgacgtacgtacaaccagccaatggcggcacgacaggatcggcatggaggatgggcaaaaaaacgcatgtcgcgtcgcgtgagccgccacgccagtgacggccgagaagcaagaacagttcagccaacttccttggaacgggctgactaacacgcacgcagaggttcctttcccatcataacctgaatcagtctcggtcattctggaccagctcgatcgctcggggccaatcaagttcggccgtgtgcattgccgcattcgggcagtttgtgccgtcgcaaactgcaactctgaaaagtacacgcccgatttaagcaagtgatagtgatccactgatcctgggttaaatccagtcgaaaaccgcaactaactctggaaagcgacgccgcccgatctaataccgggatcctttggttaaatccaatactccgtatacgtcgcaaacacacagccgttctgacaactgttgactcgtgcactgcagaaagctgatggaatcgtggagattaagaaacaaagaagctggaggtgcgtgcagggggagtagtggatattccgggtggcaaatggcctggggtaggaggcgaccagcgagaggaaaagaagaggcgacgataaggccatggctcaacatcgtccttgggacagggaatggaatcatcctcgtaggaggtgaggtcaaagtgtgagaggttggaggtatatgctacggccccatcgattcctcccgagtgcaaagtcaaataggatgcagtgcattatgctatccagaatctatctatctatctgctggtcagttcctgcacagagccggggacctccctgcgagtacacttgttgatcctctgtaaaataaaaaacgagaacgaattcaggggatcgaaatgaacaccccctatcagattggttctcgcacaaggtacaggccgctaaaacaaggctttgcacgtggtaaattttcaagtgccaatcactttcggtgaattcgatcattatagcttaaagcctgaaacctgttttttggggacggcgaactaccgtgtgtgttctagtaatcgccctgaatgcgaggttatccgcatatgatatctcctgttgattcgagagaggagaatgaaagattacatctttgactggctcaacagctgaagcacgaaacgaccttgttgtgtttgttgttcccttggattgatttgctaagatcttcacagttggcttatcatttcactaccacttgcacacgtgttgcctttgacaagacagattgttctaaggtcccaacgtggatgctatgggccccaacatgcaccatcttatccaaagcataccatatcaatttcgcatatactcctacagtcctacgttgatcagttagtcgtacaagctagcctgcatcagactgatatataagtcaccaagggttatacttcctccatctaaaattctcacccgtattacgttttctaatttttctatataaattgtatgcattcgtaatctacatgtatgcaagccttaaatgaacagcgtgatcgttcgtttagcgcgcggcgctggattaaattgatcttgtgtcccgagcagccatcgtcccactcttttttttttatttagaaacaccaaggggtttttcggctagcttcacaaggtggtgggctatacgacctggattcgaagcctcatcatttttaattatttaatattaggttcttccttaatattcgtgtctttttttagcagagacgatgaactcatgcattacgcagccaaccaaaccaacgtgcatatgaatcgatgcggatgtttaattgaatgaacgagtatttcgattcttgttggtttcagtgataaaatatgttgtagaaaacttttggacgaaggaagtaatactaacgtaacatagcacaaagggtatataaccaacacaataggtatttaatactctcatcgattcagatataaataataagagacacaagtctaattgtcaaatccatttcatataacggttttcaagatatattgatactcctataaatttatacaaatgaattgatacacttggatagtcagtcttagcatgcaccttactattattgtctctaagctccatgtgttgttgatggctaccttttgtctgggttatggataccacatacctaatagtcatcgactaagttcagcggggtccaccatatactaagtcttatacggaatcatattttttatatagaaagagttccgaataaggaaggacaagaagtgttttatatggaaactataaagactgctcggattatatttatattggtcgttctacttggacaatgagacttctatgggtataaatacaagccccctaggaggagaggagacacaacacacaagtcaagacaagctaaacatcgatattggagatagcctagatggactcaatccggtgcctgcggaggctgacaagagagatctagtgctatctctgatctcgccaagtacgtattcgacgaggaggactactctgtcgtcgactacatgttgatgatctattctgccaagtcgatgacagctagataggttatcccaattattatacttgtgtgatccatataaataaagaataacaccggccttcggccaacaggagtagggtcgttaccttcctgtgaaggggcctaaacctgtataaaaatccttctctctatcttttttaccttgatctcgcatacaccctggtaccaacgatctccataccatgtaaataccatagtcatgacctcaaacgtcgacacctatcaagggttagggatttcgtaccggtgaacaattacggacaatataagtggcaacaataaccaccatacgcacaattcttaattggcactagcattaattagggatgtagcgtccaatttctatccctaagtagaataaagtcaccatgtggtatctaacatgtaggatcgaacacaagtaaccaagcctaccaggggggtgaatggtagggaaaactaaaaacccaaaaaattttagcggaaataaaagttaccctcaaattgatggaaatctcgacgtagtcctgtcgccgccggtcggaccgctcgcacgccgccggttagatcgcctccctgtcgcctgaactcgaagaaacacaaattgaagaactctcaaagtagatgacaactttattgcttctctctatatttacaaagtgcaacaacaacactccttacaaaaatctcgactaaactcgaaaccctaactaaactatcaacttaattgctctcaaagcgatatcgggaggcctcaccctccctctctatttataccacaaaaaccccctactcaaagtaggtgtagaactcctattcataataggactcaatcccataatttcctttttctccaaaactacagccgcacagaagtcggactcctcctgccgtcgctgctgctgcttgctgcctgagccgactcggcttgcctctgcatggatcaagcctgccatcactgaagctgcttgaccacgcaacaaagccaaagtcagtcaccaccatgcatacatacatgcatcacacatgcatgcacgtactgcatgtataccacacatatatgcacgctgcacaccagcacgcatacatatatgcacgctacagtacaccacagtactgtagcaccatacataagcctcttccaatttcttccaattccctttgcgaacaccgatgcttgcacgcacacctcgtgaagcccgttgcgaagatctctcccacacggtatccatccaccgtatgccatctcgtatccaacttcgtcacccggtatccttgacagtctggacctcaactccttcctgagtctagtcctgatctccaccgttgaccgaagttgacctccaagaattctaactctagtcaccttctcacatggtatcccgaccgcactagacctctgtttttctctgaacatagtcccggtcctcgccattgaccaaggctgacctcaagtcacctacacacaatcagacaaaacaaccgtttctgggcacagatatcacaacctgacccacattagtcacacgcactcacatcaacatccacacatcttttcaaaccaattcattgattaaattatttgcatagccaattgttcatcacaaatattaatcatgacaatgatttcacataacatacctcatccgttcctcaatacaatgactcatatgtatcgtcatccatcgcttcccggtcccacactctatcaacctccggtctttcttttaaaaccctcacacaagtacaccgaagctagtatgtcgtccccatgaagctagtttggttgcgcataagttttctatgccaccgcctatcgttgccattacatccaaaaagaagtcgtcatcctactattctaacaatgtgccaaccgcttctacccatggtcagcaatctcttagcaacccgacaacatggactattctacttgcataactatgtttagtcatgtgggacaagttaacgagtgtttgtgcaactccttgttggagacacaccattgttttactatgtcttatacaacaacccgtataacttttttagatgttctgattaaaaatcctagttttttacattattagaaatgaattaaatgcagatacacaaaatcaaataaattccatgctttcaataaatgcatttgttctatatatatatacaccatatatacatttatggaagcagatttattgaataagatattcagctggaagttattaaataaagatatctttaggctgcacattttttcatatatgccctttaagcaatatgaaattaccatttatagtcttcatcatgtgcctttaaatactgccaagttggagacacttatcagtcaagtgttcttgagaatcctcatctccaccctcaccatagaaacaggactagagtcctttcacgtgtcctagatttgggcacctttcttttgatcaccgaaatggaacgcaagaatccgctccctcagcaagagtctgagcctcacgtcgaaggcaacaagtcccctgctcccaccagcatcgtcgacgacgccactaacactaccgaggacgactccgcgttgagggacctcctctacccgcaatctctcgaggtaccattcaatatcttttgtaagcatgccgttattcttttaattacgttatttgtgttcgatgcgttcttatttatttattaacttaaaaatattcacctataaatttatttttatcgattacatagaaaaccttatgtctaacatgagttttcacttgattccatggcttcaaattttatattacttttatataaatgaataaaaattataactatgcaccaagacaagaatatgtctagatgcaattgtattctagaatgtactggatgtacaaggggcaagtgggtccgtgtttcagtagtaacccacttgtccccgtttgaccgcttcgtctcgtactagtactaccgtctacagcgtcccgctgatgctccatcaaaccggtggacgtagacgatcggaggatctcgccgtgcatcgcgtgctttttcggccatgcacctctcgtcgtcttcctgatttcgccgccacttgtagcatctgcccgtggggtccatcggtcgatcgatccccgtagccagcacatgttgtcgtctagctcaagatttgttggctcgccttcccttcttttcggttcactcttgctagcgatcgagacgacttgagaacaaccaacggagatagctagccgtctcgtcaaagctgtgtcatcagccgaccagcgaaggcaaactcgcagaagccatcgtgtcataggtgtggtgtgtggagaagcggtggaccgaccgacgacggcggcaacccgcacggcgaggcgaggcgaggccgacggcggcggcgcgcgtccacgaaaagcgggggggtatctacctgtttttcgtataagcccctcaagatctaggaaatcgcggggcgtggtcctcggcccggggcctttaaatgcgggggcacccatgtaggccggagcagagcgccacgaggcgagttgttgggtgttccctagactagccgtctcttcctcctctccctctcctcctcctcccgccgccgcctgcaaccgcttcacgtggcctgatcctcctccggagctctccctttcgaccccaacaaatggagcccaagaggtcccctgcgctgccgcagcccaacgtggagaccaagaagtcccctccccgcgctgccgccggaggaggcggcggcggcacagctgccgtcggtggcgagtcgccgttgagcagcctgttccaccagccgtcgcatggggtactgattcctgacgccttttgcatgtttgatgttatgcctgtgttcaggcccgacgtgaatctttcctccgaacaagacgaaattcgagggtgttctttcgttgtttgtttgttttttttgttttatttttttttgttacggtgacgcggatgacacgggatgagtccccctccgtctgcgaggcgttgatacatgctgaatttgcctttcattccatcgctgttgcacacgcataaatttagtatgcttttaatgtagatatgcccccccccctcctctttctatttgcgaaaattagtaattttcaatgtacaggcgcctgtctttccaagtggatacgcgatagtttgtagaatacttttggaaatcaaccttagagattgtttatatagtttgatggtgatggtatttatccaatcccaaagtattgttttgccggcgctttgtttacacttagtgaattcctttacatttttccattttcaggcaaaaggcaaagaagacatatactccattttctacaaagggcagaacgggactgcacaagctgggactgcaggtagttgtggtcttgtggattgacccaatctcttccttgctcttatgtaggaaggacattcttattccttggtgccattaaagacactgttgcgaaaatggaacataataataagcacaactatatataaacgaattcaaataaacccaaagaataccagttccatataaagcttgaaaattagtagcctccttttcatctgtatttactatttgcctcctttcttctgtaattaccatttgcatctgttggatatctctagagttaaccaacgagaaattactttccatctgttactcttgtctgcaccatcatgttttttttttcttttgtggagtgtcgttgactgttattcatctttgtgatcatcttactcggttcagactttagagcactgagatgtttcacgatagcaaactaactgcatataaacattgatttgtatgccagatggtaaatcccagtggactcctcctaaaagtcgcaccgtgtacaccaaggataacaaacagtcaaatcagtatgattcggttgatacgtcctgttttggttcttctgtgaactatggtggtcgagactattatggaatctctggacacaagcaatccacagaatccaatgatgtaagaaattgccaaacccaaaactgcaaattatgtttgcaattactttttttaaaaaaagtatcatgaactggtctatacaactataccacaacaaagctttgaatatacttttgctttattgctttcagtataaggcggacaaaaaggacccttccacagattctcatggtgactggtggcaaggtatatttacttatttagatatgcatttatctctgaattcaagctccatattgttgaaatgttgattatttatttctatcaggttcgttttactactaagcgaacttggtggcctctcccttggtggaaaaggtaaaaggcacatcttaactgtttttatggtttgctgctattgtctgtttgtgcacatgattatatgctattcaacttacatttgcggcgcaatggaatatcttcttttccatctgacagttcatagatattggtgttagctcactcgacctattttatcaattatttgatactcatgttcttttttatacggaagagaacatattctcttttgttttgttttccaaaattcagaacagttatactagaattcaaactactaagcctttggaaattattggtgatgatgtgcccaaccaacgtttcaatacaaaaaagagccaaaaaaaactatttatatgaggaactgttactttcagctgcacatcccaaatgcttctaagctctgcatattccctccccctcaaacacaaacacatgcaaagtttatctattcatgtgtcaatatcaaagttccgtgcctccatttaactttttttttcctgcacgataagctgtatggttgtaaaatttgacgaggttcagtgggcgggaaaagggtttaactgtcctggagtgaaaattttagttagctcctggctttatatgtctccatcactgtattagttacaccactatccctataatttattgacctagtgtatgctacaaattcacttcgaggaagcagaacaaaattgcaatgaatcttgtgctgatgttccattaagctgtattacttgcataccgtgctgtgtcaattttgttctggtgaaacatgaatcctccataagaggattaggcccaggtcccatctggtaatgtagtttcataaaattcaggttattcataatataaggtagagattgattttctaaaggctgtttttaagaaaaacaacttaaccctaagttcaactacaaaaccaaagaggtttaacgatgaccgtctgtacgagaaacaatccgttaatcctaactccagctacattattttcactgtatatttgtgttattttatcgaatctaaccattatattgggctttttgtgccagggaatggaatgggaggggttggagctggttttgcttcactgttgctatgctggccgtatcagttacctaaatcatactagtgtgacatcgtccatcagtggtggcagtatttggatcatcacacctgggcagatgtagtgtgtctttaccttttcatttcgtagcttgtgctttagatgtgaaatgaatcgaacttacaagcacagtaagttttaggtcgcaggttgcataaatggtccctatccattctgccaaatctggtcagtaaccagattggatcagtttggtctggctctcttagatcgaagtatatgttccttgtactctcggatcttcgctccggagccaagaaggctggagaagtggagatcacttgcattgtaaacatgtactcgtttaatttcaaagaacttagcaaactgttcttataaatagtagtacttttattccaacagaatcatcaactgcattattcagaaagatccaggagaagtcacatccttgaatttcacagaacttatcaaactgttctcttatagatagcaccactattcgatagtcataaaggtactttatttcaacagagtcattacaactgcgttatttagaaagatttatgaaaagtttcacgtgacaaaggtaacatcagtttatatatatatatatcggatagtcaaagtgttcgagtgcccttccagttccatccctttgctcctcatggcagggtgtatgctgcacagttgaaaaagaaaaacagatgacttgatgcgattcatattttcgaaacagactgaaggaaaaaaaaaaagcagcaggagcagaaacttacggccacatttgtaaccgatggggcggttggcgatggcgcagcgcttggggatggtcatggccacggcgggcttgacgccggcgctccgcgcggtgttcgacagcatgacggcgcacaggcacttggggttccgcccgatgctgcgcacctgcgcgcagcagttgggcggcaccgcggcgcgcgggttctgcgtggccgccgcgcacggcgccagcttaagcgccacctggtccacggggacgcggccgcactcccccgcgccgcgcacggtctccaccccggcggccaccaccaccgcaaccaccaggagaaaccacacgcacctcaccttgctctccatcccgtgcccgccgctttccttttcttcttcgtcttctcggcgtcgtctgcaactctgagccgtgctgcgatcgatgatcctccaggcgtctcacggggcgagtatttatgcagcgcgccggagcacggagcgtggctcgaagccatcattggggggccgcttgagaattcccgcgggtcgcacggtgtgaaagcctcggaagtggaggtcgcactggcgagctctttctgttgctcgcactgagctctgttctgtccaatttggaagtgtcacctactgcactccactatgctgaggggcatgcttagcgtccataaaattctctccgaagagcctgaagatctgccacgtaaatggcccgtgacggaaagatttcgctcgccgatcggttcacaatcatcaccggtgtgtcggcggcctgcttttagatcagtgacacggccggagttcttgaaaacgcgagaaggaatccacactgcctttcccggaccgtcacagacctctccagtacaaagctgcagtaagaacttgcagccgtaaaatctgctggtgccagtctgccagaggcaagaaccgcagtgagttaagttcctcggagttcattggcttgattcctttgatgcactatacggacagtggagctttaattaaccgtgtaatcatgattttatacacttgttatacttgatcacgagcaaataggagcacacaccacacagagcttaacaccaggaatttcaggcgatacagtaagaacatgaatgcactcaaatggcacaagtatacacaaagactagtagtccttaacaaattttatgagtaaaacctagattaccctacattacagctctgtggtcgtcgagacatcgatcatcttaccaccgctgattatcacccccattacttcaggattaactagatcaattgccaaggctttctttgcgccaaaccccctgttgctgtaagaccgtctccctgcacccagtgggctcctctctttctttgatgggcttgcaagctgcgccggcgagaagctgggcgtcgcatatgcggtcacaaacggtgtgcctgaggcaggcacttggtacggtggaacagcagccttgttgcaagcaatcctgcaatctgcatcaccctgtggaaaatgctctgcatgcctgttcagttcatcgatgttcagtaggtcgtcgatgcgagcgacaatgttggacgccagactctccagcacccttgaataactctccagtattgatttacccacatcctagaaatggttcaagacataataatgacaggtgcatcagtaactagcatggcaatgtggataaaacaaacataggaagattcagagagatactgcacaaaccctgttatactgaattttgctcatgtccaagcttgtctgcgtcagtccaggaaacctttgcttcaaacatatcagtaggccctctgctcgttcggcaagcagctccctcttctccgtgtctattatcatgtctttcaccatgccccaggatgatctgccactggtggcacggcctaagacacttgctggttttgcagcaatcctccggcgccacacatacactgatgcctcgacacggttggcgatttccagtgcttggtactccgttgacaggtccaggcagtcgagaaggcactcaggagagaaatgatcagacgttatgtagcggtatatgatgtcacccaaagttgcccttccattctacatccaagatgaaggtaacaagctgagatcaactaaattacacatgaaatggcagatgaggttaggtcagggtagagaggcatggtacctttggtagggattctagatacgattcagggacctccatttcagctagagcattgctgttgatggccaaggcagccttcaagatttgattagcacagtcacgtttgtgctgcagttgcttcctcgctttgtcacgcaggcctccgggaggaacacgaggcaccggcaaccaccatttctcatcacggcggtggaaagctgctctgaaggaagctgagccatcacaatccggtgcgcatatcccttgttcaacgtaccagaactcagggtctctgaagctgtccaggatttcctgagaaatattgctctgagaaattactaaatgtccgtgttaaggttggattgtattgaattcaccgacgtgaaaaactcacaatgagcatatggtctagcttccgaagtgctggcagattgatgtataaatcagatcgtggtctgcttgtcatgacctgaaatgttgcaacaggaaaaaaattgtagcagtacattttttagtgaggaaaggcaaacttaatagaaaaactgtacagcatttgtcagttcgaaaattacacgaaatcaagaacacggaacacgtatttcactcatgtatatgcagcactaattacacgcactactgctcattgccaatggattcagtactaataggtggttagtaatcaatattctgcaatatttggcagccgcataacatgtactagagatttggtttggtttcactatttcagtacccacgaccaagggctgcttatcatcttcctacgttgtcctccgtttcatattataagtcgccttgatttttttaaaagtcaaaaattgtttaaaaaatattaacatttatagcatcaaattagttttattaaatttaacattaaatatattttaatagttttttattttatgttgaaaatattgatatgtttttctataaacttggttaaagataaagaagttcgacgtttattttaaaaaaatcaaagcgacttgtaatataaaacggaggtggtattcaaattttcaaattgcgttgtttaattagatgtatgtaaaacatgttatgcgtgcatgggtttttctattgatcccatttaaccaaggatgatactccctccgtttcaaaatgtttgacaccgttgactttttagtacgtgtttaaccattcgtcttattcaaaaaatttaagtaattatttattcttttcatatcatttgattcattgctaaatatactttcatgtacacatatagttttacatatttcacaaaattttttgaataagacgaacggtcaaacatatgctaaaaagtcaacggtgtcaaatattttgaaacggagggagtatattgatatgggcatctgttgtcatgttagcatgtccttccatgacattacattcgtttggttacagtttaggactaagttcagatacggaaaacatgtttagttaacaggtttctcctttctgtggctacagttctcgcactaaatataacaaaagctgcgtatgtacacggggtacgtgcactgtttcagtatctacggcctacggctgtttatcgtcctgctctgctgtatattcaaattttctggttgcgtcgtttaattagctctgtatgtaaaacatagcatgcgtgcacggcctttttattgggtacagatgcgaaaatatacaacagttacagtgatacagtaacatttttgtctttcttctccatgaagctgaattcagataggtaaaaacagtttgctaacaacggttcgatcccattttctagtggtccttgtgcaactaaagtcaccattatgaacctttcccgtgcagtgccatggtatcaagttctatggaaagccagcagttgcacttgtacttatatagagcaaccgctttaatagcctccaatttcagaattgaaccaacaaatcctatcgccagacagcgcagaggtgttgaataatcaaattgaaataatgggagttaaccggacaagcaagacacttgatgaaccgttttgaatttgcagctcctgaattgagccagcctacacgggttgatctgtctgtgaccgtacgctttgagtagaaaaaatggcgcggtagccgctcagggcctggagtttactaaaagaaaattttttcggtgtttggatgtttgacaggacgttggaaggggttttcggacatgaatgaaaaaactaatttcataactcgtctggaaaccgcgagacgatttttttttgagcctaattaatccgctattagcatatgtgggttactgtatcatttatggctaatcatagactaattaagctcaaaagatttgtcttaccatttctttctaattgtgcaattagtttttttaaaattttatatttaatgctccatgcattgatatttttggaattttttttaaaaaaaactaaaccaggcctaagtgataattgcagccagatcgagctgctatgctagtgcgtacctcgagcctggttccgtcggggaacgattgccaggtggggaccagttcgacgatgtggtcgctgacgcagagcagccagcccatctcgcgccgccacatggccttcttctccggcgggagtggctccagcctccacagctgcccgaagatggtggctgcaagagacgcagtagaggtgcgttagtgctagtacactgtacacctaagtagagctccacattgatcaaacggaatcatgaggtggggagaattctcaccgcagaggttggtaatggcgttggcaatggcgagcgccgtgcacacgcccttgccgctcccggacatgtcctccccgagcagcagcttcgcgaacctctccttcatcatctccatctctgctcatcaccatgcacaagtatcatcagtacgctgcacaacctgaccaaggagaagaagagcgcgcgcattgctcggtagtgccggtacctgagctgggagctctgcgcttctgcgcgtgcggcttgctgctgtccaccacctccgcgccggggacgcggccgcacgccgccgtcttcctgggcggcgccgccagcgtcacgggccactcgtcggccgaggccgcgtcggagctggagctgctcccgtcggcggagtccgtgaacgccgcctcgctccgcgcctccctctcctcctccccgctccccatccgatcggtcccaaccacgcgcgcgtgacggggtctatctaactagttacacctctccgtacgtgcgcgcttgctttcgcgggcgcgggtgtagtacgcgcttcgctgctccgttcctcggccggcgcggccgagttcagctccgcgtgcgcgacgagacgcgcgcgggcggggcgtggcgtggtgatttgcgcggcgttttggcgtttcggtctcggtcgtggcgcggtgcggtgggcgaacggaaggctaggcgcttaaaaaagttgggcttggctggtcgatggggaagagtgaccgttgggttttgagttgtctgggaggccttggcgagtttactttttagaggcggagagagagaaggagagaggttttccctttgtttttcttttgatcggggagggtgggatggaaatggaatcatggaatggaacgggcggggcggcagcggcgcgcagtaacggttagcgagtgaggtggaaggcgtgcagataataaagaggctggatcggcgtgatggaaacgctccctccttgctgctcctgcggtgctgccgttctcgttctctcgccttccccttgttggcgactttccgttgcacgctttgtgtcgctataagcacagaaagaaagtaaggaaaaggtaatggatcaggaaaaggagtattgatcaatagcacgaccgatccgtccctaacaatcataattaaggtccagtttgcatagcttagattgtgagaagtgaaaatctagagaagctgacaagccattttctagattctacatctacagttttttaaaatcttggtgaaaatctggactgcttaggagagcttctgttatcttttcaaaatgtgtttatagctggcttagagcagatacaatagcaaactataagccagcttaaacacatatcgaggagataaaagaagagagagaaaagcaacgggctacagatttgtagctaggtgtatcatggactccaagacacaatgtatatatgacaggtgagaccatgtattaatagtctagtatatatttataggtaattattgtactcaatccgtcccaaaatataagaatctaagactggatgtactagtaaatgtctcatccggttataggttcttatattttgggacagatggagtatgaattagttattagggcaacaacaatatatatggctaaagtagtacatatagatgggacccacatatatggattttaactattgtaaccttcacaatgtatatagatagtaaatagcattaagaggagaaaaaaagtagagacacataatatattttatcctctatgggcagcccatatgtttgtgggtagcttttgttatttctttgttatgaactagttccataatgttactaggtggttgaatggaatactatattgcttatgtaccagtttaggactacattgtggatgcccttaagttgactataaataatttagagttagtagttggttatattgttaaacttgctcttatttgctcttactgtaggacactgtcaagttaaggtcatggagagcaagccgttaaatatggaaagaaaacacggtggcagccagtactgtttgaatgtcagccttgtttactccatgtgagagaaccccaacgttagactgtctccaacagccttcacccaaattcattcgtttgggtcacgcgggatgtccgggtcacgcacccaattctttcgttctccaacaatggacccaaacgagcgttgagcgccgcccgcttccctccccgccgagcaccgcgcctccctccctccccgccgcggacctgcctcgctacgccggtcgctccccgttgcgggcccgactcaccgtcatcgtccgagggctcgcctcgccgcgccggcgtctaaacccgactcgtctcgtcgtccgcttccgcgtccccgactcacgcgggagctcagccacaagtccggcagcgagaccgtgcagtggcgggctgatgcagcacccgcacgagaaggatgaccgcgagcacgcggtggcggcgagcggcgagcctggatgagacggttgcggggcgggcggcaccgatttgggtcgaggagagagacggacgcatttttgcgttctcactcgactccgacgcaaattgcgtctccggtttgggtactctgttggcctccgattttttcatcggatgacccatatgtgggtttaggtaccgtgatgggcaaactgttggagacattcttagggacccaatgtcaaagggtgcatcaattttctactcctatcttcactcactgggcatccccacaaacacataaagaacgttccaagtccgacacaacacggtcccatacggagtactgtattctgctccgataagccaaaaaagcctgtgttgatactgtgcagcagacgctctgagggccaaactccgaaggaagctacgcttgtcgcggcgtgcctgtccgtccacgcttccccactgggctgcacacaactaacccagcatgccacgccacggctcgagacgagcgtccatgcacacggcaatggcaattttctccgtggcgcggcgtgcgtcgcgctcggctcgcttcggcacgggcagccaggcaggtctcttccagagtgcaatattttggcttggcgtcatgtgacatcgcgcggcacctgatcagacctcattgcagggtaagctgagacactcttcaactggtaagtgttgtcgtgtggaccagttaagaggggaagtcaaatgcatagttcagttggaaggtcgatgtgcacctttagatacagcatttggtgttttggtccttgtcagtgtttggctatttatgtgcctagtttagttagcgtgtaccggccgtgtcaccgttgccggtggccgacctccatttgatagcagctggtagatggtcaccagtcaccaccatgctggtagctggctataagccagctataaatatattttaaagagataaatgaagagagagaagagcagcgggctacagatctgtagccagctgtagtacggagtccaagatgtaacgtgtgtatgataggtatgatcagatattaatagtatagtaactaactattatatgaattggctattaatgatttggagttagtagttggctagactattaaacttgctcttacttcaagctggagctctacacacaagcaagttgatggcgtaataaaaaccaaaggacgactgaagacaatatctgtgttgctttagaaaactctgaattttccaacaaaaggatccatgtgggcgtgctagagagtgatgagagcacacgttggtccatgaggctatatggtggtgtattgaggaaaagcatgtcctcattaaaaacgcaacccaaacataccttatcggcctcacacgccgaatgtgacacgggcacagggcgtgcgtatggactgattctcttcacccgggcgcccgtcgtgcaagcgtgtaacaatggcgaatcgtgatacaacatcttcctgtgtgacattcgtaaatgcagttgcacaactcaagcttgtgcgtgtagaccattactttccactgggcgttgggcaagcacacggttacacggggacacatagatagaaggggaagacaaacagttcggtcctattggatcgggctattatttgcaggtcgtcgggggtaaggaataagtctcttctacctccctcaactcacgtctctggttgaatagtatccctcaatcgtaaaaccgggtgtaacccatcctaaactctaaaaaccgatgcaaatcaattcccctagttttggaggtggttttgtcccacgtggcattttctgactccattgactagttgagtcatcttgtggaacccacatgtcagtgacaagaataaaaataaaaaacggtggggcccattatcagtggccactgtagtcgcacacattccccatgcggctacacatcgccttcgcacgtcccccactccaatccgccgctgccgaccgatacgcccccccacccaccccacctgccctaggcgccgccgaagtcgacgctctcctccagcgtgggcgtgcgcctcgaggacaccgtgctcctactcccacgtcatcattgtttccaccctggtgcccaagattgttaggctccacctccccggcatccacctcgatgacgacgcaaaggccactgcttccttgcctctagacaccaccatcaagcctcccccctcttggggtcacccgccagccaccgccgccgccaccacgcaatgggggcaaagggggaggaggagggaggacgcgagatgaggagtggcgaagaagccttgtcggcgcactcaagccgggtcgtcacaggagatcgatgagggtgttggccgccgccatgccgaggagctactccccccacgcagacggccgatgatctcatcccacgcgcggctatcgtccgtctggcgagctcctcccccatgcaccattgccgccaccctgcctctattgatggaagtgaaaggagaggaagagatgagagagagggggggaggtgaggggaaaaatgggatgaggtggagaccactgacaagtgggttccatctgatgacttagtaagtcaactgccatgttggacgaaaccgcctttgaaaccacccaagagtcaatttgcaatggttttgggagttaggggacaggttatacccggttttatgatggtgggatgctattcaaccagggacatgagttgcgggaggtataatagacttattgctcagggtaaaggttgttgttggtccagtccagcccagatattttattgtacaatacatatagagtaatcaggttggcctacttgctttaagccttttgggctgcgactttgcggcaatagcccatcttaaacggaaccgggccatgcatgctccagtctagctgttagaggaaaaaaagttcactctagaaccctcgatttatcacctagtttgtaattcgtccctaaaccgcattaacaaataaaacgcatccctcaacttgtaaaaccggtgtaaaccaccttccctcatccccccagcattccaccgcacctccaattccccatctctctagtgcggtgactgatggggagagggccggtgatcggcaggagaggagctagtcaacggctggcgggaagggcagcgcgcttccgcggtggactacctgccaccctcggcctttcaccgcacctctgattgcccatctctccagcgcggcggcggccaacggggagaaggccgatggccaatgggaggggagctaggcggtagcgggcttccgtgatggaccacctcacccctacccccggcctccgctgcaccttcggttccccttctctacagtgcaacggttgttgagtagaaggtcaatattcgacaacagtggagttaggcagcggcggtcgagtgagcttggccctcataactccttgagcggccgacaagagaggagttgggtggcagcgggtgacgacggcggtggccgtgtctgatggctcctccatgactccatccacgagtgcagcctctgcctttctccaagtcagcgctgtccttctccccgccgcgcgccactcgcttcctcccgtcggttgccaccctctccaaattagtggtcgtccttctccccgccaccctctgatcgggcatagccctccccgtcgggcacccctctccatgttggatgtggctcatctctccgccgctcactaccctcttgttgaccaccgctcattgccctcccatcagttgccacttgaatgcttgagaatttgagagatggggaagagagaaagaagagttggcagctaacatgtgttcccacatcagtcaaaactggacgctatattgcccatggatctcgggtacacctgttttgtaagttgagtggcgtgttatatctggtattgcgattcaggattgaattttagactcgattgcaaattgaaggacctcaagtaaacttattcctttgtcaaattaacaatgtgtaatctaatctgaacttcagttccgtgggccagacctttttcttcgacgctagacctgactacataaaagcgtagcttaaaactaatcccaccaaaaaaagccgcatttccatgccgaaaagcttcgattcgccgctatgatgatgtactcctccggccaccaccaatcaaaccagtccactgattcagtgattctctcaacaccggtggaaacgtggaagtgtgctcgatgctcgatgccctccttttccgccatctttttatcccaagagcatattttccgtgtcgcccttgccttaagagcagcatccactcttgcgctgccttctcttgttccaccctcttctctcattggccgagcagagctttgtaactgaagctgcagttgggtggtaggagatgaaggattgggcgccggcgatcatcgcgtcggcgctgttcgcgctgctgtgcccgggaggcatcctgcagatgccgggcaggaaccggccggtggacttcatgaacatgaagaccagcttggcgtccatcgtggtccatgccgtcatctacggcctgctgctcatgctgttccttgtcatcttggaggctcatctctacatctgatccgagtgtgttactgtgatttcgttttcttgatgacactgctgtagtgctgtgttttttctgttctctagtttctttagataacttctggacctgagaggcgctgaggacgcctcgagcccttgatccttcacagccacaaggcttatggaatactaataaagaagcaatgatgctttatgcttaaacagttcaagcaggagtcgtatggctctagttgactcgttgtttcaattggctaaagctcggctcatcggatgttcttgaaatcgaagagaagaattatgttccgacagtgatttttttatcagtttacatgcaagaatatagtgtctgattcaagcggggaagaccgaagatagaacagcatagtgactttgtcactgtgaactcttgtgccactttgttcttgcttgattcatacccatcccgtggcttttaatagcaactagtataatttttgcagttttgaacaaggataactcagatttcacagtgtgcctagtgcagatgtataaaatgtacagcgtacctgccagtgttgccgtgttgggctaattaatgtctttcttttaaagatagcagtaacatgttcagaactaacaacatgtattacgattccaggcttccagcttccaggtacaacagcaaacaaagacatccaggattattcaactatacggacatactccaatacnnnnnnnnnnnnnnnnnnnnnnnagtactattaggtgacaagttagggtacaacacgcaatatacattggattgtttctgtccaggatgcaggtttgcattgctgtaagagtagcgactactttgccttgacgacggtcacagggcaagacgcattcgacagcacgtagttagtcacacttcccagcagaatcctgcaaaaacaatttaaaaatcaagcaaagtactggatcagaaattcagctttctgaaaatgatgctacaaggggatattgtatcgctgcccctgatgaatctctggttgctcaaacagaaaccagaccgaaagtttctagaaacatgtcaatgctataccgtcgtatcattcacacacctctggatctggccgaggccacggctgcccatgacgagcgattcgagattgagctcccccacagcctcgcacaccttctccctcggctcgccccagtacatcttcagcaccacggacagctgatacaaacaacatcaggcctctcgacctgaaaggcaagacaaagcatgctgccatgcatgcagcaccagcatatatagagccagcctacctccttctcccgggacacggcgttgagcatgtcgaacacctcttcgtccgaaggtatatcatagcgctgcctcaccgccgtctccatgagctcctcgagcgggatcagcgctgcgtgcgatcagtacagagacgacgcgacatgacatgacaattttcgatgggagatcaaggcattcaaaatttagaatgcaagaggtaaactcggtgcgtttctctcttagtattactattacgtacgtgatccggtgtgagaccagaggacgttcttggcctcgtcgcggccgtggtgccggatgtggaggaggacgagggtgtcgcccttgcggaggaggttgtcggccgcccactgcagcgccttcttgctgctcggcgagaagtccatggccacgccgatcctgcgctcgccgcccgcctccgtcatctcgatcccggagcaaacgacgacgacgacctctcagtttcctttggtccgcgatggtctatgcggcacgtgtgggtgtggctttgtgcgcgtccccccgggtttgcgctggaatttgttgtgttttcgatcggtgggcggtggtaggccgtgggacgctggatgtggtgcgacacgagagagattcggcggtgcgcgaggccgcgccgcgcgcgcgctgggtgtgcgtcgcgtacggcgtacgtacgtttcgccgtgccatgcgtcgtgccacatggccaaccatgcaggcgaaggcgccgggggatcagacgcgtggcgcgttggccgggcacgcagttcggacggttcagttggggacttcaaaggaaagaaagtctgattgtttctgaattctgatctcacccggattcaacccttaccgccgctatatatatataaagttataaacatagattttctttctcgtgtatacgtttcctataccgccgcatctgcttcatcgccatctccatctggtacgacgataatcgactttttctttggttattaaatgtttcgaatcatttatcagttcccgttaagatcaaaagttcttggtaattagtagcaagaacgtggtactagatacaccgactctcatatttcacttcctttttccctcaccatatatgtttcctaagattggaatattatgaacgcgagattgtcaaaacacattaatagaaaaatcatagaagtagaatatcatacttattagattcttatagaattttgaaatataagaaggcttccaaattgtcgtttaattgataaacagcatgcagattttaggaactaacaatacatgaagaagaaagcatgaaatacatgaagaagaaagcatgatatgagattctatgattattttcctctattttttctagaatagtccattccatagattttaaaggaattgatagaaatcaaaccctttttttcaaatgtctcattaggattattttacataggatatttttttaaaaaaaattatgtcttttatttgtttcaaatgagatcttagagtgctgaaatgttctcgctagcaccactttatccatgaaccggaaaattttcgacattacaaaaacctagttcttttctatttcagaaaaatacctgtttcaatatctaagtgaattgtaggctgtatttagatggtggaaaagttaggaagttgggagaaagttagtagtttatatgtgtagaaaagtttttaatgtgatatgatatgatggaaagttgggaatttagggaactaaacacggccgtaaactgatggtcatgagtcataactgtattcccccgtgagtgtttgttttatgctaccaaaatactactgatggagttatcaaagcaagattaggatttttattatgtagggagaataatagataaacaagttgatgatgcgtctaatttaagatcaattcatttatgtaccaggcaaaaaaaaaatgttgggtgttcttttcctcataaaccgctgtgtgaattactctgatgcattcaatatgcctatcttacgtatacatcttttatacttatacctggctggaaggattattaatatgtcatttaaggccctatttagtttctaaaaatatcacatcgaatatttagacacatgcaaggagtattaaatatagataaattaaaaaactaattgcacagttaggggagaaatcgcgagacgaatcttttgagcataattagttcatgattagccataagtgctataataaccaacatgtactaatgatggattaattaggcttaaaagattcgtctcgtagtttccaagcgagttatggaattagtttttccatttgtatccaaaaacatcttccgacatccggtcaaacgttcgatgtgacatccaaaaattttcttttcgcgaactaaacagaccctaagactatccatatagtttgtatatctttttgcgagtttgttgtgaaatgatgtaatccagatcaactggtgtctcagtgtgaagaacccatagatcctaatgggtgcgaagacagacaaaggcaaggtttcagaataaccatccaaggttctaatcaagagaaaaccaaaaacatccaaggttaattgatactacaagattcctctctctctctctctctctatttgtttcccaacatgacaacaagtttctgatttgatctgtgtctttcgttaggttcgacgatcacaaggcagagggtttgggtatgggcacccattgccatcggtcgttggtctccctgtagccgaggcaaagaggaggataaaacaatgcaggccagatgtctacattgaggtcctttcggtaaatgcgatgctaactatggcttaccactcgaatcgcgttaggctcttagtggacagattcaacaaggtggtagaagatcctcacattggataggctaggctcatatgcagagaacatgcttttatgatagcttagtcctagcggtgtcctgcgtctggcacaatatttgttaatcgactttaggttatgcaaaactgaagttgctttgtttttggaaattattcaaccaattctgatataatttgtgttttggaggagaaacttggatgtgatattggagaggtggcctttcacatactcaactactttgggtcatatcgacctatgtgggcttctctgcttttcggccccaaaaatatcaggcttctgtaccgggcagatcgagttatggctctggttagttttcaaatttttttccctaaaaatatcacatcgaatctttaatacatgcatgaaacattaaatataaataaaataaaaaaccaattgcacagttcgcatgtaaatcgcgagacgaatctttgagcctaattagtccatgattagccataagtgctacagtaacccacatgtgctaatgacagattaattaggctcaaaagattccacatgtgctaatgacagattaattaggctcaaaagattcgtctcacggtttccaggtgagttatgaaattagttttttcattcgtgtccaaaaacccctttccgacatccgatcaaacatccgatgtgatatttaaaaattttcatttcaccaactaaacagggcctatgttgacatattctaggatgatgaatctggacatatgtatgtccagattcgtagctccccatcggatggcctaatcagctaaagaaaaaggtaaattttaaattttcaaacttaatttttagattgattttgagatattttcaacgtattttctttttcagcattggttttaagtcaccaagaacacatatataaaagttttatctataaattaatttttattccctaataagccgttttggcttatcagggaaaaaggcaaacgatggggcctgtaatactaagatgtgtcacatctggtactatgttagtttttttataggacggagggagtaagtagttggagtagtctcgacccgttgatgggttggtcacaggctcacagcagtctcctctgtgcagatcatagctcattttttttagcttcagttctctaatcattagaccatcccgtaccttgaaaaatgctcctcccgtatcagggggtgtttgggagggtcacccttaatagtcaaaaaaaaaaaaaggcgaagcatagctaactagggtatttatttattcaggcaataggaatcagacgaggtcacaggtacaggcgcctcgccaagtgtaacaagagacacgccccgttcttgtctcgtaccgactctgcttcggacggccgttcaccagttctgctcctgcatccttttgccatcatcaggtaaacacgcccagctctttgggttaggggagctattccaaaactgaccaactcgagcgatagcttgcaacagccagtggcggacttaggatttgaacccagggtagacctagccaaaaaaaatccgaatacaatacaatacaatatgattcgatataaaatgtggtaaacgatacggtatgcaactctaaatgattcaatacaagtagaaagtaacaaataagtttgaatcttacctaaataacaatgtaaataggatattacaatacttaatactagtcaagactaagctttacgcttcttcatggtcacgaaagagtgaattatgtcttcctcacttacatcagagaagatatcacgctcaatctcctaacaaccatcaaaccatgcaaaattgtcatatgaaattgaaggggtagtacactagtagtatggtttgctcggtctttcgcctctatttcagaaataggaaaatagctgattctacttcatgtataactaatcgttccaagaatttctctaaacatgtttgttgatattgttcaatgcctaaatgatagttgtcattatgtacatctatggctaatacggccaaaaagtaatgacaaaatcagctagtaggtttagaattactcaccggagtccagagaggcggagagccggagcggagaggcagtggcgcctgggcggctgccggctgggtgctggaaccgccggccggagagggtgcgctagccggccaggcctggggcacgctggtgactcggcgaggggcgaagggagtcgtggagagtgcgcggccgcggcgccgcgtgggcgccggcgcggcgcgtgaaggcagcggcgccgctaccacggctgggcgcgcgcctggcgggagccgggaggccgccgcccgccagctggacgcggcgggaggaacgacggcgcgagtagcggcctcgcgggacggcaggagcgccggagtcgcggctcgcgggaccgtcgtcgccgtcggtcgtttgggacttgggagcagtggcggaaagggaggggagattgcacgggagagagaagaagatattagggttttttttgtttgatgggccaggcttttttcgtgggccaataaaactgaatgctgggtcttctctgggccaaattctagggtagtcctaggcctatctggactaccccttgggtccgcccctggcaacagcgatgtcgctgtccgagtagaaccagaaccaaattatttgagctcgacttcgatccccggatggtcaccggttaggttagcaataaccaaaacaacgcgactgaaattgaaacatcaaccggtagcagactgcccgggcgaaagagactcctctggtcgccaataattttcggtgtgaccacggttaaagattgttcagtgcaatacgcaacacgcagtgccttctcgaagtgcagaggaattattaaagcacctgaagatgagatgaccgcatacttccaacatggtttggttcacgcgaaacgttggattggttatcgtttcgcggtctcttctggtcgatttggtgggttagcgggtgattgtggaacaagtcgggtgcagggtgctagtggtttccgtaagcagctcgacttgacaacaaatttcgccacccaatccgtaatagagcgtacagtctctgccggtgcaacagcagggagatcaacaaaaatggaatacagtaaattagacttggtgcaggagtggcgttttagacttaattcgcacttgacagctactaggggttttactttttcttagaagggtctgaaattgatttttcttaactaaatatagttgaattgtacgtacttctaagcctggaagcaactaagatgcaatcggtgaacttcaagtccagcatttttctcaagcaaagcaccttaaggacaaatcctttcttgcatctgtgactgtgagttcgccatcagacattcagactgctaattctcccagtacttggcactggcagatctgccgatgtttccagcggagcaagaggctggataactgctactagcaccactcacgcaagcgaaagaagcacatgaacgcaaagcaccaacgtatgtgcactgtgcagcgcaaatcgccgagatgccgttctgtaaagcggcgaaagatttcgcttttgctgtgccaaaaaggctgctagtagaacatccgatgccatccggaccggcctacgcgtgaccgccacgtcggccgaccaacggatcgcaagcgaccgaaagcgcgctgcgccgccgctgccgccacgagctcacgacaattccacgaatgcgaatcgaaacggcagcgaccacggcgccacccccatgtgtgtacctgcgctgtgcgtgcggccgagcatccgcgccgcgcgacgagcagacgactcgtcgctcgcttttctccccagaacatcgccgtcgctgactcgtttgttcttttctctcaagcttacgtgtggaatgttcttatatgctttgaacttactccaatgagaaaaaatatatagattaaattgaaatgcatttatcatcctatcgaaatttcacgtggaatttaacttatatagagttataaaaaagagaaatagtggtagaaaataaagtgaacctttgtagtagttcagggctagagctcagctagtgtagcagcaccgcacactaaatctaaccaaatggaggcgaaaagatgtctcgccactcatctttgccctagccatgaccgtcgtcgcgtcggcatcttcttcggcgcctgcaccagcgtctcagacaccttcacaatctttcatgccatagacattcgcgaactctgtggtggtggtgacatatatatctcatgacatacgactgttgtttggccagatggctaggaaggtgcccagggagagttgccctggccccatgctgtatacggcagtctttcttcatcctcgatgccaaccctctccagtggctcactggcgaggcctaaggcacgacgacaagttatagcaatggctcggattaaattttgtaaaattttagtgatcatataataggttttataaatagtaatgatatattttaaatagtgattttgtaatgatgtggatcaaattgtacttactcgacgtgttagctgagccactagagagatgataattgtaagcaattagcaaatgaccatccataggcccgaaaggacgcttgccatctacaagttacaaccacgatggccagaaatggagtagaatctcgccttgtcacattgttatctggagtacaccagtagagaaaatagagtatgatattaccaccgtgtgtccggaaaagatctgcgtaaggcataaaaagtgattatggcgcaatcctttgcttccacccgaagattttggattctaaacgggccgacgccctgttagcacgtaggagtagtataatgcacatggatagcgttttctgatcttctcattgatgcggcagtacagcgacatgcattgtcaatttccaaactactccagctttacacatggatgatggatccactcgcgagctaagatatttgctttctaaatggaagagatatcagtattatcttcggttcagaaaaggatatatcagtactataaagacatgatatctctacccagatccaaaaggtatcatgggaaatatcctattggactttgctcggtactacttctacttcgatagaagtacggccgttgaggcttattcagaagagaaaagtatgaattatcctatgaattattggacgagtagtactaattacatccctaaatctgaaaactagatatcttttattctcaactattaataccaaacgaatcatcccctaacctaatatgaagttgttttggttctatgtgacaattgagtcaacaactcttttttaaaaaataaaatcagcgagcccaacctgttagtctctcgagtctcaccctctctctttcccctcacctctctactacctctatctactctagctctctctgtctctctcttctccctccctgacctccatctctctctgtcatcgagacagcgacggagggggagtcgaggatattaagggttatgaataaggcataccttatattgatagggttacgcaatatataaatatggtataccctcaagtatacagaaggttatcataatcataaggaatttggtcgaagtataaggaaaccatccttctgaatgaaaggtgttagagtcttgtttagatggatgtggactttgaaatctcgtacatgtgtcactagtggagaaaccatctttggtcggtcggccagatttcacaatagtcccggttgtattaaaaactgggactaaaaacatctttagtcccggtttaaaagctcagaggtactttttgatctttagtcccggttggtattaccaaccgggaaaaaagatcgacatactctttactcccggttggtgttaccaatcgggactaaagatctatttgtagtcctggttggtaacaccaaccgggaaaaaagatcgacatgcacggggaggtgtgcgcgcggataggatcgaggtctcctcctccttcccactcctctctcctttaactcccggctcctcctatcctctaactctttacaccttatctcttcctctcctcctttctctcccctttaacccccggctcctcctatcctctaactagcttcttacaccttatctcttcctctcctcctttccctccccaatcctccccacttcttgatctgcagcgcagaggcccgacggcgcctctcctcctttccctcccatcctccccacttcttaatctgcagcgcggaggcccgggcagcgtggaggctcgggcggccggcggccttgcggcggcacggcggcgggcagagggccggtcggcctcgcggcggcggtcggcgatccggcgggctgagggccaggcgacctcgcggcgggcggcgcagcagcggcagcgggcgtttctttgtttttttttgagaatttgtgattcggatctgagatgtatttgatttgtgtgtgatgtgaatatgtgatgtgttagtgataaattttgtaaaagttgtgatgtaattttttttaagattttgtgatgtatttggatatgatcgatttgaggatttggggatgattgatttgggattttgagatgaggatggagtgaaatcaatatattaaaaataatgaagaaaagaaaagaataatggagcaactggatctagctagcctagctctatctttagtcccggttggtgttaccaaccgggactaaaaatgctctatctttagtcccggttgataacaccaaccgggactaaaaatagatttttactcccggttatttcacccgagattaaagatatcgatctttagtcccggattcgtagtcccggatagaaaaccgggactacaaagggttatgaaccggtagtaaaaagcacttctccaccagtgtgtggtcctcttcgagttctccatataaatacaagacctctagggggtacgggatcatcgaatcataatcgcaacaccagccatagcagtagcaatttggaggactcgaagcccagccgctagtcgatctcgacaaaggtctaatcggtactcgtcggttccattgttctctattgtaagctttgtggttcttcataatcctatataaattggattagggatactaccttatgagggacctgaaccaatataatccttgttttttgtgtgcttgatgtcatatcgtatagatccttactccaacatactccaacattctcagaatacggtctacggatatctcccgtcgacagatatggcgagcgacggagggggagtcaaggatggcggcgagcggagcttgagacagccgaggatggcgagcggtggaggcggccctctctctcttctccctccccttatgtcaatcggttcagatggcaagtgacgaaggcggcaagcggtggaggtggctcctccttgacctctgctggcgcgcgcctcctgcatgaccgcctcgtgagcttgtcgctgacgtcgtcgtcactgccgctgagacatgccgcacccaaggccgtccacaacggtgtgcacatgtgtcgtcgccgccaccaatgcacagctcgtcctcggcttccgtaggtacacggggctcctccttgacatatgatagagatgggtgagacagggaagagatagagatgagagagatctgacaggtgggccccatcattttattaaaagaattgctgactagacagccacgtagtaccaaaaccgcttccaaagttattggggttcatctggtattgatagttaagggagaaagatatttggttttcgggtttagaggattaattcgtattcacccaataatttagaggtgtaatttggatattttcctgttcggaatggatggatgtttttaggaagttagactacgacggaaaacatcaaaatttaactcaaattaaatttcaactggtgattacgcaagcacaacgaacgtgctgcgggcaatacacgggtggaaggaggacaactgcacttttgtagtaggagataaaaattcaaactttacaattggtagttctatattatatatatatatatatatatatatatatatatatatatataagaacattacaattggctatcaaaccaacaagcagatgccgtcattgttgtctacaaagatgattaaattctggctagggcaaaacataacctcttaagatcatggtcatttcatatcctggagtccctttcgagctttttggtgtgagagtgcaattacaggtgcataattaacaccatgtcttagccaccaggaattaatcatggcgccggcatttccacccaggttgttgagttctactagcatataatttatagtaaacataacccaatattatcatatctattcagatttgtagtactaatttgtatctatatgatatgtagtactatgttactatggacggaataagttatcattttagcaaatataccatacttaaatacatcttaatatttttctcaaacaaatgagacaattagagttaagactgtattaatgtgtgactgcattagtaaagagtagtaagaggggatgctttggatcgtgagaacgttaagtattttgattaaaaaaaactctagcagaacgatgggtaacatagtaggttatattacccgagctccttttgttaatcaagcgtgtcatccgtacatgtaaagtgcctagacacttgaaaattttctgtccattggtacaaatagtagtagaacagactaatgttttcaaagctgcagttagtaattcttcctgcctccctcctaggtgaaaaggtcaaaaagggtatagaaattcccgagcgtgctaataatgtttttgtaaataatataaaaataatatcattttcgtttcaatgtattttaagatgtattggagtagttaaatttataatcatataaaaaatagtaataatatgaaagaccgtttttgttcctatcccgcttagtacagtactcccttaatataagagactcatcggttatccatatttcctaataacccaaaacaatttattaaagaataaaatttaatttgtaggtaaaacttttatatatttgtttgtagcggcttaaaaaccaatgctaaaaatatcgagaatatcttaaaatcaacttcaaatcaagtttaaaaattcaaattttatttagctaccaaaattttttgccaaaaacgtcaaatcgaattttagacacatgcatagagcaatataaataaaaaaactaattgcataatttgcatggaaatcgcgagacgaatcttttgagcctaattagtccatgattagccataagtgctatacacatgttaatgacagattaattaagcttaataaattcgtctcgcggtatccagacaagttatgattagttttttttattcatgtacgaaaacccctttcctacatctggtcaaacgtccgatgtgacactaaaaaaattttatttcacgaactaatactccatccgtactcgtaaagaagtcgtttaggacaatgtttaagtcaaatcttgggaatataaatcatgaataactctcaagttgttgaggttgaaaatataaaaattatataaatagatttgtcttgaaaaatactttcataaaagtataaatatatcacttttcaataaatatttttatagaaataaaaagttaaagttgtgttttggaaaccgtgtcgctgtttaaaacgaatttctttacgagtacggagggagtacaccctaaccgatgggactctattagggatggcaattgtgcccgtttgtccgtttacccgtgggtaaaaaccctattaggattgggtttgttctccattttatacccatgggtattttattgggttaaaagctatgcccgatgggtaaatggacatgggtatgggtaatcactacccatgcccgctttgcccgtttacccgcgaaatctaacttacatgtaggctagaagcaaaatccactagaatacataagccacgttctttgttttctacggtttcccttttatttcccttattatctctccctcttactctgtcgccgtcagaggagagacaccacaccgaggcagagaatatttgatgttttaagttcgatatcaaacttagaaggttgtagactttttgttccactacttttgttgtggcgggtaaacgggcacgcccgcgggcacaagacgcccgcgggcgatgggcatgggcaaccatccttacccgtcatgtagtaatgggtatacccacgggcaaaaataatctcatgggcacgggtatgggtaggcactacccgtacccatcgcgcccgattgccatccctagactctatgctacctgaactcctgaagcgtcgtgcaaaaaaactattccgttagagcaggtacaatagcaggctataagccagctataaacatattttaaagagataaaaaaaagagagagaaaagcagcaggctgcagatctgtagccagctacagtacggactctaagacgtactatgtgtatgataggtaggaccaggtattaatagtatagtaagcaactattatattaattggctattacattggctataaataagttagagccagtagttggctatactattaaacttgctcttagtgtggcatgcacggttgctagtagctgcctgcctgcgccagaaacgcactcattgccagttgacattggaagcagacgagttttctctacagtacgtgacgtgaaaatgcaaaaaagagttgtacgctacgtatcggaacagaaactagcacaacggaaggaaccaaaaatatctccgggaaggcgagtaggagtacagtgcgcggaggcccaagaaacgaccgtgaccgaccaggctccgtgacaatagccggggctcggttcgtctactctcatactacaaggctacggcgtaacgacggagaggagggaggacgtgcacagcgagaggcctgtcccatcaatcacgagccccgcccccaagaccccggtgtacgccacgaaacagccggccgatggcttccccgattcaaaagagagacgccgtagcccgtaggacgacgttaggtcactgtcgcgataacaatcgtcctgataggataatatatatctacatgtcccgatagattgttctatgataggcctcatctaatattactatgttgttccattctgaaacggagggagtatatactagagtaatttatgtccactgctccctccgtcccgaaataactcaatttagaatgggatgtgacccaaaaataatgaatttggacaaaggtttgtccagattcgttcctaaatcttgacatttaagtgtcacatcatcatccactagcaattattatctacaaatttttcaatcgcatgcaagtgtaccaactttattatccgctagcaattattatctagagtattttaaatatcatgtaaatatcatctaatattactatgttgttccattctgaaacggagggagtatatactagagtaatttatgtccactgctccctccgtcccgaaataactcaatttagaatgggatgtgacccaaaaataatgaatttggacaaaggtttgtccagattcgttcctaaatcttgacatttaagtgtcacatcatcatccactagcaattattatctacaaatttttcaatcgcatgcaagtgtaccaactttattatccgctagcaattattatctagagtattttaaatatcatgtaaatatgacagatcatttatagttttgttgtgtttttagaactcagtatataagcaatgtcaaatcattatctccagatcattttcacattatatatatatatatatatatatatatatataggaaggctattatgtactcccgggagtacatactccctaccctcataccgttgattacctttgagatttgtacctgataacgggttagcagtgaaggggacgtgcggtatctacccattagtggatcgtggatggcattttgttttaaaaattgaattaattgactgctcgtgtataactaatccctgaagaatcggtctgtacgcaggtaatgggcggtgaggaatggtatttatatcatcaaaccacatactgcttcatttgttcagggctgcaggaacttggtttggacctccgtagtccagctcgaggatacgccgccgcgcggcggtgctgatttaggatggataaacaagtgaagaaccacagaccttctgatggtacggatggatcaaggtatgttgttctgtttcagtgatttatttcagtatgtgccgctggttttttttctctgaatttcgccgtgtgaacttgagcaattctaaatcatcaattcagggaaattcttatggacgagcgcaaccctaccatggacatagtagatggtattagtcaatctgtccatgattcacaaccggatggtggtcagtcaaggttggatcgtagcttccgtgaatttaaaactctgtaaatggtagccagatactgacacatcttgattgtgttatgaagccgtgtagcaatggaggaggacgtgccgtcgcgggttggatcacatgattcagggcatggaattccagagacaaggtatgtgcatggctaggtgtcagctgagcattcactttaaagcagtatatactacatagaaatgttcagtatgtgtcacatgagaaagttcagtatatgctatcttctaggaaagttcagtatgtatcacatagaaaagttcagtatgtgctatattgcagaggagttcagtatgttgcacagaaaatttagaacatactatatgctgtcgtataacaaagttcagtacatagcctcccatagaaaaattcagtatatatgtgaaaaattcagtaaatactggtgcgtatcaaagttcagactacgaatcactatggaaagatttagtatacgtgtggaaaatgcagtatatgctatcgtctagaaaaattcagtacgtaacccatagaaaaattcagtacatactatcattcaacataaatcagaaagaacccctccattttaaaaaatgagtatatacaatcatctaacaaagttcagaacaaagctccccatatttttttgttagtagtacaacatatattttttttaaatttgcagtaagtactgattataaattaggttgttttttgtaaactacattttcagttagtagtagtatatgctatttttaaatatagtgtctccaatacagaaatttggtcccttcactggattggacagaaggaaacccatatgaaaaagaaggagctaggataccgatggaaaggtttgtatcagcatgttacggatttttacgattttttttgagccaggatattggtggtattttctgaaaactgattgtacattttcttttcagaatggtggtagataatgttgatagcagtgctgtcatacctcctgctgatcctcaaattcttactccgatgctgggacaaagatttaagactgagagggatgcctataatttttataatgtttatgctgttagtaaaggatttgggatacgactggacaaagatcacatgaatactaaaaagcagagaacaatgcggcaaatatgttgttctcaccaggtacatacattatgtaacaatatcttagtagcagaaatttacctaaataaagacttgacgtactatgtgttaatttcgaaatcttttatgcaggggaggaacccaaaaaccaagaagccttccgttcgaattgggtgcccagcaatgatgaagataaatatgtctggagctggtagtggctggtcagtaacaaaggttgtttctgcgcacaaccatcctatgaaaaaaagtgtaggagttactaagaattatcagtcgcacaatcaaatagatgaggggactcgtggtattattgaagagatggtagacagtagtatgagtcttacaaatatgtatggtatgttgtctgggatgcatggcggaccttccatggttccattcacgagaaaagctatggatagggttgcttatgcaattaggcgggatgagagcagcgatgacatgcaaaaaacacttgatgtcttgaaggatttgcaaaaaaggagcaagaatttcttttatagtatacaagttgacgaggcttgccgtgtgaagaacatattttggtctcatgctgtgtccagattgaactttgagcattttggtgatgtcatcacatttgatactacctacaaaacaaacaagtataatatgccctttgcaccatttgttggtgtaaacaatcactttcagagcaccttctttggttgtgccctgcttagagaagagactgaagaatcatttacatggttattcaatacattcaaagagtgcatgaatgggaaggttcctattggaatattaacaggtatgtgagtatttggccgaatttataatttggaatgaattcgttatactttacttattttaagtatatgatgggttattcattggatgcttattattgtccttaattttgcagacaattgtccttccatggcagctgccattagaacagtatttcccaatacaatccatcgtgtgtgcaagtcgcatgtactgaagaaagcaaaggaatttatggggaacatatactccaagtgtcatacattcaagaaagcatttcataaggttcttacgcagacactaacagaggaggagtttgttgcggcttggcacaaactgattagagattataatctggaaaaaagtgtttacttgcgtcacatatgggacataaggcgtaaatgggcatttgtatatttttcccataggttctttgctgggatgactactacacagagaagtgagtctgcaaaccatgtgtttaagatgtttgtgtcaccctctagctctatgaatggctttgttaagaggtacgaccggtttttcaatgagaagctgcaaaaagaggactcggaggaattccaaaccagtaatgtaagtatccactgtgataggtttgttgacctctttttatggatatgtgtaatcaacatttggtgtcgcttggtgcaggacaaggttgaaattaaaacaaggtcaccgatagagattcacgcatcccaagtatatactagggctgttttccaattgttctctgaggagttaaccgatagtatatcttacatggtgaaacctggggaggacgaaagcaccgtgcaagttgtacggatgaactcgcaagaatcattccttaggaaggaatatcaggtgtcttgtgatttggaaagagaggaattttcatgcgtttgcaagatgtttgagcataaggggattctgtgcagccacatcttaagggtatttgtttcttctactgtctaaacatttattttcattgggtcgtactatatgttcggtagtgtttggctttttgaagtaatgcattggtttgtccctttaggtacttgttcagtatggtttgtcaagaattccagagaggtatatactgaaaagatggacgaaggatgctcgggatactataccacctcatctacatgggtacaaagatgatgtcgatgcttcacaatcgaggagttacatacatgtaatgctgaaaaggaagactgtggaggtggctaagattgctaataaagatgtgcagacatttaagatggcaatgacagtcatgaataagcttttggaggacatgaaaaatcagttatctttggatgatggtgacaatagtagagaagctccgaagcgagcagctaggcataaatcaaggtctactgtattgactaaagatggaaacgaagatgttggtggaggtgatgaggacagtgagtatgacgtgccaagtgaggacgagggtggaaatttgactgctgatatacttccaccgttgaaaaagagaagcagaggaagacctaaggtgaataggtataaatcgggtggtgaggttgccagcctgaaaagaagaaaagaagtagggattgagaagaagaacacaaccaatgagtgtgagtccgttgaagaagaaaaccaagtcattgatcatgatgatgaagtgccctttcctcgtaggttttgccacacatgccacgaagctggtcataattcgcgaacttgcggccggacatctacgtacaagagaaaactttagaatatggttccctgtagtttagttgggactcctctgattgttagaagttgttttgttttaagtacgtgaacaaatttttgagaggcgtgtgttttttcatcctatgagcaatttattaagattatgtaacctgtggattggtcagtatatacgaccttaagtaaagtatgcttctagtagtaaattgtgtcttttttgggtagtgtatttgcaccggttaaaaatggatgtctgctgtaattagtttcatttggatgatggtgctttctctataaagagagaaagagatatagtatactggtatttatgacgatcattgtttgcaaaaggagtgtgatttggtgtggatatgagttgttttttttaggtatggagatagaaattagctgtgcaatgtattgaatcctcccgttcactgaaatggacataattatcgatagcaattgactcgttatcacgcagagtcaatgacataatttacgcagagtcaccgcatatattgaatcctcccgttgaaaatgataaatggaagtaaatgacatactgttattgtttggcatagtgaataatttccatagcacagttcgtgcaactgtcattgcaacccagacgatactttgtccatgcatagcaatgttttcatgattctgtcaagataggacagaagtgtatttcgaagattacatgaaaatgttctggtaaagctagaagtagaaaattgctaaactaattgtctttaatttgtcgaagacggtccaccacatattctggtagtattgcctcgttatcacgcagagtcaaaaggtggatcaaaaattgcctccggaggtagtacgggtcctgcgaaagttagagtattttctttatagctttatgaggacatatttatggtggagtgcggtgtgtgcggatatgaaagcattatgtacctctgtaatagggttcagaagacgacgaccatcgtagttcaccatatagttgaatacgtaaaagccacagtcatccctgtatgtttttgagaaagtagtgtcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46163 - DNA, 3398 bp, Oryza sativa
caatgggaagccgatgtctaagatgatggttgatggtggggcttctgtgaatttgatgccatatgccacatttaggaagctaggcaggaatgttgaggatctcatcaagacaaacatggttctcaaagacttcagtggcaatccatcagaaaccaaagtagttttgaatgtggagctgacagtcggcagcaagactatccctacaacattttttgtcatcgatgggaaggactcctaaaacttgttgcttggaagggattggattcatgctaattgttgtattccttcaaccatgcatcaatgcttgattcaatggctaggcgacaagattgaaattgtaccagccgacaggtcagttaacgttgccagtgctgatttagctctttaggagatggatggtcttgattgcttgtctggaaaggtatgggaaggagattttctaaaggtgtctgattgtgatatacaaccattgaagatggagagcccaagttattattttgagggcgtcgtggagggttcaaacgtctacaccaaggacacggtagacgatcttgatgacaagtaaggacagggtttcatgtcggccgatgatttggaagaaactgatataggtccaggtgatcgaccaaggccgacattcatcagtaagaacttatctccagaatttaggaccaagttgatagagctcttaaaggaattcagagattgctttgtttgggagtattataagatgccaggactcagccgatcgattgttgaacatcggctacctatcaaaccaggggttagaccgcaccaacaacctccgaggagatgcaaagccaatatgctcgaacctgtaaaagctgagattaaacgtttatattatgcttgttttattcgtccttatcgatatgccgagtgggtttctagtatagttccagttatcaagaaaaatggcaaagtcagggtgtgcattggtttcagagatttaaacaaagctacccaaaaggatgagtatccaatgccagtagccgatcaactggttgatgctgcttcggggcacaagatattgagttttatggatgggaatgcagggtacaatcagatctttatggctgaagaagatatccataagacagcttttcggtgtcctggtgcaatcgtcttgtttgagtgggttgtgatgacttttggcttgaagagtgctggagctacatatcaaagggccatgaattacatataccatgatctaatcagctggttggttgaagtctacattgatgatgtggttgttaagtctaaagagatagaagaccacatagccgatttgaagaaggtttttgagagaactaggaaatacggcctgaagatgaacccaacaaagtgcgcttttggtgtatcggctggccagtttttgggatttcttgttcatgaaagggggattgagataactcaaaggagtgttaatgcaatcaagaaaattcagcctctagagaacaagacagaattgctaattttgttagaaggtttattttgttagaaggtatatttctaatttgtctggaaggttagaaccttttacaccattgttgagattgaaagccgatcaaaaatttacttgggggcagagcatcagaaggctttggatagtattaaagaatatcttagctctcctccagttttgattcctccacagaagggaataccttttaggttatatctatcagccggtgagaagtcaatcggctcggttttgattcaggagcttgaaggaaaagaaagggttgtgttctatatttaagtcgtcggcttttggatgcagaaacaagatattctcctgtggagaagttgtgcttgtgcttatatttttcttgtacaaggttaaggcattatctattgtccaatgaatgcactgttatatgcaaggccgatgtagttatatatgttatcggctccgattttgaaaggaagggttggaaagtggatattttccttaacggaatttgatcttcggtatgaatcaccgaaggcggtcaaggggcaagctatagctgattttatcgttgatcatcgtgatgactcaatcggcttagttgaagttgtgccctggactttattcttcgatgggtcagtgtgcactcatggatgcggtatcggcttggttataatttcccctcggggggcaagttttgagtttgcttatactattaaaccttatgcaactaataatcaggctgagtatgaagcggttctcaaagggttgcaattactcaaggaagttgaagccgatgctgtggagatcatgggtgattccttgctagtggtcagtcaattggtaggagaatatgagtgcaaaaatgatacattaatggtttacaatgagaaatgccaagagttgatgaaagaatttcggctggtgactttgaagcatgtatctcgagaacagaatgttgaagctaatgatttggctaaaggggcatcgggttacaagccgatgatgaagtatgtcaaaatagaagttgccacattaacagccgatgattggaggtatgatgtgcatcattatctgcaaaatccatctcaatcggcttctcggaaattgcgctatagagctttgaagtataccctgttggatgatgagctatattatcggacgattgatggggtgttgcttaaatgtttgaatgccgatcaagctaaggttgcaatcggtgaggtacatgaaggaatttgtggcactcatcaattggctcaaaagatgaagtggttgcttcgacgtgcaggatatttttggccgacattgctggaggattgttttaagtattacaaagggtgtcaagattgtcaaaagtttggagcaattcaaagagcgccagcatcggctatgaatcccatcatcaagccatggccatttagcatgtgtttggttctgggactaggtgggataggatgaaaccatccctgatttgaggattgggatgattccattcgggtgtttggtttgaagaataggatgatcccagttttttgtttggttcaaggaacgagggagggatgggatgagcgccgtttacaaccaccgacaacgccgtttgcaacaaccatggccgacgccgcctctgccctcacctccagacgtggtcgggcgggcggagaagcgcgacgacgcacggtcggccttcgcgtagagcagccgcggctcgacgacgacgacggcggcgaggtccgcgcgggagagggagagggagaggccggtggagaggagggcgagcacggccaccatcgcggtcgggcgggcggagaagcgcgacgacacacggtcggcccgccgccgagttccccgcctccggatccgtcgccacaaccttccccatcgctggatccgccgccgccgccctacacaccaccggatccgc

SEQ ID NO: 46164 - DNA, 2886 bp, Oryza sativa
tcccatcccatcccatcccagcaaccaaacactagaggttggggaattgatatgatcggtatgattaatacaccatcgagcaaaggacacatgtttatattggtggcaaccgattattttaccaagtgggtagaggcgattcctttgaataaagttgattctggggatgctatacaatttgttcaagagcatatactctatcgatttggtattcctcaaattattacaaccgatcaaggatcaatcttcgtgtccgatgagtttgtttagtttgccgatagtatgggtatcaaattgttgaattcttcgccatattatgcacaagctaatgggcaagccgaggcatctaacaagagtttgatcaaattgattaagagaaagatttcagattatcctcggcagtggcatactcgattggccgaagcattgtggtcttatcggatggcttgtcatggttcgatccaagtccctccttataagcttgtttctggacatgaggctgttttaccatgggaagttagaattggttcaagaagaacggagttgcaaaatgatttgacagccgatgagtattataatctcatggccgatgaaagggaagacttggttcaattaagattgagagcccttgcaaaggctaccaaagataaggaacgtgttgtggtgcctaagtccttttctgaaggtgaacttgtttggaaattgattttgccgatagggactcgagataacaaattcagcaagtggtcaccaaattgggaggcaccgtttcaaatttataaggttgtatccaaaggagcgtacatgttgcaaggactcgatggagatgtttatggacgagcactcaatgggaaatatttgaagaagtattacccaagtgtttgggttaatgcatgatcggctggtgttgccgatagcatgatagccgatgtattcacatcaccttgagatggccgattgactgctttcatgactgccagattcagtcaagtctgcagtagccaccatggtccacctactccaactaccgagccgacagctatcttggccgatgcattgttcaacatttggtacagatagccgaggaggattttgcctaaggggaattgtctttttgattctagagcttcggctataaactgccagttggttgtagcaccacaactggatccatagaagaggaacttttctagccacatcagcagaaaggctatatgctctcgagaggtgactgaccctgtgcccatgtattccgccacataaccagaccaaccacctatgctcttggtcctgaagtcatattgattcttggtgttcagactcataggattagccgatgaggtcacatccagaccggtgatcatggtgatatcaatcaaagttggggtcatcggccttggttgaacagaaaagcgttgatggtattggaccagaaataggtggcagcggccattaagggttcatccttagctgaatttgctatggggagggcaagtgcttgaccgattccaattttgtcctagtgtgtttgcttgcttgctgatacacgcttgtaccatgtggtcaagagatggccaagacgtaaaagtgtttgtccagtgacctagattcgggttggctaatctaaaaggaatcctattggtttcaccgatgatgaactcagtgggatcaagatcaccgattggacctaggaaatagtgtctctcatgcgacaaacttgggattgcgaccagattggaaaggtaatacgaattcaaaaggaatagagaagaataaaacaagattagacgacgaaaatcgatctattgcgcagaaaaaagggatctagccgatgggcacgtacctcagcatactcggctgatggcgcgatagacgggctggcggaggtcaacatcgccgtgggcggaaatttggccgaagaagaaatcacctggaaatcgccttgcgcactgaggggatcgccagagagagagaggacggagtttgcttcggcggtgaaaacggaggaaacagtgtgaagtttctcggggacaacggttagtatttaaagcgctgggtaacagtcggaaaacggcaagtgcagatttctctcggagtcgacatatggcaaatccaaaacattatccaatattccggacttggggggcatgtgttaacgaccaaatttggtaatccaaggatcggagatgaagaagaaatcgagatggagatcatcccggaaatggagtaaagatcggctggagtccaaatcggctgcgaccaggatcggcagagtccgagttggacaaggttagcctattgagtcgaatccgacaatgtgacacggcatacgttgtcgggttgaattaatgtgcttcatgaggattgccacgcatggatagagtcctgagaaggcaattgtatctattaaattaggatattttatgtatattccttagaaatatgtttgggcaaaagtctgccgcaaagacttaaggtgtcttagagtttgttagagataagagtcgtgtccgacacggacttgttttgtaatctctggtataaatagaccccgagccccatgtaatcaaactaacacacgttcaatacaatctcggcacatcgccacccttttactttcattttgtttcgacgagttcttgctttcgggttgagctgcattggtttcgatcttcaacaagaggtaaaacttgttatggcggcttgcgttgtcgggattagtgcttccatctttatgatactctaatcttgtttatgtaattcgtcgagttatcatatgccttatataatctctggcaatatcactatctaacctccaatcggctaacgtctgttactagacggcagccgactaggttaaatatcgatgttgacttagattatata

SEQ ID NO: 46165 - DNA, 5873 bp, Oryza sativa
acatttattctatatgcttcgttgatatgttagatctgccctctatgctaagatcttgttgcatttacatatattaggcctttgtttagtatattctacttgctttaatatcttagtatagagtggtatcggagtattagccggtacatgctagatctatctgatcggctatgctatgaacatatatagtcccattattaatatatatttcgatctaagtgatttatactgtctcggcatgacgaccgatctatcccaatcacttaatttaagtatatattgatatgaggagtatatattgttaatatctacaactgatcgagtagatttagttccttcctaattatttatgactgccgatcgatacatatatgacatcggctccaagataaatgatatgtcatcggcacttagccgatcggctatcgtttataggtttaaccgcggtttctttgtcttttttccttgttgattgcaggatcaaatcaactggcacgctagcatacccgaaggcgagttttggacctgcactggagttaagcagatctcccaggcctcgtgtttttcatcaacaggcacgacgacgggttggcgtggtcggcaagttgacggcggcggcggcgtggagataacggcggccggtttcttagcggccacggaaggcgttggcggcggtgtgcgcgggtgcaacacgcgcacctggatgaggaaggcggctcggctatgggccgatttgggccggcttgggctgaggggagaagaaaaaggatttcggcccaaagtgaacagaaactgtttctgaattttgaagggggtttgggaaatggaattggattggatttatatttgaaaagaattttaataggaaagtttggaaggaaattatatttggatataatttccaaaagtgatattttctaatttgagtgcaatatttttggaagtggaatatagtggaatttatatagatgcactccaatgggggagagagagatataattgggaatgtgtgaggaaaatggagggaatggaataaataaaattttagcccaaaatatgtggtaggaaatctagaattgattatgggctaaatgaggttttggatttgggatggaaggatgaaatatatcttcttagcaaacgagcaatatttgcaatatttgtaatagtattattcttgtgccgaggaggaaatcaagccaagggaattaaattggcggctagattgaaaggaggaatttggatacttgagatttggaaagggaactaaggataggtttggaatcaaaggatgggtcgacaattaattccaattaaaattgaaattacaaagaattggtttggagggttttctttgaccataattcatacaaatgaaaagggttttcaactaaatttgaataaaaggaattttgtcgaaagaaggttttaatttaaaacccaaaatcaagaaacaccttaatttaactaaatatatttttaaatgaaaaacacaaaagaagttaaataccaaagagggattttatgcaagttagttttaggaggtctcactaattatattttcctaggtgtaggaagttattaaaaacataagaagcggcatgatgcaggattagaaaattgtaaattttcaggatgttacaaaaggataccgaactcagggaacgtatgtaatctacctaaggctaagacgatccaaggacaacaactatgtaggctggctaggctagagatgactttctatgtattttaattatctaatttcctatctgttgcttcaggcaccgacccgtgctaatctgccagcgtggttccggctatagctctatgatgtatccgaacgtggaggattactaggacaggattcagggctgtcaccacctgccatctacctctaacaaatccatgggatacacaacaaacaaaggtaatctctaacctagacatcacgcctaagttattaattactactctaatacttgcgcatgaactttcttttttatccagagtcctagtactagagcacttagtatgaatactaaataatgaacccgcaaagatggaaatctatcttacttagacaaagtaattaaataacataagaaaggaacacgaatgtttactttctagaagaagtttctcccaacccggagcagagtgtaccgacagctccggtactcctccagaattcctcctatgaagctccactcgtcgaggtagaagtcggatgagcgctaaacttccgggcactcctccagagcttcccctcactctctacctaattttaatgtacaaaagatacaacagagcctcttgtaattcagctcaaagttgtgtgctggaaatgagagtgagctcctccttttataggcaggtatgacgattatagcctatgcaaaatgtccaaaatggcccggaaccgccattaggaattaatcatgaccgtccacatgaaaaatggtgatcaacggcctcatgaatggttcggccgaactggtggttcagccgaaccctggacggctccgttcagcccatttttcctcgcggacactaattttgaggcccttagcccattggcatggtggtttgggccatttggaggtgtttaattgggttttttgggtccaaaactctataagtttggatatgcgtttgattatcctccttcttcatgtatatttcctctcaactttgttagtttgtcacctacatccaaatatatagcaacattagtggaaatgattagtaataaaccataccactaagttgaataccatattttattccgtatatgcaggtattggcggtcagatattatgatttaaggaccatcaacagtaatagaaagatgcatggttatcattttatgaggtttattattcaaatacctttacaaacttaggaatccggttaaaatgggcatttgagttgatgttgtgattgttgaaagttatgaatgttggaatttatgatgaagtttgttggtatggaagttttggatgttgagataattttttgtggtttaaccggattataattacccccttataccatggaaatgacatagtttgtacccatccacacgaccaagtaattggacttagcctagtatattgtctcactatatgaaagactgttgggtggctcgttaggagcaggttttggggtgaacttgcgtaaggagtttgggcggcaatgtttcacaatagtgggtctcatgaaaagtgtgatgatatagataccttgcctaggcctggcaagagttcgaccactatgatgagccaagaccccactgtgcagtaactagtagtaagtgggactctcgaacgctatggtgttttcagcattacaaactgttctcatcgtgtgggtaaagctgggcagacactacagagtcgtactgtattcaaatacaccgtgctcccggttaaggagatatgtcatcaaggtgatttctactcctgaagtataagtagttttaaaattaaaatgttgaggataaagatgatttatggtttttatttctcctttactttatcattgttgtatttaatcatatctcttcacctttaattatttataatatgtcttgctaagtacataagtactcacccttgcataatttaacatatagatattgtgctaacaagaagactagaagatagcgaggtctatgacaatgacgagtttttcttctaggctagtctacactcgagcttttgcctgtggaattcatagttgtagttcaggagttcaagagtttaatagattaggagtttagtagtttagtagtttggatttttcttgtattttcaaataaggatgtattagtttggatcttttcaacctttaacaattgtataaatagcttctatgaacaaatctgtgtaaactaatcaaaagctgctctgtatatcaatctgtgcgtgatcaaaattctggatgatcaccagtggatatttggggcaccaggctaaattgggtgtccccacacgtggaccccacatgtcaggatgccacatcatcaccctctctctctttcccctcctctcccttcctcctctctctctctctctctcacttttctcctacaagtcggtcgacagatggggacagcggcggtgaactcggtagggcgtggtgtggcgttcaccatacctcacgccacccgcctaccccattcctcctttcaacggtccggcagcagatgtcgtcgtcgaatcgtccgcttgttgtgcgctcgcgtaggcagaggcgtggtgtcactgcgtcgggagaagacgacaccgaagtcatgctgggcgcctaggtcgctcgcgcgattgagtttgttttatgttaatttgggtatcaattgttgaccactgaaccctatctcaaaatttcccatctcttctactcttcatgtcctggcggctggcgagcagcgacggacggctcgacaactcggtcatgcgcgggaggcggcaggcagcagcaggccagccgcaagctgccaacggcgccggcaagcaagcacatagaggcgcatgcggcaggcacaggtggtgggctgggcgtagccgcgtaggcgcgtaggcgaagcagcgggctgctgcagccggtaggcagcagtagcaccacaggccgcagcggcaagagcaagcagcaagccaacaaggaagccaaggagcattgtaaattcaaagtgtattgaaaattttgaaattacatttgtgtaattgatgcgaactctcgcatcgcgagttccccgttgccgtcggagaggaggagcacctcatcacgacagcgaagaagccgagccatgcacttgaggaaggtggtgcagaatccgagggcgccactgaggacaagcgcgtggtttggcgagccacttgttggacgagcacgtggttgccgagccgaggacgagcatcggctgcggtggcggtgggggtgctgtgggggaaggtcctcctgctctggtgctctcgcgccgttgtcatcgccgccgcctcgtcgcccatcgccaactgccggactctcgcctcccccaccggctggcctgctctcgctcccgctggccggcggcgagcgctccgtcgacaccatttgcgacggcgcctggccctgcctccacctccgcggccaccactgtggtgcccggccccgcctccgcctcccgcccaacaccggtggcgacaccgcgctattgacgccattcacaaccgcccgccaccctcgccttgtcccgcgtcgcagccgccgccgccttctcctctcctgcctcgccctggcgtcctcctccccagccgccggtcggcttggccagagaagggaagagaagagtgagagagagagaggaggaagaggaggggaaagagagagagggtgatgacgtggcatgctgacatgtgggcgcatgtgggtcccacactgacttagccaccacgtcggatgaaaccggggtcaaaaccttcgaaggacctaaagtgactggttttgattagttaaggcacatttgatatctgattttgtggtttgagaacgttttttttatcttgatatcaaattgaggaaccgaagtgtactttttccgaggcatgtgactcagcccatcccgtttggttggagggtatttttaggagggattgaaagtttagagggatgaggctattaagtgttttgtttggttgagagacatgagaattttagtgggatggggatcgagaattgaggaaggaactccctccttttcaatacctgggtaggggcaggtaattgggagggaattcctcctttactttgtctaagtaaatctcagccatacgtttttattaatgaactaatctccaaccaaactccctatcaatttttgtcacctctaccaaata

SEQ ID NO: 46166 - DNA, 4416 bp, Oryza sativa
ctacccaagtatgaaaagagggagttccttcgtcaattccccatccccatccaccaaaattcccatgtctcccaaccaaacaaaacacttagagcatgcccaacagccacccaatatttgattcccaaaaaatatgaattaggaattccaaagtaaaaattgggcccaataatcaccctctcctccaagagaggcccaaaaattaattccctattatttgttagttttccacataagcaaggtgggcctagttcggtaccgatcgatcgtctccctccccgcaattgcgccgagtcttctccctccccgcaccagcgccgtgagtcttctccctcagcgtaccaacgccgccatctgagtcatcaccagccaaccactgactgctgcggtttctacaaaaacggaatactgaggatatgccgtagctattcgtgtaatcaaggaggtaatccctagcaaatcttattgatctcttgtgccctagtcaatctctatgtgtttattttgatatgtgaagatttactgtatggaaaatattaagtttgatctgataattaattttgtagattgattattgttctattcctgccatcggttcccctacatcgcacttcatccctacggtaataaacactccaaccccgtgccaaaaaaaggagatgagtcgtcgaagcaccctcctccaaatgctattggatgaggagtctttatcggatggcgaagaagaatttattttttcggcagttgatatagtgcactgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaatattctcggatttttcggagcacaattcctaattttaatcatacaaagagcatttcagtaattaaccacatattaaattaatcattaaatggtctaattataattttgttaagtactttgagtgtccaagtattttcaggatttttcttgaaattatttgagcattggaagtatttttaacaattcaaagatcatttaagtgattattttaattgggaaagtaataaaattctcctcccttgtcttaggctgaatcggcccattcctttccttcctctctcttccgccggcccaacctgagccgcctcctctcctctcagcccagccggaaaagtctactttctctccctgcgctactgttcatcttccagctcaggcagagcccgagccagccgtgccgtgcacaatgccgcctttttccaaatctcgcctccccgttgctcctttttccaatttagttgaggggaaatattcctcttatcctcctctatctttaccccaaaaatcggagctaatcgttgagtatcttatccgaatcgaactcgttttcgagtttatctccgaaaccgagtttttgatttcccggatcgatttcttgcgggaggagtccgatctcttcaatccaaggctataaataggaccccctagtccacctctttcgtttgcccctctcccgtggtctcccgtgccccgtagcctctccgccgccgccgccgccaagttcgccgccgccgccggccgaacttcggccgtgtcgcgccgtcgcctccgccgttgccgtcggtcgccgtcaccgccgaaaggtgcgccgaggtgtgggcaagctcggccgctccctccccgctgtcgccggtcaccggagccccgtcgccgccgtcgaccgaagccgcgccgccgctagacctcgtcgcctgccgtcgtcgttcgtcgtttgattcgagagtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgttaaaaatatccatatgtactgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacaaatcctatacacaatcctttgagcatgttgatcttatatttaaattctctatttatttcaactgtgcatttatttttgaatgtcactgggtggtgtgaatctattcttttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacagctttaccttttgtatagcatggttcattgcagagcaccagactaagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttaaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttagagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattgtgccatcctttggtatccttgtgcatttgcatatttgctgtgtggcttgttgagtatgtcatatgctcattcttgcaataatcaatcaacctcagttgaagacaagttgcgaaggagaagacgtttggcttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacatgcacggtgagttcgatgacgatgaagttccaaagcgtggtggatctgtcttaggtcatgcagtaattaatcgggaaagattggctggtcaagattgtataatgattatttttccgaagaacctacgtacctcgatgttcagtttagacgcaggtttgtagcagtgctttttgttttgtcaatctttgtttgcaaaattgatacatatgagaattattattattaattactatgcaggtttagaatgaggcgacctctctttttacgcataatgaatgctattgaagcacatgatgaatattttgtgcagaagagaaatgcggctggtatccttggactgtcatgtttgcaaaaggtaacatcagcggctggtatccttggactgtcatgtttgcaaaaggtaacagcagtgtcacatatgttatgttatggaatagcagcagatgcagttgatgagtatgttcatattggaggtagtaccgttattgagagttttaaaaggtttgtggtggctgttgatgaagtttttggagaggagtatatgagaacaccaaacgaaaacgacatagctagattacttgctcagggggaagaaagaaggttcccaggaatgttgggttctttagattgtatgcattggcagtggaagaactgcccgactgcatggcaaggccaatataaagggaaagagggggttcctactatagttttggaagccgttgcctcacgtga

SEQ ID NO: 46167 - DNA, 8448 bp, Oryza sativa
atctcataatgatattaatgtccttcaaaggtcaccatggtttgcaaagctagctgaagggcaggctcctaaagttaatttcagtatcaatgggcatgactacactatggggtactatcttgcatatggtatttatccttcatgggcaacacttgtgaagagcattaagctgccacaaggcaataagagaaaatattttaccaaagcacaagaagccaataggaaggacgttgaacaagtgtttggagtgcttcaagctcgctttgctattgtccgtggaccagctcgtttttggaaagcaattactctgaattagataatgagagcttgtataatcatgaataacatgattgtggaggatgagcacgatggtgattttgatttagtttatgatgagatgggagaacaggtgggtggttcccaagaacatacgcccaactttaatgattttattagtcagtacgaaaaaattcaagacaaggaagttcacaaccaactaagagaagacctcatcgaacatttgtggaatcatcatgcagatcaatattaagtttagattttatattattgaataatgtcagagattgtaataattagatattcaccgtgtgttttgtaattagtacaatacattgaggccatgaattttctgcatatttcttttgttttcaaatattcacaggcatatttcagaatcattacgcactgatgtttttgtttatttatttgcaaaagacagcagcatcaagcttaattatgtggaatgtgaatagcacttgttgtaattttttagcacctgtaatcaggagcagcatcagagaaagcagagacagacaaagaaggtcccatggtctgaaactctgaactttaatctgaaacactcattaagaggctacctagcatccattttattaaggaagtctgataatgtatatgttttttaaggttagaggagtttattagcacagtgatgttaacatcttattttaattgcagaaaatttattagtgagaataggtgtggagattatgggtaccccatacccacacggcatggttatccgactagtcaaaggggatagcttatatatatggaatatgtaacagattatgacttgggtattacgtttccttgtatattacggaacggcctaaagtcctggtttgataagattataaagtagagttagaaaaccgataccgtattggataaggtttctatcttgtaatcctgccccccatcctatataaggtgggcaggaggccctctagggggcatgagacaacctgatcgtcagatcaatacacaccccggcggattcaaatccccaaacaggagtagggtattacctctcatcgagagggcctgaacctgtctaaatcctttgcctccgcatccatccacttttaggtctcgtgcgctacccccttttcatattgtcgaattcatgtttcgacagttggcgcaccaggtaggggttgcgttgagttacctgtcgacaagtgcgatggaatcaacttcatgagtcaccggcttcatcttcgcttcgggagttttttcgccgaccacttcaacatgctcttgctcttcgactcggatccaatctagccgggaagatcagtctcgacatgttcgatggattcaatttccaccgccgtcaatacctccatggaagacctcagttcaagatcaaataccatatatacatgccctgccgctgtcggaatccgatcattgccaggacgagtcccacgccaattatccgttcggcctgatttcaactcagctgcgattagccagacgcagaacgacggaaggcagtcatctatccaataggaatagtaatcatgtgcgatttcgccatgtatacaatatacatgcatatagcagaatccactgacaacagattgatctggaattataattagcagactttgcagcacgtgtctccaattactgaagcaccagcatatatactatcgttattcccaggcagatttgtttgttttgggagcttggactttgccgccatgcataggcaacgttgtctaatatggagtaattaagattcatgcaactactacatgatttaatcaccggatggcatcgatcaatccacctctgtccgagctgtacacgagtgcctgatctaaatgcacagaggcacgtcgccaggaggacgagtcggcagagtcaaaccaacgagctgggcagacgtcgcatgctaccacatggatagaccggcaggagtgcgaagctgtttctccgttccctgacttcatcgttgccggcttgcctccgccatcatcaccgccggcctgcctccgtcgccgccgaccggtgtcctcgcctatacggttggttggtcacaccaccgttcatgggcgtccacatcttcactgaccggccgcctcgtccgctgccgactggtgtttccgcctgcacggctggcctattatatgctgccgttgttgggcgtccgtcgactggtgtcctcgcctatacggttggttggtcacaccaccgtacatgggcgtctacgtcttcaccgaccggctggccttcgtcgccgccgactggtgtttccgcctgcacggctggcctattatgccgccgctgttgggcgtctacgacttcaccgccggcctgcctctgccgccactgactggtgttttcgcctatacggttggcggacttcgccgccgttaatgggcttcatcatctacaccactggcttggttccactggcgccgactgttgtttttgtcaccactgatggactgcttcattcccacatcggctacttctgttgtcaccgagggaatacgacaaagcttagtcatcatttattttattctttatatgatattttaccttttcctttgcctcactacatcaactggttcgctgttgactagtgagtcgggggctacaaatgttatatcatattttttaaacaattttcataatatttatcttgattgcttgcgacttattctgagtacaaaagtgcctatcgagttatggagttccatcttcctatgctttccgtttggtttgccaatggatagttgcctttgggccgattcctagcacccgggggcttgttggatggaccgaataacgcaaggtgctaagcattattcggaataaatcaaaagcatagagataagataatttattttctgctcttaataattgcaaaagtacccgagtagtaaactccgacccgtgaaactttattccattaatgacgaactcatgtcactcatatgcatgtttgggaagtgcttaggccgactcccggtgcttggtagctatgactagtcgggcagagtgtttaaacgtaatgagtcatctgtttggggaaatcaaaattgacaagagaagaaatacatatttataaatattttaaaatacttgcatttttctcgagtattatatttacatcagatactactcatcctatctgtttgttctgtaggatccagatccagatatgcataaaagggattcacggctttaagcttatctcctacgcttcaggaatggatcagtcagaacatcaccatcggcttgcgttcgtctgccgccggctggtgtctccgcctgcacggctggccaattatgccgccgttgttgggcgtctacgtcttcaccgaccggccgcctcgtctgccgccgactggtgtctccccctgcacggctggcctattatgccgccgttgttgggcgtctacgtcttcaccgaccggccacctcgtctgccaccgactggtgtctccgcctgcacggctggcctattatgccgccgtctgttgggcgtctacgtcttcaccgaccggccgcctcgtctgccgccgactggtgtctccgcctgcacggctggcctattatgctgccgtctgttgggcgtctacgtcttcacctaccggccgcctcgtctgccgccgactggtgtctccgcctgcacggctggcctattatgccgccgttgttgggcgtctacgtcttcaccgaccggtcacctcgtctgccgccgactggtgtctccgcctgcacggctggcccattatgccgccgtctgttgggcgtctacgtcttcaccgaccggccgcctcgtctgccgccgactggtgtctccgcctgcacggctggcctattatgccgccgtctattgggcgtctacgtcttcaccaaccggccgcctcgtctgccgccgactggtgtcttcgcctgcacggctggcctattatgccgccgtctgttgggcgtctacgtcttcactgaccggcttgccttcgccgccgccggtgtctccgcctacacggctggcctattatgccgccgtctgttgggcgtctacgtcttcaccgaccgaccgcctcgtcgtctccgactgattatttcgtcaccaaggctacaaaactctgtcgctattgctgggtgcattcatcttcactgttagttgatctgactgccgccgactggtttcttcgcttccatgccgattgcatcagctatcaccgatggataatttcaactactccaaaaggacaagctatatactcaggggcttactacctcaaacaccagtatcataccttcaatttggacttgttccggatacatgcaacatgaatttaatgatcatgggtctattttctatgctcaaagactggactatttattattccccataagagttatcaaccgaatacttgcgccggtcgggattcaattattatatctattttggagtatcccataagggataatcattcagatcagaagaacaacacttcatgtttacctatgcaaactaacaatttctcacactttattttaggggtccaccaaaaaaaaggctgaagaaagcatcttccagtaacatagtgactagcattgttgtggccactcctggatcaggcatggtattcccacacaatgaggtggcggccagtgctacacagaagccaaagagagtgaaaaaagccgccaaaaagaaggggccaccaacatcaagaagtactgacaattcgatgacgagcaggtatgatctttcacttttcctaatcttgtcatttccaacctcactgatctctttttcttgctttcacacaaggtctataactggatccaataacccctttgctctccaaattgagcaccctccagttgttcatgatgacattgcatcctatgaagtctctccacagacagtggacacaccaaggaagaagcaagccgtcaagaagtgtacaccaaggagggctcctattgaagtggctaacccatccagcccagcttctaatactagaagcaagaagaaactccagcttgaataaattatgtggaggaactactacttttgatgtaatttaagacatgtatggtttggtgtgatgaaaactagtgaactactactttttatgtgtggacttagtgtgatgaaaactagtgaacttgttgctgtgaacttggtgctatgaacttgttgctatgaacttgttgctatggatgcaatggtcatgtatggtttgatatgaacttgtatggtttgatatgaacttgttactatgggtgcaatggtcatgcccttgttttgtccatgtgatatgttgttatttgtcggtatgtaatggtcatgcacctgttttttcctttttaaaaaaattatttccgatttttccttatattttccaccattttataatttttcccacattttcctaaattttcccggatttttaaacattttcaaaatttattctcactttttctgatttttacctttttttaaaaaatattttccatttttttgattttaacgccttttctaaattatttttcacttttctgattttttttaaacccattattgtacacaagggcaaaactgtctttacacagcccctaacacctctgttatgtctccatccatccaaaatagtacacgggtcaataaaaattgggctcacggcgtataagtaacttcaattttttttatggtgcacacttaagcagcaactttgaacaggagtaaaaactccgggacgagcgcgtcttgagaaaatgagaaagaaacggaggaaaaaaaaaaggaaggatcggcgcatggcatttctctcccaggcgctgccacaaacgtctccgtgcccttccgccgccgatcccgagagaaggccccgaccagagcgcctcccccgcgccccaaggccgaaaccctagccgcgccacctcccaggtccccacgatcgccccggaaggcggtggtggcgacggtgggtgggggaggaggacggaaggcacacaggccggtggtgccacggcgaccaccatgtccgctgtagtgtgcggcaagcgggcttcctcttccttcttcgaggatctcacccacccgaccggcggctcccctcccgctgccaagcgtacccgctgcgggggcgcctttttcccgccgccgccgccgcccacctggccacgcggcgtcaccaagaacgaccttgtcgcccgactctctacgcaattccctgccatgagcctcgaggtgagcctcctcccaccctcctccttccccctctttggggtgcaaattcggatgcggatatgcaggagaaccttgtagtgggagaggtaattttttgttgagggatttttttggatgtagaaaaatgcagtcttgttgagattggtagctgctgtacccatccgcgatggaagaagcggtcttctcattgggcctcaattgtccgttgaatttgatgaagtttacttactttgattttgtatcttcatttaccttgttatcttattctctaccttgcacttttcgtttctgcactgaactaggaaataccatagatagatggaatgatagttcaatcctgaactggtttaggtctcatgtgttaggagaggaaaggcctttttgattcttgcaggactttgggtttggtgtgaccatgacactgaatgatttgacacaggtgaagtctagacagctgcaaatttaatcactagaagtgcaagccaaccacataaacatttgtgctttgcctggaaggatgttcattgacaatccaacttgatgactcgtgagaggattttgattaccaaactgcttaggaagttttgagcactgtaatggagatgatatctatatctcattccacttctttagatttagattagcataatgtaaaataccataagcttatatccaattagattgtgctaaattctacattgattgattggtaattttggttaggaaagagtttgtattgatggatgcatgacttccttggattattcttctaatttgctattttgcaaaagattttttcttgtattttcatgagaagctctggtgcatgtgaatgtggaagttttgcgaaaatcctgatacaagtcattgttgctctcagatgattgaaaaggctctggacaaatctggaaataatgtggattcagcaataaggagtttgcttaatctacatttggaatctgtgcaaaataacagtggcgttgcatttgaacccatacaagaaaccactgaggttcaggtgtctgctgaaggtaattttcaactgggtactttaatcatctgtggcatattgaatatcaactatcttctttatggttctgtttggcattgaggtgtattatgataatcttgtttggtgcaactacttctaggcatttttgttgtttggcaactgattttcttttaaattaagttaccgcaataatatcattgcattctgaaaatatggaacaattgatagttacaacagttaaataatgtatttttctaaccttaatttgatctgtaaaacaaattacaacaattataaattatgtttctacagaaacttaataataagcacatcacaagtaaacaactgcaaactgagcctgttgctcctttgtttgtgctttgaattctattttatggcatagaagcagctgaaggtcatgagaatctaaaagcgagaaaatcctgtttaccaacctaatttttggttgtgctggacctaaagaattttttagtaaatcatctttaataccccttcccccgcctacacacacacatgcacacccacgaacacgcatacactcaaatgacagtttctactcatcgagaaggtttgtatttgtaacatcaaactttctataaggaaacatgtaatgttggctaaatttgtttgtacattagtagtacattggtttataaaaggagcacagtatcaaatctgtggagagttgcaatatgtagacatgaacacatgttttacattaatacaatgaacactggccaatctggagacatgagcacttgaatatcaaagtaacatgaaaacacaagaatacatgaacaatcacggtaaatcatgatattcatgaacagaagaaaataccaacagatctagagtcttgaacaat

SEQ ID NO: 46168 - DNA, 16105 bp, Oryza sativa
  unsure (1)..(16105): unsure at all n locations
tgtctgactgtattttagtatggcattaagaaagtgatttactttgcttgctgtttgtgctatctgcctgtgtgatactgtcatgctcaggtctgttagatccgaattttgtttggtgctgtataccatggtaggtgtggcttgtagactgacatgtgcactatgttatatctgtatgttcacatgtttgctactttcattcatcatttgcctctagtgacctttttagtcgcccatcaccattgaatttcatgactattttgttggcagttgtttcagatggtaacgagattggtgcaccttcagaaagtgccccttgtcctgagaactttccgtcaaatggctcagaatgggtcgagctacttgtgaatgagatgacaactgcttctaacatggatgatgcaaagtctcgtgccaccagagtgctggaggcttttgagaaggctgtggtgtctcatgtcaatgctcaaggacctcatgattttcaaaaggttgttggaatatcctcctgttaactttacatgattctatcaattgttgttcaaaatcatagctatagtagatgtgttgcaacaaatctataagatcagtttacagccgtaagttgcatttggtgcatgcagtctatttgactatttatttaaattacttgaggaattttcctttatcaccataatttcctgaggtaacatggcagtcaaacaggaaaatgcagtgcttaaggggcaaatggaatcgcttacaagagaaaacaccattctgaagagagcatttgcgatacagcatgagcggcaggactatgatgcgaagaatcaagaactacaggatgagaaacagcgcattgctgagttccaagaacaagttagaaaccttgaggtatgtcagatttaattaccttctccatccactgatcgacccattactttcaatttcagtcccctctatatttcttggaattctttatttcattgagggattccgtggtagaattaagtagagtttctagatgactgctgcaagtcatagttttgtgacgttactgataatagcactgtcataaatttgtagttttcttaatattatgccatacccaaattattggcatggtagaatatgctgccacaccacatgggttagaaacggtgggatagcaaggattagggacactggttgctgttctaaaaataagttattggttggtatgttaagaaggttaaaaaaaaaatcctgcccgtattgtgaaaattagggaaacagataataaacattgtcattaagaaataataggctgccttttctcattgaatccgtggaaaatcctctcaaaagaatccatgggaaattaaagagaagctaacctttttttttcccttttttttttttgcagcttaataactacagattgagcatgctccttaggcaagctcagcagggcagctcaattccagggcgctttaatccggatgttttctaagaggaagtgcaaattccacctttcctttgcatacgagttcggaggcttaagatgttactatagcatgcaaatcttaagcttaaatttttgttgtggacgtgtaagtttatgttccgctgtagtatgggcagcggaatattatgttttataaatgatgggcaattcatggtcaatagataaattctaggacttattttatcgaatgacttatttttcttaccgatcacatttcaaccactaatagttcagtatccagcaacttttaggctgaacggttcccaactcacaccgaatttttttaatataataattaataaccccataattaaatatctggtaaatcaaagttgagatttttaataataggatggacgctgaagaatacagcgtccagatgtggacgctgtttgtaaaatcgtccagagctggacgctctggctaactacgtctagcatatgaccggtcgcctaggtcggtccggtggtcccagtacgaacagaagcaaaatgaaaaagagaaaaaaaaaagaaaaacgggaagaggaaccgttttggcgacgccactgcccggaaagtcctccacgcgcggaacagcgtcgcccatccatcagccaccgctgcgcgtccaatcgcatgaaggggccggccgtcgcagccctcgttctcggcagcgccgcccatccgccgccactgctctcctccacacgcgagggcgacgcccgcccgtccaccaacgccgcctgcctcatacgcttgtgggggttcgccggcactgccacttgcccacacatcccattcccaggtggtctcctccgccgtacacctccacgtgtagtgtaagtgccgtttgtttgcatgcatagtcagttctttccgtaatacatgtgtgattataccatcctatatatgtccatcttgttagtatgcttgattgttgtgataatgtggattaaagaaatacataattagttatattagatttgtcatgggagttgtttccaaaatactgaattgctcattacatttttacattcaccatatctttgcattggtaatataaattctcagcaattcacattgattacagcttataaaaaaatgctgatagcgtgatcagttcagtgatttattatggtgcctcatggccagcactaaatatctaccattgaagaaaatctgagtattttttcagtttgccgtacctgttgaaatctgtttttttttctcatctattcatgttaatctccttaagtaattgttctatgttttcatgcatacagcctagcggttccatgaatatatggcgtcatcaccatggaattctttaccacccactttaccaatcagctctagaaaatattggatttctttcaattgcaaagatgaaggctaggtagtggagttccattatcccaatagggtaatgagacaatttgaaataaaacaaatgattccactacctcatccacatggagaggccgatctccgtaggctgcgaaaagtcaagcacgtaggagggaaaacttgtgattggagaaatttaatgccaaatatatgttcaacaatatgatcaatggagatgaaagtgaatacgtactcgcgtgatgaatctctagtgtgtgctagctgccggcgccacagccggtcagccgcacaggcaaaggcgtggnnnnnnnnnnnnnnnnnnnnaaggcgtgtcgtcagctagccgcgtgcgattggtgacgcatactgcgccgcctttgctgcccgccggtggcgatgagggattgccgaggaggccaggatgcggtcgctagagaacggcagttatttcggcgctgattggttttaggtggatacgttcgggccggtttggcacggttcgactgcacccgtatggtggacgctgttcacaataacgttcagacctgcacgctctagagaatagcgtccacatctggacgctaacaaaaacaacgtccatcctactttgctaattacttgcacgcaattaccagatgtttaattacggggttattaattattatatataaaaaaaatcggcaactcacattccttcgcgcgcatggtttccaaactgccaaacagtgttgaaagttatctgaaaatttgacaaattgatcctattgaaaaacttatttcaaaactaaatcgtgtaaaaaaaaacttaaaaaaaatactccttgagcttagcaccatataccttggtgtggagtgattcaatgatttagcagaagaatcccacactgacttgggatcagcgccaataaaagatgtatcatttctatcagttacttctttcatttcattaagtaagtttttctagcattacccacatatatatatatatatatatatatatatatatatatatatatatatatatatatgtgttaatgaatcaaaagtcttacattatgaagtggagggagtagttacaaagatgtatgtggtaagaaggttactatgctataaccactaattaattaaataaagatagaaatatacgtgctactgctaaccactaataaataaagaggagaaaaaaaaactaatacttccgtttcaggttataagactttctagtattgtccatattcatatggatattagtgaatctaaatacggatatctaaatgaatgtggacaatgctagaaagtcttataacctgaaacggagggagtaattaattaaaagaagatagaaatataggtgctactgctaaccactaataaaataagaggagaaaaagaaaaggaaaaaaaaaaggcaaggaccaaaccaccagactactgctacaggacatcgtgatttcgtggttttagctccaggacaccgcacgaagtcacttttgggggaaaacactctcaaaacatagttatttgccagcggacaccgcgcccattaaaataataatttccggttgaatacgagagagaaatcacgtgaaatgtcaaaaataccttgggccgacatgtcagctctcttatctctatctgcgaggtgaggcggggcgcggcgccaccgacggccggagcggcgtctgcgaggcgaggcagggcgcagaggccggagccatgttttcattgctgctcccggcggcagccgacgcgacgtcgtcagcgctgctggacctcctcttgctgctctgccccatccttgacttccacgcctgcaccggctcgctgtcctcgtcaacgcctacccttatttcgcctacgctgaggaccccaccagcgtcgagctcgagtacacgctgcttgagctgacctacgccggcgttgccgcaccgtcctccgccctgcactaccccaacttgctcgtggcgcaggtggacgccgtgtaccatgccatcgcagcggccaacacagcagcggcgagggcggtggaactgcgtggcaaggtggggtgcggaggcccggcgcgggcgcggtggctgtgcgtgtggcgtggtgaggcgaggcggcgagcggaggcccagcgcgggtgcggcggccgtgtgggcggcgcggcggcggctcgcggtgacgccgtgcggggtccgtctggctggggctcacggcggccgtgcgggcggtgtagcaaggcacaaaagctgtgcgggcgcggtggtggcggcttgcggtgactccgtccagcagctcacgccagctcagctttggtgcccattggccgccgtaggagctcgcgcaccagtagcgccacgcttcagtgccgttgtcgaacctcaaggtgaccgcattgttgtcgtcggggtccagccacacactcgagctccacctcacacgcttcgctgccgagcttggcatcccgttcgagttcaccgccctcgtgttcgaccccctcagcagcgtgtccccgcccttcggactctcggccgcgcccgacgaagcggtggccgtccatctcacgactggctcgatccatgaccttctcaccggcgcccgcacacctccttgtcgtcaaggagctccgtcctgctattgtgtaaggaggaagagagatagggagatagagagagaacagaagagagataggagagctgacatgtgtgtccaatggtatagttgacatttcacgtgatttctctctcctcttcaaatggaaattattattttaatgagcgcggtgtccactagcgaatatccaatatttgagagtgtcttccctaaaagtcacttcgtgcagtgtcctacactaaaactacgaagtcatgatgttctgtagcaaaatttgccttagttcatttactagtgctctactgcgctccatttgtttgttagaaaataaaatctctcagcaccaaagcatacggtgtttatacgttcgacctccgcgacaggaaggttagcattgagctcgagaaacttgcgggaatatatgtagtgcaaacctataccaacatgcaaacttggaaaccagattgttgaccattggaatgaagatggacggtccagattgagcgcctcacccctattgcacattttgcaaaaaaaaaaaaaaaaaaaaaacgcatgcctctcattgtcctttttctgttttggtccttggacttattgtatttcctctctatccatgcatgcattcactttttccatgttcaaaatgattttctcctaaattacttatccaatctacaatccgatcataccgttgtatttgttgcaattaaatctttacaacaagatgacacatgactatgttttagcaaaagaaaaacgtatgtttcaatccgttaacactcgttgtttcgtacatgatagtgatatgtttcaacgtgtatattcactatgtttcacatttgaccatcatgcagattttgaagtcaatccggcactgtttcatcaagtagatcgaaaatgtttctatcttttaaaatacaatcaaatcacccatgaaacattttgctacaacgtatgtgtaacatactcgaatttaggattaaggaattcttgtcaaaactagttgaaaggaaagttctccaattttgtgaaccaaaaatttccattttaaaactaggtgaagttgatctaacttgtactgaagtaaaatttgagagcaaattaaaaccttttcatctttaacctataccaagcatgcatactcgcttacatcgtgttttgacttgagtccttgtgtgcatttggattttcgatttgcatttcataataggtgtcatgaataataactaagatctagataaacaactaaaccattagggcctagtgttagctagaggaagttaaaataggaaccatacaccttaaaatatatcaacatggctaatgtcaagcctcactaaactaatttggctactcatctgaaagcatgtcataaatatgtgttgatgtaaaaacacgaggcctgggagatctgcttaactccagtgcaggtccaaaacttgcctttgggtgtgtgagcatgccagttgatttgatcctgccatcaacaagaaacaaagacaaagaaaccacggttaaatccataaacgatagccaatcggctagttgccgatgatatatcatttatctttgggccgatgtcatatgtagatcgatcggcagtcatgaataagtaagaaagaactaaatttactcgattggttgcagatattaacgatatgtaatccctatgtccatatatacttaaatcaagtgattgggatagatcggtcgccatgccgagacagtataaatcacttagatcgaaatatatattaacagcaagactatatatgttcatagcacagccgatcagatagtctagcgtgaatcggctaatactccaataccactctatattaagatatcaaaacaagtaaaatataccaaacaaaagcctaatatacttaaatgtaacaagatcttaatataaagggcagatttaacatgtcaatcaagcatataagataaatgtagttaaatcaggtaagatcagctgaaaccccgatgctaccctaatcggcaaccaaaggcaggctagagattgagattctaatcacgactcataagatcaaactcaaccaatgcagcaataagtatgaaaagaaggacaatatctagacaatcaagccgctggaagtttcatagagtgatggatatcctatataatctaagtcaacatcgatgtctaacctaatcggctgccctctaccgacagatgttagccgattgtaggttagatagcgatattgccagagattatgtaagatatatgataactcgacgaattacataaacaagattagagtatcataaagatggaagcactagtcccgagaacgcaagctgtcataacaagttttacctcttgttgaagatcgaaaccgatgcagctcaacccgaaagcaagaactcgtcgaaataaaactaaagcaaaaagggtggcgatgcgccaagattgtattgaacgtatgtatccactgattacatggggttcggggtctatttatacccgaaaattacagactatgtccatatcggacacgactcttatctctaacaaactccacgataccataagtctttacggcagacttttgcccaaacatatctctaagaaaattacataaaatatcctaattaatagatacaattgccttctcaggactctatccatacgtggcaatcatcttgaagcatatcgactcaacccgatgtcgtacaccaagtcgcattgtcggaatcggctgtattacttaacccagtctgactcggacttagccgatcccaatcatagccgatccggactccagctgattcttactctgtttccgcgatgatcctcatctttgattccgctttgattcaatcttcttctccgatactaatattaccaaatttggtcgttaacacatgccccccatgtccggaatatttggtaatgtttcggatttgccatatatcgactccgagcaaaagtcgcactttgccatttcccgaccgttacttcagtgctttaaatactaaccattgtccccgagaaatctcacaccgtttcctccgttttcaccgctgaagcaaactccatctcctctctctccggcgatcccctcggtgcatgaagcgattcccaagcgattcctcctccggctagatctccgcccgtggcgatttcgtcctccgctagcccgtctaccgcgccgtcagccgagtatgctgaggtgagttctcatcggctagatccccttttctctcatcagattgatttcccctttcctcatcttgctttcttcttctcggttcttttggatccgcagcacctctccaacctagttgcaattcccatcttatcgcatgaaaatcattactttcttggtccaatcggcaaccttgatcctaccgagttcatcattggtgaaacaaataggattcctttcagattagccaacccagatctaggtcactggaaaaacaccttcaaatcttggccatctctcgagaaaactccacccgagaaaagttggattacatggtacaagtgcgtatcggctagcaagaaagttcactgggacgagatcggaatcagccaagtgcttgcccttaccatagccaattaagctaaagatgaacctctgatggctgccgctacttatttctggtccaataccattaatgcttttttgttcaaccaagggccgatgaccccaactctgatcgacatcaccatgatcactggattagatgtaacctcatcggctaaccctatgagtatgaacaccaagaaccaatttgattttaggaccaaaagcatagggggttggtcggggtatgtagcggcatatatgggcaaagggcctgtcacccctcgggagcatgtagctttcttgcttatgtggctagagaagttcctcttctgtggatctagctgtggtcctacaaccaattggcaatttgtagccgaagccctagaatcaaagaagcaatttcccttaggcaaaatcctcctcggctatctatatcatatgttaaataacgcatcagccaaaatagccgtcggcttagtggttggagcaggtggaccatggtggctgctacaatcttggctcaacctaatggtcatgaaagtagtcaatcggccatctgtgacagaagctgaattcccaaggttggagccgattgtagaagatgatggagaagaacgcactcatcgtagatgcaagtcatatggagaatatgcatccacaccagccgatgccagggcaaaattatcagctgaactgctcaaggattggttctgtagtttttatgaaggctttcagaaagatgcccgggtctggtttccttagaagactcagcagaccttgaactcccatcagacttcagatttgaagacattaatcatgaaagataccaaaaattcagggaagttttctcaactgcaatcagcccatgcatccttcctgtcggcattcatcagggaagaaacattcaagtctcttatgaattttatcacccgatgagctcagctagacaacttggagtgggccaactcccaatcggcttattcttcgccgataagatccaatgccgatgggaaatttcatcaaccttgatgatgcatcggctgctcaatctccaaggacctcctctaggcagtattgaaaatatcgagctggcaggattcaaaagcaaaaactttgacagatggtggggcgagtggaaactgcatctattccaccaatcggcttctatgtatatgatggatctctttcccgatgttatacctcaggtaaactctgatctcattaattctgtttgaacaattatcagccaattcataatttgactaaccctctcttctattttgcagacaacataatcttcccctccacatcaaagcaatagtggtagagatatcaaatatgccccaggtctaattcctaatggaggtgggccatctcctcctgtcatcggctatcatgcccccaagacttcgactcttctccaaggcttaatcagagaactagccgatgcaagcaagaagagaagaaccaggtcatcggctgcagacacgttagctctagccccaaagaagaaggccaaactcaagaagcctaaaccaaccgatgacctgcctgtcctagatccatatattgaacaagctctagatgaagaagatattgaagacgatgttgaccaatccgcagccgaagtgagcgatacagaaagaacaccatcggcttcacccaagcagacccctccaactccttctgccccaactcatttttcaagagtaagcagctctctttgatcctttttgtaatcacttcattttttcggccgattactcacagactttatagttgcagaagaagaaaattgctgtgaaaaagaaaccagcagcaacaattctcaaaccggctccaccagtaagttattttaattcttttattagttgattccagccgattttgtctaacacttgtctcttttacaacctcctccttcttctcctcctgtgcaacaatcatcaagtgaccgaactccatcggctgtggggagtcaccatgttgagaaagaaatacaaccagctgctcctgcaatcctggtaagttttgtcttataaaaattttgaatcgaccacataactcatgtcgagtctcaatttttagaattctttcttgcaggccttagccgatctattttccttcgacattaaagactatcttgatgaagaaacagaagaatataccaccagcaaatctttagttcccttgtccgatgatgtaaagaaaacccttgaagacatctctcatcggctagaagcatcatcactggacaacttggtggtaaactgtgggcctattaggactcggctacatgagatccatcctctaatcccagatgagctagccgatatccttactccagctatctatcttgagcagcatcaattcaagctagagaaagccaagctaagattagccgaacgtcgggagcgtaaagatatcgaagcaacaatccaagccaatcgtcagcttgtgcacgaagagaagtccaagcttgatcagctacctgagggcccgatcaaatccaacattgatcggcttgaggcttgcaagattgagctcttggtacaacttgaagaatgcaacgccgagctggacatagaacataaaaagctggctgatctcccaagatccattgaagaacagaaggcaagattaaaatcgactatcaagaatgttgccgatctcaccaagtctttaaaagtcattcctggaaccgacacccaagatgcccaagccattgaagaagtggaacaaatcaggcaaagggctatttcggctatccagcaatacttgtcttggtgactttccgtgtaatagaccttagaaatttttgtaatcggctaagatactatagtactttactgtcttagcaatcctttgtgccgattaatataacttctaaattcgcccaaaaatttacattttttgtatatatgtgcccccctaattttacaatgtcaaaagcattgataaaattattaaaacaactaagggcgatatatcggccatagtacatcggcaaaccacaaccgatttcaatatgaaaaacaactaagggcgatataacaatatcggccattgtacatcggcaaaccacaaccgatttcaatatgaaaaacaactaagggcgatataatcatatcggccatctcaaggcgatgtaaacacatcggctatcatgtatcggcaacatcagccgatcatgcattaacccaaacatttgggtaatatttcttcaaatacttgccatttagtgctcatccataaacttctccatctagtacttgcaacatgtaagctcccttagatacaactttgtggatttggaacggtccttcccaattcggcgaccacttgccgaatttgctatcccgagtcccaatcggcaaaatcaacttccatacaagctcaccctccgaaaaagtcttgggcactactttcttattataatgccgagcaactcattctttatccttggtaaccttcacaagggctcttaatctggattggaccaagtcctccctttcatcagccatgagattataatactcatcagctgtcaaattattttgcaattccgttctccttgagccgattcgaacctcccatggcaaaacagcttcatgtccataaacaagcttataaggagggacttggatcgatccatgacaagccatccgataagaccacaatgcttcggtcaatcgagtatgccactgccgaggataatcagaaatctttctcttaatcaatttgatcaagctcttgttagatgcctcggcctgcccattagcttgtgcataatatggtgaagaattcaacaatttgatacccatgctatcggcaaactgaacaaactcatcggacacgaaaattgaaccttgatcggttgtaatggtttgagggataccaaatcgatagattatatgttcttgaacaaattgtatagcatccaaagaatcaatattcttcaaaggaatcgcctctacccacttggtaaaataatcggtcgccaccaatataaacttatgtcctttactcgatggtggattaattatgccgatcatatcaattccccaacctctaaatggccatggtttaatgataggattcatagccgacgccggtgccctttgaatcgctccaaatttctgacaatcttgataccctttgtaatacctgaaacaatcttctagcattgtcggccaaaaataccctgcacgccaaagcaaccacttcatcttatgagccgattgatgggtaccacaaatcccttcatgaacttcgccaattgcaaccttaacctgattggcactcaaaaacttcagcaacaccccatcaatcatcctataatagagttcatcatccaataaagtgtacttcaacgctttataccttaatttccgagaagccgattgagacggattctgcagatattgatgcacatcatatctccaatcatcggctgttattacaacaacctcaaccttaacatctttgatcatcggctaataccccgatgccccttgggacaaatcattagctttaatgttttgttctcgagatacatgcttcaaagtaactagccgaaactccttcattaattctcggcacctttcattataaaccatcaatgtatcatttttgcactcatactctcctaccaattgactgattactagcaaagaatcccccatgatttcaatagcatcggcttcaacctccttgagtaactgcaaccctttgagaactgcctcatactcagcctgattattggttgcataaggtttgatagtataagcaaactcaaaactttccccccgaggggaaataataaccaagccgatgccacaaccatgagtgcacactgacccatcaaagaataaagtccatggtacaatctcaactgagccgattgaatcatcacgatgttctacaataaaatcggctatagcttgtcctttgaccgccttcggtgacttataccgaagatcaaactcagttaaggaaaatatccactttccaatccttcctttcaaaattggagccgataacatgtacttgacaacatcggccttgcatatgacagttgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaaaatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataagaagaggggaagaacgaccatagggtcgtgctccaaccctaggacgcgcccctaatgggcccaacttggatacacagcccattgggccaaaagaggtgacgcagcaccattgacagaaaatagtcgggagtaaaatgacaattgcggccgctcgagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcaacagtgcattcattggacaataggtaatgccttaaccttgtacatgaaaaatataagcacaagcacaacttctcaataggggaatatctagtttctgcatccaagagccaacgacttagataaaatacaactctttctttcccttcaagctcctgaatcaagactgagccgattgattgacttctcaccggccgacagatataaccgaaaaggtatccccttctgtggaggaatcaaaactggaggagagctaagatattccttaatattgtccaatgctttctgttgctctacccccccaagtaaactgctgatcggctttcaatcttagcaatggtgtaaaaggctctaaccggctagacaaattagaaataaacctcctaacaaaatttatcttgccgatcaactcttgcaattctgtcttgttctccggaggttgaatcttcttaatcgcattaacactcctttgaatcacatcgatccccctctcatgaacaagaaatcccaaaaactagccagccgatacgccaaaagcacattttgtcgggttcatctttaggccatatttcctggtactctcaaaaaccttcctcaaatcggctatgcggttctggtatttgcatagtatggggatcgtcggtgctaggatatacacgagactgaggtaaaagagacggagacgaggatttttatacaggttcgggcccctgaattgtcaggtaatagccctacatcctgttggccgaagccggtcgttgctctttattcaccataatcacacaagtacaatatatgggtagcctatctaactgttgtcgacatggcgttctgaaggtctgactcgtagtcgacaacagggtagtcttccttctcgaatccgtgcccgacgagatcagtgatagcgctttcgtctctcctgatagtatccggagacactgtaggggactagccgggcctatccctgaagtcgatatccggcgtcttatcttggcatatgttggcttgtatgtcatggcttctgttgttccgtatattgtggtgggtgtcgactgtctggtctcctcctaggggaccttgtatttatacccataagtgtccccttgtccaagtagaacta

SEQ ID NO: 46169 - DNA, 9633 bp, Oryza sativa
ccaggacacctaaaagttgtcttatggatatcttcttcggccataaagatttgattataacctgcattaccgtccataaaactcaaaatcttgtgtcctgaggcagcatcaaccagctgatcggctactggcattgaatattcatcttttggggtagccttattcaagttttcggaaatcaatgcacaccttgacttagccatttttcttgataacttgaactatactagaaacccactcggcatatcggcaaggacgaataaaaccagcatcatataatcgtttaatctcagccttgacaggttcaagcatatcggctttgcatcttctcggaggtagttggtgtggtctaacccccggtttaataggtagccgatgttcaacaatcgatcggctgagtccaggcatttcataatactcccaagcgaagcaatctctgaattctttcaacagctctatcaactttgttctgaattccgaagataaattcttactaataaatgtcggccttggttgatcacctggacctatgtcaatttcttccaaatcatcggctgacatgaaaccctgtccttgtttgtcatcgagatcatctactgtgtccttagtgtagacatttgaacgctccacgacgccctcaaaataatagcttgggttctccatcttcaattggttgtatatcagaatcagacacttttagaaaatctccatcccaaacttttccagataaacaatcaagaccatccatctcccaaagagctaaatcggcactggcaacattgactgacctgtcggctggcacaatttcaatcttgtcgccttgccactaaatcaagcattgatgcatagttgaaggaatacaacaattggcgtggatccaatcccttccaagcaacaatgtagacccccgattttggaaatcggaaatcttctgtgtttatccgtaccaatccctggatcagtagttggtacacacatacatagttggatcacaacatatcacgaatgaatttaggctaaaagagttaaatatttacattagggccaggtaggccaacaactatcagagaacaacagtggaagacaaaataatataagggcccggttaacatgccacaggcagtcgactgtggaacgagacctagaacaagaccgcactccgatcatcttgttggatacgcaagcgtaccgacaagggcttctcttcaacactctcctaaaagatatatgaatagcaagggtgagtaccaaccgtactcagcaagccacccaacaacaatgcgtatgatagagggtatttcaaggaatgtcttcatgttcttttgcataaagctaattttacaattcttttcacaagcctaaaacctagcatagactgatcaaattttagtaccagtgttcactttaaacaacgacggttctgtccaccatccattgtgatcccaaggatagcttcccgccattgagtcgttatggttttctgaggacgtccacattcccgcctctcaggaagtggctccatcagcataaaaatcatcatgcaatatcccatcccacacaagttaaagaatttagagtctagccaagtctaatacatgtcctggtgctcaataaccgcgagcacggctattcgaatagatttggtttactcacactgcagtggatgtacactttaccccgcactccgcgattatccaacacatgagcctcgtcccaatacatgagacacgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcatgcttctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgactggggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcattcctaagcaattgtcatagttgactagggactcatacgtaaacatggttacaaagatttaagggtaaacaataatcaaggcatggcataatcacaagtaggatgttcatcattgcatgcaattttatttgcaaacaaaacaatttcgcaattgggatcaacatgttcaaggaatagtgatgacttgccttgctcaggataatccttattattgatataatcttgatcaaccttcacctcctcgaagttgcagacgttgcctcacgactaaccgatacacaaggtctataatacgcgagaaaaaccaatattcaaacaacaatcaaatatgcgcaacaaaatgtactattcgtgttttctaatggatcccaatcatgctaaggctaaagtttcttaatctttctattgtcatcgtggcctatttaggagttaaccaacatagcatttatgggatacatatatatttggctaatcggtggtttagtctatcaaatggctatggaaggattatggctatgtatgcatctatctaaataggacggttatatactagaggttcttttgttagatggatttaggatcaatcaaacaattacagtgaattatttgtattattattttattgatggaagctttactttaattatgaacatattttacttgccattataaattataaaagggctaataattatccatgctctatatgttaaattcgggaagtttataatattatagttacagattatctcttaatgaacaatccggagttacaattgaactatgaacatatgaggtcaagatttataattagtacttatctactattcatgtttgttatatactccccagtttaatatatgaaaaagataaattaattgtgtaactataatgggatgtacaatatatgtgtgcaacaacgtataaggttttggtcgcctactgtacatgagcttatttagaaagtgtactacccaatgctccaagtgattcctaaatatattgtagtttaattatacattagctagtttctatgagtgatattgtatatgtgatgcgacaagtttaagcattggttctattgggttactaataagtggtaatcaatttaggcatatatatgctattctatatggtattgcatcgattaatttacttagtgattcctccacatctagctctgttatgattctcctaaacaggttaaagattcatctatgtgtgtttagattttagttacataatcataaggctatacttgatttaaataacctataagccatggatttaattatatggccatcgaatattaaataagtactagtattttcctatacatccattaatttgaaggattgattataactaatttatttagttgctacagtgacaagacatgttaaagataattatgctactgtacaatatccatttttattcattggcacactatttaggttaactattatctaatcatttgatattaattaatttataattataagtatattttgttaaatagtgaattatatatcattggagggcttatgaatttagatgaatttaggttcaagtttcactcaaatccgagttaaaatgaataagttatgctagtgtaaagattcaaatttgaattaatccgagaaattgcgaaaagctgctgttcataaacgatttatttttaatccaagacatatccacagccttgtaccaactgacaagtgggaccccgggtttatttctttttcctaccgaattattttctaaagggaaataggaagagctaatgacaagtggggcccacatgtcatagactcgagaccataaaacttctataattagattctaattattttaaattttctaaacttccctaatctccctctaatttactttttatttccttttcctttttctccctttccctttttttttctttcctttctttttcttttctttctctccttttctcttcttttctttctctcctcccggctcctttctatctctctctctcggctctttgcttccccgggccgcgacggcagtgggcgcgaggtggagggggggggaagacggctcaccggcggcggcggtggcggcgacgacggcgacggcggcgcaaggcggcgacgcacggcgcggcggcttcgaaggtggcggcgcggcggcacgacaacggcagcgcggcggcgcgacgacggcggcgcgtggagaaggggaagagggagaagaggagggaatggagtggggtggagaaggggggattgggccggggtctttataggggagaggggaagaaagagaggggaaggagggggaagggtgaaacgacggcggcgcggcggcgcggggcgcgaggtggcgggctcgcggcgcgaggcgacgagacggcgcgcggcgcggcagcggcgatgggacgcgcgcggcgacgggacgtcgatggcgacggcgacagcggtagcgcgcggctcggggcgggatgcgatgggcggcgacacgacggcacggcgcgacagcgacgataggacggcgcggcgcggcgcggcgcgggcttgacggcgacggcggcgacgtgacggcgcgaggcgcgcgggcggagatgacgacggtgcggcgcggctcagggcgcaaggcggcgtggcacgtggcagcggcgcggggcgcgaggcagcgggcgcgcggcgcgaggcgacgggatggcgacggcgacggcgcggcagcggtggttcgcggcgcgaggcggcgatgggacgcacgcgcggcgcgagggggaacgcgacggtgacgacgcggccgtggcgatgagatggcgacggcggcgcggcggcaggcgacgatggcgacggtgcgcggcggctggcgacggagagagggggaaagaggaggagctgggttaggggaccccgtcgaacaccttaggtgcaatgaactgtgccgttttctaattaacccgattttagagtaatttccatataaatttgattccacaattcctaattttgcatatatgcattttactcaatatttgtgttatcttatctaatgaattcaccctagattaatattactcatattttatttatataatttatttgaatttttaattagggttaattcttattattgttatatatttttcaaagttttcctatttttcttcttttagggttttggttgatttataaattgagaaaagttgcaaattaaatttgtatttactcccaaacatttaggtgaccgtattaagtgttcaaatgtgaatttgcccaaaatttaatattgtccaatatttaaggtttattaaagattctataattttctaatgagaccgttattaacacaatagcacattagctcaatttatctatatgttagtttattttatatggaggggtttaatatatcaaatttcaatccctaaatgcaagtaggaacttggtgcaaaatcgatgtacatatcgaattaaatactcccgtaaatctattatatatacagagaactcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaattatatctattgcttaaatgtagttcttttctttactttcttggtgatcatttacggtttggcaagcaatagcaatcataacaaccagcatgatgcaaaagttttgaaaagttcgaaattttcgtgattttcattgtcttgaattttcaggatgttacaaacaagctgtaagaacccttcccatcgatgacaaagaacgttgtagggatggttttgttgccgactgtcagctccacattcaaaactcctttggtctttgatggattgccaccaaaatccttaagtaccatatttgtcttgatgagatcctcagtatttctgcccaactttctgaacgtagcataaggcatcaaatttactatagccccaccatcgaccatcatcttggacatcggcttcccattgacataaccatttatatacaacggtttgagatgccaattctctgtaccctctggcttctcgaagactgcttgctctggtgacaaaatcaatttagccgattcctcttcaacctcatcgacatcggcttgcttgatcccaaactctgcaggcaacgtaaaaaccatgttaaccgatgcggttacaatacttttccctttggccaatctctttgcttcatcggttgcgccctcatcggctacaggagcttgtttcttaacgcgccactcctgctttggctttgttttctttagccgatgattgatttcttgttcgacctcctgaaaacgctccctgttcctcaatctttgaacccttcttttctgattctttgtaaatataccagaaggacaccattgagtcttcctatcttcattgtcttcttggttacaaccttggttcaccgggcccaacctttgatgaacaggaactcttgcttgccctagccgattgcctctgttatacgatcggcttgaactttctgcaacattgctgcacccaggacagtcttcaatagacagcagcctcataccctcattccaacaaaatctaaagaactcacaaccccaatgaggatcaaagccatcatcatcttcttcgtaacgcttttcctgctgcctgtcatatttcttctgatacttattgataatctaagctgaattcacctgaaaaccttttgcacgtcctccattggctgttcggccagctgtatgcaccgtattgacaggaaaaggattaccatcaaccttcatcggcctcttagaatcatcaaacttgattttgcccccatcaatagctgcttggatctgctgcctgaagattttgcaatcattagtagtatgagacctagaattatgccacttgcaatacctcttcttgcccaattcttcagccgatggaattgtatgaccagcaggaagttgaatctgcttctctcagagtagtaaatccaaaatcttgtcagccttggtaatatcaaagtcatacctctcctcttttccagaattcttcacccattggcacggtataacctttttgcttcttacccattcggccgccgctatttcggagtcatcatcgtcatcatcatccgatccatatatgtaaggacaaacatgattaacctttctagagttcttcctagcctttgcaaacctctgttcatgcagggttactttctacgtaagatgcgacaagctatcaaactcttcagatgagaatttctccctgatcggagcaatcataccctgaaaagccaaatcgctaactgagcatcagtcaaactcaagctatagcacttattcctcatctctctgaatctctgaatatactcatgcacaggctcatcatgtctttgcttgattgttgttaaatcagacaatttcatctcatgtaccccactgtagaaagagctgtgaaaatgcttctccaaatcggcccaactgttaatcgacccatatggcaaagaagaaaaccaagtgaaagctgatccagacaaagacaaccggaacaacctaaccctcgaggcatccacagccgatgcttcaccacactaagctaaaaatcggctaatgtgttcataagttgatgtgctatcctgtcctgagaatttggaaaagtctggaactttaaaccgattaggtagaggaactctctcaaaccattcagggtaaggctgtcggtacaaatttccagcgtcttttggcctaagcccaaactgctccttcataacatctgcaatcatatcggcccatggtcgttgctgaggtgctccttgaggttgctgaggcatgggctcgaattgattgtattgaggaacaaactaaggttgagccaatcctccctgttggtattgaacttgcggtgatggaggctgatactgataattcaaattgcccccctggtaattctgaaaatccggctaaatattgcacaccaaatgcttgggaacaacttgaggtatcactgtttgatatggttgcacattatgaactaagtgctctggaaccacttgattcgcagcatgctgtccaggctgattaccaggcgttgcaaacccagccgatgcattcatcaggccttgctgctgaatcggctgaatgacctgttgccttaatggcgtctgctgaatcggttgcaaaacctgccgttttggtggcgtttgctgaactggttgcacaaactgttggattaggtttgtttgttgaatcggctgcacaacctgctgccttggtggtgtttgttaagtcggctgctgctgggctggatcaacagtatgttgaggaggtaagaacatagatgcaacctattcttgtgttagccgattcacattctgtccactatgttgtggttgttctctcaccagcaaccggggattaactaattggcctggagccaatggtggtgcagcaagtgtaggaaccaatacttgtgccgtcggttgagccgatggtgcattaagagagattgactggacaactggttgattatcagtgattaatggccgataatttgggaacattcctcctggtagataaactggtcctgtagcttgatactcggccattgaaccatcaaccattgttttcacgatgtttgacaaagtattgactaatattccagactgattgatcaaagcatggtgcacggcatagtcaacctgatgttggaagttgttaaactgtaactgtgccgtattgccatcttgattagggccttcaccttgaactccgtgagcaccatcaccttgaacaccctgtactccttgagagctatcaccctgatttccttgagaaccatctgcagcacctttattacttggttgagccgaaccatctggagcttgtttcccttctccatccttagaagaaccggtcccaggaacatcagcaactaccttcacgatatacttctgcaccactgtccccttgcgggtctgcatgaatgagtttaagaactggttccgtgcttgctgcatcattgcgtcaaaatctttttgttgatcaggtgtcaacttgtctggagtgatggtcacgatgttgccttcattaacctcagataagctcagctgctggatttttttctttaacagaacctggactagccaaggacggcgatggcggcagtttctcggtcatggggaaaactgctgttgacttctaat

SEQ ID NO: 46170 - DNA, 7656 bp, Oryza sativa
cttctaatcggtcccaccgggcatgccaaaagcatgttgatgaaaaacacgaggcctggcagatctgcttaactccagtgcaggtcgaaaactcgccttcgggtatgctagcgtgccagttgatttgatcctgcaatcaacaaggaaaaaagacaaagaaactgcagttaaacctataaacgatagccgatcggctaagtgccgatgacatatcatttatcttggagccgatgtcatatatgtatcgatcggcagtcataaataattatgaaggaactaaatctactcgatcggctgtagatattaacaatatatactcctcatatcgatatatacttaaatcaagtgattggaatagatcggtcgtcatgccgagacagtataaatcacttagatcgaaatatatattaataatgggactatatatgttcatagcatagccgatcaaatagatctagcatgtaccggctaatactccgataccactctatactaagatattaaagcaagtagaatatactaaacaaaggcctaatatatgtaaatgcaacaagatcttagcatagagggcagatctaacatatcaacgaagcatatagaataaatgtagttaaatcaggtaagatcggctgaaaccccgatactaccctaatcggcaaccagaaggcaggctagagactgatattctaagcacgacttaatagatcaaactcaactgatgcagcattaagtatgaaaagaagaccaatatctacacaatcaagccgctggaagtttcatagagtggtggatatcctatataatataaatcaacatcgatgtctaacctaatcggctgccctctaccgacagatgttagccgattgtaggttagatagcgatattgccagagattatgtaagatatatcataactcgacgaattacataaacaagattagagtatcataaagatggaagcactaatcccaagaacgcaagccgtcataacaagttttacctcttgttgaagatcgaaaccgatgcagctcaacccgaaagcaagaactcgtcgaaataaaactaaagcaaaaagggtggcgatgcgccgagattgtattgaacgtgtgtatccactgattacatggggttcggggcctatttatacccgaaaattacagactatgtccatctcggacacgactcttatctctaacaaactctaagataccataagtctttacggcagacttttgcccaaacatatctctaagaaaattacataaaatatcctaattaatagatacaattgccttctcaggactctatccatacgtggcaatcatcttgaagcatatcgactcaacccgatgtcgtacaccaagtcgcattgtcggaatcggctgtatcacttaacccagtctgactcggacttagccgatcccaatcatagcagatccggactccagccgattcttactctatttccgcgatgatcctcatctttgattccgcttcgattcaatctttttctccgatactaatattaccaaatttggtcgttaatagtgccgtgcctctctactgccgccgcccagccatacggcaaccaccacgtgcacgcgccgccgtcgccatccaatcagagaatgaagtcggcgccgtcttttcttctttcacgtcagcgtcgccgtagccgagtcgatgaccgcctctacaaccgccttcggcaactgacctccgcgacctataaatagacgatgaggtcatcccttttcccctccacaccatccgagctcttcgagctctgtctttctctctctcttcctcaagactggctgccgccgccatcggccgatctctctcaccagagcaccactaaccaaatcctctcaccaccaaccttgccttactctggcgaacccatttttccacttttccccttctctttcgtcccatatcaagccccaccggagctctctctctcctgcctgttcacggcttgtgctcgtcgttccggccattcccttaaccccctctgccggccacttccttccctaggtgtgctgtagccgggaactccaccagccgccagcgtcgccgccttccgactaccggagccccgacgcccctctcctcctcctctcttttcgactgaagagaagaaggaagagacgggaagaagaagaagagaaagaaaaagaaaaagaaaagcctggcaggtgggtcccctgcacagtaactttccttattttccctatttaattcaaatcctattctttagaagcccatcttatataccgaattcaaggtaaaaaatcaagcatatgattgggccacgtggctccctaagattttagggtttgctcctttgaaaattagccacgtgtcccgtgagattcagctagagcgtcgattgtgcaatgtctcatctcttctattaatctaaagctagccattcttctagcgttttattggtccatgtggcatgtttcattcgtccagcctctcgattattccggacactggaccgtgaaaatgaaaaagaaaaagaaaagaaaagccattggttcattcactggctgtcatgggctgtacagcccagtcacgcatgactgcactaggcctggtcatctagcgttgttgctacagcatttgcacattgcactttaccttctcgggctaattaattagtaataacacaaacatgaccaaacaaaaataggaaaaaggaaggtagaaaaaagtataaataattttgtaaaaaaaatcttcaaaacataatatattgatatcatgtatttatataaaataaataataatcgggaaaaactaaatatcaaatataaagtgaaagagattggatgagaatttgttcaaatataaactaagaaccgtttcttcaaatacgcactttatcattgatactatatgtacgattttttggttaatgaaatcacaacaatttttaggaaacataactttaaatttttctaatagagtgtaacatacccaaaattttaggacttaaaaatttgttgtcaaaatagttagaggttaacttctccaattttgagagccaaaaatttccgttttaatttaggtgatgaccaacttaaaccattgcatgattaaaatttgagaacaaaacaaaaccttttcattcccagcattagactagaaatgtcatcaagcatttgagcatacatgtgcataatgcatgcctaggcttgaatccattgtgcatttggttttggtatcgcttttcataataggtctcatgagcataaattaaaagggttaaaactactaaacaaaactatagttaatattgggtgataacatgtggacttaatattaaattctaatatcattttctcagcccaaaagaagtttaatgtaaaccctataataatattagattcaattatgaagtaggaacacatattcaaagaaaggttattctaattctttagaataatctatgcaagataaaatcatggaaaaatttatgtaaactatgtttagctcaagcaattcactataatattggtacaggttaatagctaagtttaataccacaaattaatcagtcaaatcagacaactaaaagaaatcaaattaaactttaatcggctaaagccatacttcatccaaaagtacatttaactgcacataagtgaatatagaaaataatttattcaaatactagattatttatcatgcctaaatgtaatttttctagaattttcctcctctgtttaagcctcctaaaaattcaatctagctttctaatagcccatctttgtttaatttctgtgagcaatctacccattatttttgagtgcaaccaaagaaaatgaaatctaggtgtaatcatttacctccagtaaaatcaacactaattaatttggtccacacattaaattatggagttacaaagtcagaggagaaaataattccgaaaattaatctaaaaatcaagtttacccagtcttctacccatatctctctccctagcctagtttccatcgagttggccccacttgtcagtgccttaggctagcttcagccctgtccatcacttcctccactgctccagccgagagagggagagattgagcgagccgacgcgtggccacaacgtgtcgtcgatctcggtttcccttttctcgctctctactcctcccagatgcgtcgccattctccattcaacactcagagccgaagaaaccgagggaggaggttctctgcctctccatcgctccaaaccttgccgccagccgtggagacgacgaccatcgccatctccgtttgagtcaaggtcacctccatctctttcacgttcccatctctccacacaatgccgagcattttgctcttttgacctaaacccctctcgtgcagtgcatcgccgggaacgcaagccacgccgacaacgccctggagcacgcaccggagtgccgccgcttcaaccatcatcgtcgtccggccattctcgaccacctcggagcaagctgctgcgccatcgtcatcgcctcaacctcctcttcaatacgcctcaagaaccccagccggagatgtgaaggactcggagaacgcatcttttcttcactaccgccgatctagaatcgcctccgccgtcatcattgattaccgctgcctcggtgagccattgttcgattcctcacgcatacaccatctccttgacctcacaaacctcgtgcatgcttgcttgtagcagctcatcgtcccgttcgagccgtcgtcgttcacccgaggaggaacgccgtcgccgagccgttccacaagtcaccgctgccgccaagacctcgacaaccctagctcgacccacggtgagcatcctgaaggctagaagaccacatgcatgcatccttttttgttcggaatcgacttccatccacacatgcgctttcaccccaagaaccaccgccgctcacactcgccatcggcgctactccaatgtcccctaaccaagaaaactagaggaatggaatcgcaagaacatgctcttcattttatcttttaaccccaactccaaccgagccaccaatcgccgccggtgaaccctggatcgagctcagccatggctgctctgcctctgtgcgtgtgaaaaaggtgtcagggacttcattttgagaatttaaataactataaggttcattacgtaatgttcccaatcaatgacatatggacctaggactgcgggttgatttcctgaaatcctaggggcctttttgcatattggcctgatactgcctgatgaaccccatgagtttaaaatttgaaaaatgtaaaaagataatactaaaagctttatattttcaacaggaaagcatgtaaacttataaaatccataacaaattgaaaacaactcattttagagtaaatcaaatttctgtgaactcaccaaatcatgaactttagagttattgcataaaactagacattcactgtacaaactttgtctctaaaattggtttaagataaatcatacataaaacatgtacaaacttataaaatacatagaaaattcatctcaactcattttgaaacaaactcaaaaactgcagattcatcatcatgcactctctgattaggtgaaataaaagtaattacttactttgcatcaaatgcctctaaaactattatctctataattattagttttagataagctaaactttagaaattcatgtagaacccaatttagcttcaatttgaataaacttaagttctgtaggatcaccaaaacacgtatttccatgttatgaaataagattatatacttactgtgtagtaaaagtctctaaatattcatataaggatttactaacatagagcaacctttaatttgtaaaacttgtagaaaattcatttttagtccaaatgaaatgaacaaagtttccatagaaccagcaaatagttagcttcaacatagtaaaataaaatattgcaccttttgaacatattatagctctaatctttaaatagataacctaggagttaatcacctagtaatggttaagcaaaatatatgtgtgaggtagttaaaaaaaatgcattctagctatgaataaaccaaaataaaacttgttagaccagagaggccatagttccatccctatccactaaaacttagaagaacttagctcatataacaatttctaggttaatataatatattgctagtttagtttagagcatctctagtttataaaatatgaactatagtagtaaagaccataaacatgtgaactaaaaatgttttagttaactaaattattccttttattcaacttaaataggaagtagcatgttctgaacctataactcaaaagtcatgaacatataaaacactatatgcctaaaacacgttgtaacttgtaaaatctataagaaaatcattataactccaaaaattgtgaaaccaaatgcattagtcttagaaaacacacgtctacacccctgtgaagtctaatctagtaaaaatcactttacaaaagtatttcataacactacctaagactatactactataaaccgataagacttctaaaattcataactccctaatggaataagataaaataaaaattctttcacctaaattcattttagaccagtacctaatcactgtgcataaatcatgcattttagggcattttggatttttagctcttttggtgtttcattgcatatcgtgtcctttatctagataattgcataatcggtgaaggagtggattaggtgctaacatttctctgatcaaggcaagttttctcctcccatcctttgaacacattgaatcccatgatttgaggaatgaaaatgtttgtttgcaaagctgcatgtgaacttagattatatcggtatttaaaaatgggttaaggtagttacgacctatttgctgcataccccaccttgaataattgatcgtcttgctgtttgaacccctagaaatggttagagtacactctttgtgctcaaatgggtttatatatgctctatttgcaactacttgcttagccatgcttagaactatgcaaatgctcattccatctataattaaaatatgattttgatacatgaacctttgctggaataaaatgaatatgatgggtatttgtgaactaaaatgtgtaaaatgtgattttatacttgggcggcaagtggtgtgcatatggtgttagttgcataccgatagggggagtgtttgcccaagtccataaggaccaaacttgtgtcacccatttaaagttattcgtacatccacatgtgctagtatgggatggcctaagctgagtaatctatttaggactagccttgcattctggtaggccggtgtatatgagttcgtataattaagaggagcttcctatttaccccgacgtggtagtttaggtgactaagcgtgtccaatacaacggtattgtgccacgtggtgggttcccgtcgtgttcgccatcacggcgttaagtttaaggcatgggcccaccacttaacggttctaggtatattccaagtatacctaggatggaggaacacgtatcgtgctggtgcaaggctaggctctaagtagtgtaaaggcttcgttatgacctctagatcacattcaacatgaagagtgtggtggagtcttgcaaactcaaaacaa

SEQ ID NO: 46171 - DNA, 1745 bp, Oryza sativa
gctgttgatataaccttttgtttgcgggtttagacttagtctttgagtgatgcgggtcccgattgcttcttctaggatgagaacttaatggggtaaacccctagtcggtgtgcttgtgattgggtaatcaagcttccgttgttctctaataagtctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgctgccttcgagtggtttgacgggcacatctcaggctgaagttgactggcaggctaagggctcagcaatgtctctaatattcctctctcgaggcgtcggatgtttcattatgcttgtttgatgacttgaattattcacttcatctcccaaatataatggaagatccggagagcctacgacatagagtctctagctatttgccaaattattgatcatcattaattacaatcttactttggtttttctcataattctaagacaaacataaaattaaattccattaatatgtccatttgaaagaattttttttcagagttaaacttactcatgtaataatatattactctgcatgtttaatattactggtcattctcacatttcaaattattatttttagatcgcggtcttctatcttcaccttttaaatgccatgtataactgttaatcaaagttaatattgcttttgaaaatgattataatgtagttaataagcatagcagtgtaatttgccacatctccttgtttgatgtgaaattttgctagagttaaaaataatataaaatgagaggtaggcaaattttctatatatattacagatgagccatattacaggctaaattaggtggcacgccaacaggcgtgcagatcttctagtatctcctaaatcgaagatccgattccgatgaaacttggacctaaattcatctaaattcaaaatctacattttgataccaaatttgctattttaatattttatttggatttcctgaagttatttaaatgtcatttgcttttcaaatatctccttttatttcaaaatatcctttagccactaaaaagccgtcggttggaactttacgccttccatggggacgttcgcgcggtctacagaccccaacgtcgaaccgttggttgtaaagcttggcataaaccaaacccaaggtcgaagtgcttctcctggcaccctacgcctcgctgcgtacaacggtcggagcttcactatgtcctcgacctccacaccacaccacacagttcactctcaagctctgtgtgattctagccgctccgccgccactcacggttgttggagtaacactttcgccccacttaacctgtataaacctccaatccctctagccgatatgctatctgtcgataccggctagagaaaataccaaacctagtcattatgctctatcatcgactagcacacaaccaaaccctggctaacaccttgctagttaaaacccaactgtcatccaaataccccacctaccaatgttgcctatccactatactcagccacctactctcctagaacctatatagagcctagccgatatgcttccctactccgctgtcggcataa

SEQ ID NO: 46172 - DNA, 18374 bp, Oryza sativa
cgcatggggactagagttcatggaacaggtaccactgatgttagtaactgaaaagctttgccatgacaaggctaatgtgtttggcacgtcatggattgtgggtaaagcgtacatctactgcagtatgaatatcctcaaaactattcgaatagccgtgctcacggttatcgggcattgggactcactatggcatcttggatagaaatctaattcgaaattttattaaatattgttgcatttaaaacattacaggttttctacttctgcattctctgctttctgcaagtaaacctagctttacacagatattatcatttcatacattcattgttgattaaatataatagcttgttgagtacgttgtactcacccttgcttcaatccccttttttagagtccattaggagtttgtgccaaagctgggagtttaatcatataagttagtttcatttcaacctaatcctcaagtctagattagatagatggtttaagtctatagcaaaacagcagagttaggtcattctaaagcttctgctgtaatagttagccacaatcttgtaaataccctattactttatgtaataatctctccttcaaagctatgtctaaatgtatgcaaagacgatccagattattgaacttgtatcaatctactgatccagggcttgatacagtctaaacatgtcggtttccgaatcattagttttgggatccgacaccttttggggtcacccaaaggtgaagtgctacagcggtattccgtgcgcttgcggaattatctgtgatcataagaaataccaacaacctcatgtaataatgcttgaaggcattgagttatgtcttgccttgcgccttaagatttctcgcggcttcagcgtagctatttgggtccacgtcagctccttggattcgatagtcgaacttgctgtacggtctaacgtacgaatacgaaaaagatagcaaataaagcctataagcaaattgctacaaagaaacgataaaaccaaggaataaataaaattggagcaaggagaggggaaaaaaggaatgggttcaaaataattttttgtttgaaaaacaaaagagaggttttggtatctcaaggctgagaatcaaacaaaaacaaagaaaggataaaatgggtaggcagggtttattcggtggatttggttttctagtcggtgctatagagtaaggcaacacgacggctagatatttggatttgttagccgatgctaagatgggcagcatagcggctaaatatttggctcgtctagtcgatgctacagttaagcagcacaatggctagagagttgggaagtttgtacgggtttgaaaagtgttactctacagtcatgagtgacagcagagcggttaggagcgcacatagctcaaggactagtgtgcggcggttgtggaggtcgggagagcagtgaaacttcgaccactttacgcgtcgaggcgtggggtgcaagaagtatcactttgaccttcggattaggttataccgggctttacaaccaacgatttgacgtcggggttcgagaccacgcgaacttcttcacaaaaggcgtaaagttcccacaacggccttttagtggctaaaggatggtaaaagaataattgaaaatttagagataaaaaatggtctttgaataaatcaaaggaatttaaatttaaagaaaggtttttaaattcaaaagtatttaaatgaatttcaaattcagaaattaaataaataaaaggtgttggcggatggcatgaggctcttcgaccagatctgccgaaacccgtggcgaaggctatggagcaagaacggcgtgaggcgaagagtcgcgcgagggccttgccaggccagggacgtctcgggcgaagggtgcaaggcgaagactatctgccgaaggaagacgacttcaccatgtcggcaagtttgcccccacaagggccgaggaagcctttctggcccatcaagcctaagggccggcgatcgctagacggcccatcaggggcccatgagaccctataacattatgtacccctgtaaatgtccctttcatatgggtaatcatgtaaattcccctgtacaacctagatcctagtagtaagagcctgcaacagggctataaatagcggccagttaacgggggatgtaacgggggatcctagggccatgtaacgggggatcccaagtgaaattcaaaatttagtacacttcattttcccaaccactgttgagtaaccacgtccttcgacgtatacagttgtcgtttcgacaacagctggcgccgaccgtggggactccgagcgaaaccactaagagcgaatgccaccgaagagggtcgtgaaggagaaggtcgtcaggcggaaggagagcgacgccggaccggacatggccgccgaggaaggagcagagccttcggcatccgtggccgaagatggagaaggacaagcgccatcacagccgccttcggcccccgcgccatcacaaccgtcttcggcccccgcaacctcagtgcaagtgccgaacacggccgacgtggcgaaggcggctgcgacggcaagggcactccagaccagggcggagaacctttcaacaaaccaactggtggtgcctcaagccgccccatcacagccggcggcgccgactgcgcccgccgttgtacaggcccaaatcagcctggaccccgaagcgcaagccgaagccgacatggaagccatgcggcagaacatgacacggctccaagacatgcttcgccaaatgcaagaacaacaacaagcatacgaggcgacaaggcggaccaaggccacgtcggctgcaatccttcagtattcggcaggctatgccccacctcaagtccggccgcaagtggtgacccagccttctccgccactagccgcacagccgccggtgtacttcgccgggcagcatcaaccacctggccaagcgacacaaacagtggcggaaggggcttcggctctgcaggcgcaactccaagctttccttcagcaactcaaccaaccccactacatttcaagtacaaccccatcggctcacccggtgggggatacaagtcaaggtgcgcctaattggttgccaccgattcagccaggctcgggaccttcgccatggagtcaaggacagcagttcgacttcggcaacactgctcaggtgccaaccgttcggcagcaagttccaaccccaggcttcggaacaaaccaagcaccaaaccaagctgccatgatgtagtcgcagccaatctttgacccatccatggcggcccagcaagtaccaccagttggagccgggcagtcgaatgccgcggcccaactccacgcacaagctgcgatttcgcccttcgccacaccgtacccgcagcaaggtgcggtaaacagggcgggaggcgaaaaggggctgccgctgagtgggggaatcaagactcgtccaatcccgccccagttcaagttcccacctgtcccgcgttactgacccgaaggagttcctctccatctacgagtcagcaatcgaagcggctcatggtgacgaaaataccaaggcgaaggtaatatatctcgctctagacggcatcgcccgttcttggtatttcaatttaccagccaatagcatttactcatgggagcaattgcgcgatgtttttgtccttaactttcgaggcacctataaggagccgaagacgcagcaacaccttcttggcattcgccaaaggccgggggagtcgataagggagtacatgcgtcgcttctcgcaagcccggtgccaagttcaagacataaccgaggcgtcggttataaacgccgcttcggccggtctgcttgagggcgaactaacaagaaaaatcaccaacaaggaaccgcagacgctcgagcacctacttcgcatcattgacgggttcgcaaggggcgaggaggattctaagcgacggtaagctatacaagctaagtacgataaagccttcgtcgccgctgctcaagctcaagcacaagttcaaattgccgatccacctcccctctttgttcgccagtctcagccggcgatccagggacagccgccaaggagaccgaaccgcatgagcggcccaagcacacgccgaagcccacccctcacggcaagataacaaaagtgcagatggatgatgccgaccccacaaagctcgtatcactggggggcgacatgggcgaagaagaagttgagagcatccaagaggtgctcaaaaagaacatcgatatcttcgcctggagccctaacgaggtggggggcgtcccggcggatctcatcatgcatcacttagcagtcaagccgaatattaagccaagaaagcaaaagttgcgcaagatgtctgccgatcgccaagaagcggcgaagaccgaagtacaaaaattactctgggcgggggttattcaagagattgaccaaccggagtggttggcgaatccagtgctggtgcggaagtcaaatggcaaatggcgcatgtgtgtcgatttcacagacctgaacaaggtatgtccgaaagacgatttccccttgccgcgaatcgaccagcttgtggattcaacagctggatgcgagctcatgagtttcctggatgcatattccggtcaccaccagatccacatgaacccgctcgacatccccaaaacatccttcatcactccattcggcacattttgtcacctcaggatgcctttcggcttaaggaacgcaggagcaaccttcgccaggctggtgtacaaggtccttggcaagcagctggggcgaaaagtggaagcttacgtcgacgacatcgtcgtaaaaagccgcaaggctttcgaccatgcgttcgacctgcaagagacgttcgacagcttgcgcgcggcaggcataaagcagaatccggagaagtgcgttttcagcgtccgcgtaggcaagttgttagatttccttgtttccgaaaggggcatcgaggcgaatcccgagaaaatcaatgccatccagcaaatgaagcctccgtcaagcgtacatgaagtacaaaagcttacaggccgaattgcagcactcagtcgattcctctcaaaggcggccgaaagaggtttgcccttcttcaagaccctccggggtgcgggaaagtttaattggacaccagagtgcaaagcagcattcgatgagctaaagcaatacttgcaaagcccgccagctttgataagcccatccccaggaagcgaactgctattatacttggtagcttcgccggtggcagtcagtgctgcactcgtccaagaaacagagtccggacagaaaccggtctacttcgtctccgaagcactgcaaggagcgaagacaaggtacattgaaatgaaaaagcttgcttacgctctagtaatggcttcgcgcaagcttaagcactacttccaggcccacaaagtcatagtcccatcacagtaccccttgggcgaaatactccgagggaaggaagtcactggccggctcagcaagtgggcggcagagctatccccgttcgacttgcattttgttgcacgctctgctatcaagtctcaagtgctagctgacttcgtagctgaatggacactagtacttgcccccgaccccgagcccaacgaccagttctgggtgatgtgctctgacggttcgtggtcgcacaagggggcaggcgttgcggcagtcctcttttcgccgaatggtgtgccgatttggtacgcagcgagattgcagttcgacacaaccaacaatgcagcagaatacgaagccgttctaactgactccaagttggtagtaggccatgttgacaaatccttcgaggcaaaagaagagggaatgaagaggtatctggaggctgttcggtccatggaaaaaagcttcaccggcataacggtcgaacacttgcctagagaccaaaacgtggaagcagacgccttggcgaaatccgctgcttgtggtggcccacattcgcctggcatctttttcgaagtcctacatgctccaagtgtgcccatggacagctcggaagtcatgacaatcgaccaagagaaactgggcgaagacctatatgactggcgaaccccatttgtgaaacaccttgaaactggttggcttctggtagacgaagcagaagcgaagcgtttgcaactcagagccacgaagtataggatggtctcgggtcagctttaccgctccggggtacttcaacccttacttcgttgcatctcttttgccgaaggcgaagaaatggcaaaggaaatacatcaggggctatgtggcgcgcaccaggctgcaagaagagtggcctccaaagtatttagacaaggagtttattggcccactgtgttgaaagtctgtgttgagcaaatcaagaagtgcgaaagttgccagcgtcatggccgaagccatgccgcgccccagtatgatctgcagcccattgcaccaatatggcccttcgccagatggggaccggacattattgggccattcccggtggcacgaaacgggtataaattcacaattgtagctgtggaatatttctctcgatggatcgaagtcgaacccccttggggcaatcacttcggcagcagtacagaagtttgtatggaaaaacattgtttgccgtttcggggtgccaaaagagttcattactgacaacggcaagcagtttgactccgacaagttcagagaaatgtgcgaagggcttaacctagaaatcaggttcgcgtcggtcgcgcacccacagtcaaatggggcggccgaacgtacaaatagcaagatcctagaagcactaaagaaaagacttgagggggcggcgaaaggcaaatggccagaagaattgttatcggttctttgggcccttcggacgacccccacaagaccaaccaagtttagcccatttatgcttctttatggcgatgaggcaatgaccccagcggagctaggggctaactcaccaagggttatgttctccgggggcaaagaggggcgcgaggtatcactcgaactcttggaaggtgtaagggtcgaagcgctcgagcacttgcacaagtacgccacaagcacttcggcaacttacaacaaaaaagtccgacccacggagctaatgcctggtcatctcgtcctaaggaaaaaggcgaacccagtagcggttggcaagcttgaatcaaagtgggaaggaccatatacatcatcaaacacaagtccaggatgggatcttttcgcctagcgacactcgaaggcgaggagttcgaccattcctggaacgccgcctccctcaagcgcttctacatctagaatgggtggcacccaaatcgccaacttgtaaaaatgtacatactgtcatgtaagcctttcggcactatgtaagcctttcggcaagaaaaaaaacgaaaaaagagaagagaaaaagaaaaaaaaaactggatgtagggctattatccaccatggaggcccgaaccagtataaaatctctgtgtcctccgccttctttttatttcttttcgtgtgattgataatttgtggaaaaaccccaaggcaaacgcctgattagtgaaaaaggccaggggggcgaaacgaatcggccgaagcattgctcgccgaacgttgaaaccgcaacagcttgtctcggaaaataaatagcctaacgacgttacgaccgatcagcataaaagcaaaagcgtttctctcgacacagaacgctacagatcgaaaacgaacgacgaaaagctgaaaagtcactacacctatttcgctactatatgcaaaggggctggcatgttccgacctaacaaaagcacaaagtgtgacgatgcgaaaaatagcgaaaaggaaataaagcacgttctttattagcttcgaaaaaataatcgaagaatacaaggtttacaacccgatacaattcattttacaagtaaattacattttcgccccagtaatcattatccctccctaaggaatggtcggacgaactaggttcgtcatcactactaatatcatacacaaccttaagaggagtagggggcgaaacacagactaaactgtaacgacgctgaaagatcgattcctggcgtttagtcttctgatggttttgccaaaagcgagccatatcctccaaacgtcttgaatgaacaagatcgtaatcttctaaggttcgcccggggtgcgcccgcagccaattggcaaccttgaaaactttatagctgcgaccgtttatttccatttcgcgataaacaggccgaaatggacatcgcaccttcggcaaacccttcaatgccacaaatttctcgttttgacttcgccagctcccagaagggggccgaatgcatgattttcggcaaaccccctggtagacagtgcagaaaaggcaaaacacatcttgcatggtaagaataggcgaaagaaggggaaggtatggcataatgcaaaatgagcgaaataataatatgccaaagactttgatcattaaaaagtggttaaaatttcatacagtccaagtatgcaaaaaagccttttttaaggtctagcggcagtttgccgaatatacaatggttcgccacatctagcgaacaccaaaagaaaactatgaaaatctaagagaagggcggagggcctcacacctctgggtgatcctgggcatcgcctccaccccctccggctgccgcgccctcctcttctcaaatgtccgccgcctccgctttcgccagctgctccaaaaggtgcgccttagcggcggagcggccgtccttctgccaaaattgttttcgccacgcacgaagtgcaggcgaaatgtcttgcgcactgatttcccaatcccccttcgcgtacttggggaactcggcgatgtgctcgcagccgaactgttgcaggaggcccatggtaaaggccgctgacacgcgtgcacagcaatcgccgtatgcggtggtggagtctgaaaccgaaccaccagcctgttgggtccattcggagaagtcgaaggctgaggcatcttcggaggggacaccccgcaccttcgcgcccatatcaataagggcaaggcgaagcatttggcacgctgtccgcgcggactcggtggttttcaccatctcctgcgaaaaccgccgcgactcctctgcagcgcttgcttcggccttgcgaacctcctaccgaagagcctccatcttcggctcggtgaggttataataatctatgagcatggcggtgtgggccttctctttctccagttcggcctttaagcgatcaactttggccctagcttccttccctttctctagttccgattggagccgcttgttttcgaccttcgcctccttaagggtgttggcaagggcctccatctccaaatttttgcggcctagttcgtcatccttggcccgaagacggcttttgaacccatcaagtcgagctcgcacgattcgctccgttgagcagtgagccacaaggatctgggcgcagaatacgagcggggaagagaacaagtgtcaattttaaaaacaagatagaggaagagtaaagataaaaagggggggaaaaacgtacccgaacagccaggctttttatagcagagcacccctcgtcgaactcattcagttcggtgaacaagctcggggcgctggcgggcagtacaagattgcttaccccctccacaaatggaaggaggtccactcgcgtctcgaagtcgccaggggcgaagcggggtaccgagagcgaatattccgaagcgaacgtctcagcgaccgctttctttcccttcgcctccatcagcggcgaggcaaccggctgatgcggaggactgccgaatactttcgccgcggccatcacaatcctttccgcagaagccgaagccccagcggcggtactaccgtccactccagcggcgccaagtggaggaatgggggcggccgaaagatccaggctgcgaccagtgggcgaagtcggagtcccgtcggaggactcgtcatcgctaaaaacgcgagcgacatcgacgagtcctttctttttagccacctttttgacaggacctccctttgccgccgcgcccgaagagaacgcaactagggccttcgccccttctaaatccttccgacgaaggggggagctgttcgactccaccccattttcgttgtgaccaggacttggggtaggagtgtacctgggggtgtcggcgcggtcttcgactgcctcacccgcggccttatcagccacagcctccacctcctcctcttcctctccttcctcctcgccgtcacgttctttggcatcatcctcgtcgtcagcgtcggagtcaaacgaagcaggaacccttcgcttcttgggggcaagcttcacttgtccacgcatccactttcgtgaaggccctgcctcgtcgacggccttttggggattcgcccggggaggcagttcgccattgtaaacccggttcgcccgcctagccgcttgacgcgttaacagctgactatactcgacgaccgaaacatcgccgatcatcctgcgggcttcggcttcggcctggtcgagggtcaacactgaaaaattagagcgtgaagctacgtcaaaagtcaaataaggcgaaataacaaagcacagtagtatatagcaaaagaacagtcttactgtttgcccccttagggagtatcaggttcggcaaaccgtcgacttcttcgccttgttcaaccgcgacttgccatgactgggagaggggaaaaatttgaagcatacaaaattcctccaccaagtcacggcagctaaggcgggagcaaaccttccgcagtagaacgaaccgcgcctccatggtgccgtccacagcgatcttgggtctccggttcggcgcaatcgccctacgccggcaccggagggctttcgctgatttagaaccaacctcgaaggggatggtgtggtagaaccacctcgccatccaatggcggtcccacttcgacatagcagcgttcaccggccagagatcggaccgctcggggcgaacgttgaagttcacgctcccgaacacggtttttttcgttccagccggggtgatcaccatcttcgagttcacggtggcgaaaaatatggcgccaaagagctcggcgttgggctcaaacccggaagtccgacacgcccagtcgaagatagcgatccgaacaagcgccgacgggctcagctgcggaagttccacctcaaagaggcgaaggatctccggcaacaacacgttgcagggaaaccgtagccctgcctcaaaaaatacggcgaacaccaccgtccggttgtcgacaggtttcggcaccacggttttccctggggcgaaagcctgcccctcaaccaacgctccggagctgaccaacttcgccagctcgacgtcgtccacaagagagacccccccgaaaggcggtgctgtcgtcatcgactcggccgggatctggccctttcgccgaagtagggtttggcttacgtggagccatggcgaacggtgcgtttgcggtggcgaaaaaagagattcgaagaaacgcctgaggggtcgaaagatgctgtgaaaggaagagacggagaaagagagcgcgcacggtaaaatggcaagtgtggcggtgaaaaggaaagagcaacgggaatatatagcccgcccaagcgaccgttcgcctacccaccagtaataaagcgccacgtgtcgcaagggtaggtgaaacggtaaattcccgtcgaccgagcggcacagtaaaaagcccaagaaaggaaggcccaatactgttccgttcggcctaggaaaaaagaatatatataaccatcaatcgcacgaggcgaagcgcggcaaaataataccagctgcacaagtaacaaacttcatttgcaggaataatgtaggtttcggcaggagcatcggtcgaaagggggcgccacataccataccacatggtttacacggtctcggccgaagctccaatctcacccttgcccgcgaggggcctgttggcgaatggcatgaggctcttcgaccagatctgccgaaacccgtggcgaaggctatggagcaagaacggcgtgaggcgaagagtcgcacgagagccttgccaggccaggggcgtctcgggcgaagggtgcaaggcgaagactatctgccgaaggaagacgacttcgccatgtcggcaagttcgcccccgcaagggccgaggaagcctttccggcccatcaagcctaagggccggcgatcgctagacggcccatcaggggcccatgagaccctataacattatgtacccctgtaaatgtccctttcataagggtaatcatgtaaattcccctgtacaacctagatcctagtagtaagagcctgcaacagggctataaataaccccctagggccatgtaacgggggatcccaagtgaaattcaaaatttagtacacttcattttcccaaccactgttgagtaaccacgtccttcgacgtatgcagttgtcgtttcgacaacaaaaggtatttaaataacttaataaaatttagttcaaaaaggttttaaagaatggaaataaatgaatcaaagaaaagtatttaagaaaatttaaataaatttttttaaaaaatagaaaatttggtgtcaaaatgaagagtttgaaattagatgaattttgatcaaaggttcactggaattggatttgtggttggaaagatatgagtccctaaagattgaaaataaaataaaaggaaaaagggttactttataaaagtggggcccactgtcaagtgctccttcaacctctttttctcgtcttcttcttcctctcttctccttccagccgggtacagaggagagggagggagaagggcgtcggtgctccggtggttgaacggcctcgacgatggcgtccaagcgtgttcccgagcatcacgcacccggggagggtagaggaaggcagaggtaaagaggaggatggccggaacggcggcgacaagagcacagctccgacaacaagaggaggtggctgtggtggttggtttcggagggggaaagagaggggaaactagaaaaatgagttcacctcaccaaggcaagcccgatggcgcaagtatttggccagtggaactccggtgagggagatcggccgacggtaggtggcggcttgacatggatggagagaggctctgtttgtgtggagggaatgggtggtctcgccggctatttatagacggcaaaggtcggtttgcagaggagagggagaagggaaacacgacgccgacaaagtggagcggaagaaagcggcgccggcctcgccttttgattggctggccacgtcggttctactcgatggctgacgtcggcagggtgacgtcacagctgacgttggtgtcacgccatcagatacacgtgcatgcaacaaagatgatgcagagaatgggcctcatcgagttcggcccagtcgccaagtgagagcaaatccgaaatacattggaaggatctagactaagtaagggatataaatagtgtctaggagactagagagagggatgacttgtaactggaaataaatctatcccaattcttgtaattggaaataaatctatcccaattctgaaatccttcctctgtctcagctctgtctcaaactctgtttctttctcttactttctctccaagttgctgttcttcctttcgtttgatcttgcagattgggatcgtaacattttggtatcagagctcgtctcatccgggagaaaccacggttcaagacgcgattgcagaagcaggttgatgcgatggagaacaaggcggtagacttcgagaagatgctcgctgggatccagaactccatcggagcgatggcggcaaagcaggacgagactcaagtcatcgttcgccgaatggatcaaaccatgtcaagttggaagccacaagttgatgctgttgtcaagggattgcaagtcgagatggaggagttgaaggctcaggtggggcagctggagttgcagcatcaaggcggaggcaattcgtcgaacaacttgggtgcgacacaagcttcgtcctcggcaatcaaggatgaagtggagcgtcaggcacctctacttcccacgttgccagaatttctcgctgctgcagcgttgggagaatttggcttggatggccgccgccctgcttcaaactaccgggggaaagcacatgggatggtcaccacccttgtgccacctccggtcaaaagtacgtttcgatcaactacccctgttcgtcatgctttggatttttcggatgttttggggagagatgatcatgggggtggagaggatcgtgggtttaatcatcggttgcccaaattggattttccacattttgatgggagcgatcctcagaactggaggatgcgctgtgagcactattttggagtttatggcacgcatcctagtttgtgggtgagagtggcgaccatttattttatggggagagctgcatcctggttgcgatcatcaaaggctcatttgcagtttgaggattgggagattttttgtggagctgtagacaaaatgtttgatcgggatcaacattcgttgctcatccgacaaactgaacagctcaagcagactgggtcggtagaggagtattatgagaagtttgatgatttgatgaactagttgttgacctatgatccatatattaatcagaagagtatagtgcataggtttatggagggattgagggtagacataagaaatgcagttttgttacatcgtcctttagacctggagactgctcttgctatcgcttgtttgcaggaggaattaatggaagcccagaagagtaaggagattcgaaaatttggtgattctagtgcaagaattaagggggcttatcctttgccgttaccacctggcaaaagaattggagatgcacccaggaatctgccacgagcaattcctgatattggcaaggctaactcgaccactgacaagatcagtgcactgaaatcttatcgaagggcacaaggactatgctacttatgtgcagaaaagtggtcacctactcataagtgttcagggattgtgcaattgcaagctgttcaggagttatttgcaatgttttcagccgatcaacctgagcaagaattaagtgaatctgatggagaaggatcacagacactgatggcaatttctctgcaagccattcagggtactgttgctggttagacaattcgataccaagggctaattcagggttttgaaatcttggtgttggttgattctggaagttcttgtagttttatcaactctaggattggaactgatcttaaaggaatacaacctttaagagttcctttacaagttcgagtggccaatgggagtatacttcaatgtgaatctgaattgccaaatgccaagtgggaagtgcaggggaacactttccatactactttcaaggtgttacctctcaataactatgatgtgatattgggaatggactggttggagcaacatagtccaatggatattgattggcaaaagaaaactttaagtttacaaggaaatggaggcctagtgcaattacttggggttagttcagatattgctcattgcacagaattgtcttgtgcacaactatatgacatgcatgatcgaggttcagtagaagggatggttcagttgtgggaaattcaggacgagtccatgcaaccaattcctgaacaaattcaattgattctgtctgactttgcagaagtttttgaggaaccccgaggattaccaccttctcaagattgtgatcataccattcctttagttcctggagctcaaccagttaatgtaaggccttatcgttatacaccaattcagaaagatgagattgaaaaacaagttaaggagatgttggacaaaggactgattaagcctagtgctagcccattttgttcacctgtgctcttggtcaaaaagaaggatggatcatggcgattttgtgtggattacagacatttgaatgctatcacagtaaagaataagtatccattacctgtgatttatgaattattggatgaattatgatgaggacatcaacaccatcgatacatccatgtccccccatgtacagcatgatggtcctattacccgcgctcgtgcacgtcaactaaattatcaggtgagttctttcttgagttcatattcctcgtctttataccccggagacgcgtgcactcgtgttttactcaggaacgatggagaggatccaaaaggaagaggattcgcgcggggtggattcggactgcagggcagcgccaacttctgacggctgccacgacttcatgcgaactccgatttgggtgtgcaagtacttcatggaaagcttatcaagtctactttcaaatggatccagccacatgtccatatctgttctggagcggccgcaattgtcattttactcccgactattttctgtcaatggtgctgcgtcacctcttttggcccaatgggctgtgtatccaagttgggcccattaggggcgcgtcctagggttggagcacgaccctatggttgttcttcccctcttcttatagctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatttttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatttaatcgagttatcccttacctctcatcgaaagatcaggccacaaaccctagcgggttcgcatcaggtggtatcagagcgtggttcatcggtgagagaatttacccttcccttcgtcattaatttttttttcctatagtccagaaaagaccaacaaaaaaaaatagtagattagttttcccgtgatcctatagaccattgtgcctttttactagtactgcttagttaaggcttgttgagttttcgattgcatcggttgtgttaatttgctggtcttagtgttaggcgatcagagtttcgagttcttgccaccatcgcacatcgccaccttcatcaattttgccgtcatcaccaccgtcaccaccgtcgcagtcacccaccaaatcactttctatttgtgtttgatctgttgccgatagcttttgtgagttgccttgtatcctgctgccactagaaaggaaatagaaccctgattcgagtgaccttccttaaaacagtcatatctttttcatacggactcgaaattaggcttataatatatccatggacatctacaaaaaaagttacatccgattctccccggctttgccgggttcggcaaatttaaaatcgccaaattcctcttgcaaaattctgtttttgtggcgagaagcttggggacctattcgcatagaactttgaaaataattctacaagcttcatactttgtccgtttgagataagattttctgtggttggttctagtgtgctcctggttgtgaaaaaaatatcaaaaaaaaaaaagttgtgcctctctcctcagcactagagagagcaagcaaaaaaaaaaacaaaaaaacaaaaagaggatccagcgagcacaccccaccattccccctttgtcaccaccttccaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaatgtggtttctagttttctcttgagcattgctttcagcccaccaacagctccaccacaaacccgactacagcttgacaggtcttgttgctacagcaccgatacacctcgttccacggttgctaacttgtgggttgctgtccccctcctgtgggcaaggtaagaactggtaagagcttgtgagacaagctgcgagtaaagtgagagtgagcgtcttgcaaaagctacatcccaatagttgtgtagggcttacattacatcctccattgttttgttgtccttcatttctaaaccatggcaggtccagaggataaagatgaggaggctgcatctcattccccacgcaccaaaggcatcatccaatactttacaaggcaagtgaagcagcacacagaaggacttgatacagatttgcaggtgacaaatgagaagattggacaattggagtccacgcagatctccaccaacactaagcttacagggctggagacagcggtcgcccgcat

SEQ ID NO: 46173 - DNA, 4640 bp, Oryza sativa
tgacactagccttgctgctcttgtgaggcattttgatgctctcaatgctggaggcaatggtgggggtaatgacgatgacattgacggagagtacgtcgaggataatttggaggatgaatatattgctgacactgaacaagatgatcgagatgctcgagatcgtcgacggctacacaacaatcgacgaggtatgggtggtcgccgccgacgcgaggtacgcaacaatgatgatgctttttctaaaattaaatttaagattcctccttttgatggaaaatatgatcctgatgcgtacctctcttgggagattgctgttgaccaaaaatttgcatgccatgagtttcctgagagcactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaataggttgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgatatcgtagactataaagattacactaatatgacccgattgtttcatcttgcttgtaaggctgaaagggaagtgcagggacgacgtgctagtgccaaggctaatttttctgcaggtaaaacttcatcatggcagacacgcaccactcctccggccggccgtactgcttctccatcttccacacccacaactagtcgagcagcacctcctccatctagtgacaagtcagcgacaaaggctgctcagccagcaccgagtgcttcttcaatggcatccacaggccgaatgagagatgttcagtgccaccgttgcaagggctttgggcatgtgcagcgtgactgccctagcaagcgagttttggtagtcaaaaacgatggtgagtactcctctgctagtgatttcgatgatgatacacttgctttgcttgcggctgaccatgcagataatgagccaccggaagagcacattggggctgcatttgcggatcactatgagagcctcattgtgcagcgtgtccttagcgcacaaatggagaaggcggagcaaaatcagcgacacacgttgttccaaacaaagtgtgtcgtcaaagagcgttgttgccgcatgatcattgatggaggtagctgcaaaaacttggctagcagcgagatggtggagaagcttgcacttagcaccaaaccgcacccacatccatactacatccaatggctgaacaacagtggtaaggcgaaggtaacaaaactggtgcacattaattttgcaattggaaattaccatgatgttgttgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaatccaaatgtgagagtgataaaaaagcccaatctgatggcaagaaacctgagacaatcaatttgaaacccaaatgcttacttgctactaaatctgatattaatgagttgattgcatcaccttcagttgcctatgctttggtatgcaaagatgctttgatttcacttcacgatatgcagcattctttgccccctgctgttgctaacattttgcaggagtactctgatgttttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagtagggtgatgaatggaaaacagcatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtgatgctagtgggattggattgggtggtgttttgctacaagaaggaaaacctgttgcatattttagtgaaaagttgagtgggcctgttctgaattattctacttatgataaggaattgtatgctcttgtgcgaactttagaaacatggcagcattatttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaacaaattcgtcatcaatgatgggtttgttttcagagctaacaagctatgcattccagctagctccgttcgcttgttgttgttgcaggaagcgcatggaggcggtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctaggaccaagagggggcgtgatagcatttttgtggttgtggatagattttctaaaatggcacatttcataccatgtcataaaactgatgatgcttctcatatcgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttgggctgttttgaagaaaaatatcaagatgtgggaagaatgcttgcctcaaattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctagagatttggtttggttgcatttgcgaaaagaacgatttcctgatttgagaaagtctaaattgatgcctagagctgatggaccatttaaagtgttagcaaagattaatgagaatgcatataagattgatttgcctgcagatttcggggttagtcccacatttaacgttgcagatttgaagccgtatttgggagaagaagatgagcttgagtcgaggacgactcaaatgcaagaaggggaggatgatgaggacatcaacaccatcgatacatccatgtccccccatgtacagcatgatggtcctattacccgcgctcgtgcacgtcaactaaattatcaggtgagttctttcttgagttcatattcctcgtctttataccccggagacgcgtgcactcgtgttttactcaggaacgat

SEQ ID NO: 46174 - DNA, 18879 bp, Oryza sativa
gatttgcgatctggatatcaccagatccgaatggctgttcaggatgagcacaaaacaaccttcaaaacacataatgggcattatgaatttcgggtgttaccatttggactgaccagtgcaccagctacatttcaaggagtgatgaattctgtattggcaaatctgttaaggcacagtgttttggtatttgttgatgatattttggtgtatagcaagactttaactgaacatgtcgagcatctcagacaagtgttacaaatcttgactgatcatcagcttaaggtcaagaggtctaaatgttcttttggacaaactcaactagcatatttggggcatattatcagtaagaatggagttgcaactgatgacagcaagattgcagcagttaaagattgcgattaagctcttcttatcatccacaatctgatggacaaacggaacgagtaaatcagtgtttggaaatgtttttacgctgttttactcatgcctgtcctaatcgttggcattagtggttagcacttgctcagtattgatacaatacatcatttcattaagcaatcaaaatgacaccatttgaggcattgtttggacataagccgaattactttgggttattgggagcttcttcagcaaattctccagcattgacagattagctcagtgaaagacattgtatggatactttgatttataatcatcttttgcgggctcaacaacgaatgaagtttcaagctgatcaaaatcgttcagagagagttttctctatgggggattgggtgtttatgaaacttcaaccatttgtgcaacaatctgtcatgacccgagctaacaggaagctttcattcaagttttatggacctttcaaagtactgcagtgtgtgggaacggtggcttatcgattagctctgcctatcacaagtttgattcaccctgtagtgcatgtctctcaattaaagaaagctttagcaccaactgaagaattgcagtcagagttgcctcatcttgatcctgaagctggtcatttggcaactccagtttgtgtttgtgctcgtcgtctgtgtcgtcgtggtgcgaagatgatcgagcaagtacaagtcgagtggtctggtttatcttcttcggcttgtacctgggaaaattttggtgaattgcattgccgttttccttcaacatcagcttggggacaagctgattttcaaggggggaagaatgtcatgccatcagatacatgtgcatgcaataaagatgatgcagagaatgggcctcatcgagttcggcccagtcgccaagtgagagcaaatccgaaatacattggaaggatctggactaagtaagggatataaatagtgtccaggagactagagagagggatgacttgtaattggaaatcaatctatcccaatactgaaatccttcctctgtctcagctccgtctcaaacgctatttctttctcttactttctctccaagttgctgttcttcctttcatttgatcttgaagattgggatcgtaacagttggtgacggatccttcaagtcgacggaaaaacgacggcggcggcgcaaagctgcgggcgacggcagcgcaaagccaaggcgacggtggcggcagcgtgcgcgtgtgccacgcgcgcccatagggaggaagaaggaggcggctcggccgtgggctggctgggccggctcggctctgatgggccgacagcccaaggaggagaaaagtgtggaggacggaaggaatgggccaaaaggaagggggttttggcccaaaagaggaggaacttgattattttgtgtagagggtttttaaatggaaatcaaaggagatgaaaatctaagggatgaatatttgtggaccttttgaattttggacaaggaattcaattaggatttctaggaaatggatcttaagaaatatgttggggggctttttagaagtttggaaaagaaatttaaataggatttctaggatatgaaacccaagggagtttgtttgtggactcttttgaattttgacaaagaatctaaatatggaatttttataataaaataggtttgaaatatttttaaaacaaaattaaagatatttattttgaaatataaattttaaaaggataaaaataaagatgctccaatttaaagaatttaataaggaccaaatataaaacttgacacaaaagatttatctactaactttggataaattttgggatgatagcaaaaatagatggaggtaaataactaggattttagcctccaaaatatgtggtatggattctcggtgaaatatttgtggctaaaggaagttggattttgaataaaagggattggaaataagtttcttagcacaagagaaatcattcaaatatttgtgataatattattcttgtgcgaagaatgtgatcaagtcataggaatcaaattggcggatggactaaaataggaacttgaccacaagatattttggatcaatctagaggaggtaatggttttttggagataggtctagctaggggtttgatccaaaataaattccaacaaaaggggagttatagtagtttagccccaaggataaaaatggttaatgggatataacagagagtcaggccaattgggaaaatattggctcaagctaaatagtaaactttggaatcttgaatggataatttggatgaatgagattccaaaggggaagtatttgttggaggatagaactagattttggaagtaataggtggatgggaaatcataggtatttttataagaataggattggaagtaggatggtaaattttgaaggataagtgttaactttaggggggggtagtattttatagactatggagatatttgggtatagatccaaagggaaagtattaactctagagaggttggagaattatatttcatgtactcgggagatagttgagtgggaaatgaaaggatatttatggttgttggaggtgttcgaggaaggattcaaaggaaatataatatagagccaaagttagagattaaagaaaataaatggaaaggttttatgaaatttgaaataaacaaaataaagaataaattaaggattttataaaatttaaaagagagcatttaaatttgcaaataaaacttagatccaaaataaaagagaaggttaaaagcaagattgctccaatggaagaatcgagaaaagtgcaataaaacttttcgcaaaaaatttttccctgaaaatttgagtatgttacatcacgtgtgttccacgctgactcagccgttacgttggacaaaaccgggatcaaaaccaccgaaggtcctaaagtgaccggttttgattagttaagagacgcaagatatctggttttatggtttgagaacgtttttttacctggctttatggttgagtgcgttttttttatctcgatgacaagtctaagtgaccttcaggtggtgtttgaatctcctgaagatgaagacgaagatgaatatgaagattaagtgtttcacgcaaaacgaggtggtaataacgtgcgattaattgagttttaattattataacttgaaaaacgaattaatctgatattttagaacaactttcacatagaaaaatttcatacgaaatacaccgtttagcagtttgaaaaacgtgttgttttaatccaaaaagtttatcccctaattttgaaacaaacagggcctcagtgtactttttcccatgcctggcagccttggcgtcgtccaccatcccggtgttcatcccgcggcccagtcacgaatccaaccgtcaccgtctcggtccggtctaagcccttgctgctccaccacgcttcttattccattctccttccgccgccgcccgctctctgttgcgccgcagttgggagcgaaacccttgtcttcctcccaacccatcttacccaaaccctaaaaaaccaaaaaaaaaatccgcaaaattacccccgaaaatcccaaaaaatatcgccggaaccctatccttcgatcggatccacctatccccctccccggtgatggcggcgcaggttcaggcggtgccggcggcggagggtggtggcgcgccgccgcaggccaacggggtcgtggctgcgggctctgctgccgccgctgcggcgaccttccaggcgacgtcgctgtacgtgggggacctcgacgtgagcgtgcaggacgcgcagctgttcgacgtcttcagccaggtcggatcggtggtatcggtgcgcgtttgccgggacgtcaataccaggctgtcgctgggttacgcctatgtcaacttcagcagtcccgccgatggtgagctctgttcttctccttcatatcaattatttcttgtgatgatttgttggtcatgggtgatgggtcgttagggttctggcagggaacaattcgaatcgcctcaactccattacttattgaaagtgtccaggccattttaatgggtaggatttgtgtgctaccaaatgccggaaactatttagtctgttttaacatgctgattgtattcattaactgaggtttgtaaggagtatataataatattggttttttttattacgttttgtatagctgtttgttgtctcatacatatctaattacatatatagtaagttgagtaaacgagttacctcatttcatgccaagaaaactttttgaggacagttgaattgtttttcttgctgatagggatttatgttctcttgattttaacgaaaatgtcctcacttgcaacaatataattcgagatgtctgttttagtgcacgatgtgggggatcgttgatgtgaaaggtccttccatagtattcgacataatcaagttacttttaattggttccaaaattttgtaagcatggcttgtcatttgcctctgaagttcttgtgagagtttgctcttctgtaactgttaagttagatatgtgttctgcttctgataatatatttcaatcacatgatgtacattaatttggcaaacaagttctgattgtttatcaaactagaattgcaacttgcttcttttcttactttaaaatctgttgcagctgcaagggcattggaaatgctgaacttcactcctattaacgggaagcctatcaggataatgtattctaaccgtgaccccagctcacgtaaaagtggagcagcaaacatatttattaaggtagcacattcatattatgtattcatttcatagatagccaacaaagaatatctcttttgacatcagtttatgttgttaacagaatcttgacaagtcaatagataacaaagctctctatgacacattttctgtatttgggaatattctttcgtgtaaagtcgcgacggaaatgtctggagagtcgaagggatatggttttgttcagtttgagctggaagaagctgcccagaatgctatcagtaagctcaatgggatgcttttgaatgacaaaaaggtgtatgtagggccttttgttcgtaaacaggagagggaaaatgtatcaggcaatcccaaatttaacaatgtgtatgtaaagaacctatcggaatcaacaactgaagataatttaaaggaaatttttggtaaatttggacccataactagtgtcgttgtaatgcgtgaaggtgatgggaaatctagatgctttggatttgttaactttgaaaatccagatgatgctgctcgagctgttgaagatttgaatggcaagaagtttgatgacaaggaatggtatgtttgtagagcacagaagaagtcagagagggagatggaattgaaagaaaaatttgagaagaacatcaaagaggcagcagataagaaccagggaactaacttgtatttgaaaaacttggatgatagcatcgatgacgatgagaaattaaaagaaatttttgctgattttggtactattacctcttgtaaggtttgtctcttatctccgctagtttgccgtaatagttaatacaatttattcacatactttggttgtttggtcagtttgctgctgctgattataaagtatgtggcaggtcatgagagatttgaatggtgttagtaaaggatctggctttgttgcatttaagtctgctgaagatgcttcacgagctgtgagttgtatttatatctctgggcatcatatttgaaaaccatatttcaggaaattcattaacatatttgttctgatgattgcagcttgtggctatgaatggtaagatgattggcagtaaacctctctatgtagcacttgcacaacgcaaggaagaaagaagggcaaggcttcaggtaacattgacggatgagatgtcctgtatacatattcctaaaatgttattctctgtttctaatatgttcattttacttttgcaaaacttgacgaacatgattttatttttgaactacaattagaacaataatgaattttcttcccaatgctattcaatgcaatagtgtttgataaaactatgctttttatatattgttttgtgaaagttctaatggtctggaaaataaacagtcatttctgataccagcggatccatacatggaccctgtttttaggtattcatgttgatgacttatttcaggcacagttctcacaaatgcgtcctatggtgatgcctccttcagttgctcctcgtatgcccatgtatccccctggtgtccctggtgtaggccaacagctgttttatggccagccacctccagcttttgttaaccctcaggtacatcagtacatgaactccatctatctaattaatgaattatgaatgttcatgcgatcatcaacatatactgttaaggaattttcgaatcagtatgttgctgttggattagaataactataattgttcaaataaacaaaagctgtaactttgatttgctaccaatgttttgatatagctttgcattgtaaattttgaaattccattctggattgaagctcataaactactcaaacttgccaaaataactatgcaaattccaacgttgagcttgttaccagctacttgtcattcattttggagcactattattatttttaacacttaccaacattttatttctgcgtgtagcttggttagttttcttgtctgttttgactaattatatacatttaaagtaaaaactatgatgatgccagattgttgtttaccaacttgctaagtgctaaccattacaactgatggaatactttgttgtgctctaaatctagtgtacgttcatgtttttcctttctgaattgattagtaaaactgttatgcactaccaattacattgttatgttttattctttcacgtgttatttctacatttacagtagcagtgagaagtgcagaaaaacataaaacaagatagaacctcgctattgattgtgcatgttagttttgctggacatttagtgaactaatttctcacttctagctcctttaaaaaatttcagtaccaagcatttattgaaggaaaaaacatacttacatgtgaaaaatggacttcacaaaattaaagtgagatttctgcgtgagtggccacttgtgacttgtgaggactgttttggaaacaaccatatcgcaaacgttgcttacgattatcattgacatgttttatgtgagaataatctaaccaagttgaacattcctgatgatatgaatgaactgatatcttaatgggttaattatgactgatgcctcaggagtattataattgttttgtcatctatataagtgaatgaatattctggatagtatgggcacctgtaactctagtttaggagagtatgtagcgtaaggtgccttgttttgtcatccttgtaaggtgcattgcttagccaaaagtttctcggtaactcggttatctttggtgctactggatgagattttgttgccctccttggcactgttacctttgctgtgaaaaagggcaaactgcccttggttctgttttggattctgtcgttcttgtgaatgttgtgtggtggatgtgttgatgcttgacgagatggtgaggtctagcctcgcctccttagagccgggttgaggccgaaggggagactagagataggttcaactttatttcttgattgattcgctaggaaatgccgtgctcccatatggccagccacccaacaaattctacaaacaagtatagctaataacttgcaaactaattgaatccatgaggggctgagtttcgcccataacatccccacacaacgattgacttgcatctagcctcatcccctcttattaagccttctacatcctggcttttaacattatttggaaaggaaaataaatctaaaattattttggtgtaccttgccagcctaaggtggggccctacctggaagccctcagtatccatgtgatatccaaagcttgaatgtcctgctggcctgagaaccctagaaaaccttggcaaagtaacaattcgtgaagagcctgcattcttgctattgaggcccaatctgcaagcccatgtgatgtaaagccatgagccatgtacatccgagttgtgagagatagcgaggggcccaacaatcagcccaaatcaggttcctcttgggagaataccctatcccactgctttatgccacgtacatagaatgctgcgctgccaccgtgcaagctgctacagtcgtgcactgttaagaacatgacaaatgacgcaacgcacctgcggcacgcaaggcactaacgctatgcactggttgagcccccaaactgagctcctgccagcgcagctcgcacatcaccatggggtcacgcaggtgcagccctcgccgtccacagaagcagcgcaccccgctgattgtgtggaggccaccccaatgagtcaactaattgtgctgcaacctcccatcacgctcgaggactccgctcgcttgccgtgctagctactcgcgaggatagtggtgcactttgtgcccgtggggacggaaccaatttgcatggagttggacgaggcgtgcatgtcaccgccaattgtggctcaagctcctcgagtcgtgccagttgttctcggtgattctgccagaaaattgtatgcctgagtcaccaagcgctgccttgtagccatatcgatgctgttgccaaggccaacaaagtggatgacagattgacggtcaccagggagctgcaccgcctccaaaagacgcattgctgctcgagggaaccgcttgaagatgtcttgctgccgtgtggtcgcaggagggaacagtgacggtgcgacacgatggtctcccgcggcgacggctgacttgattgcttcctggcgagtgctggcaaaggtgtagcagcaccactgcagctgcggacactgatgattgccaagggagtggctctgtggccagtgacatggcctccacctctggtagtgtggccgatggttgaggagagggtacagaaaatgagtctgttggggtggtggcagtggagaagttatcgttggacaccgccagcccgcatggagtgctgcacaaagtccctcaccttattgagcccatgatggtgttatgcatggcaatggatgagcgatgcagggcgtggaggctgttgatggcagccatggtggactctgggaaaggatcacttgaatctgatacgaaggtgctgtgtgggggatgtgtaggtggtcgaccaccccagagccgggttgaggctgaagggaaaactagagataggtttaactttgtttgttgatttattcctattttttttaaatctgcagggtgattttacctagcagaatttttgcaaaaagatgaaagaataaaatctataagactacctagcatgtcattgatatttgtagctttgtgcattgtagaaatcttccatgactgatttccattagaaactagggggaaaacaaagctgaacaatttaacctccaaaagaggatggatataacagtcagataaggctgtgatttggattgtttcttttaccaaatacatcaatatgtttattacatatgaaggtggggatggcaacagcctatggtaagcacctggtttaaaaaggttgtaaaactttgtcctcattattgtacaatcagtcttttatcaaatacatcaatatgatgcataatttgcagtttatgcactacaaatcagccttgctttacaatttacttgcacatgctataatcagtctcttttttgttgcctatctccccattgccttctcatttgtattaatttgtattatcgaaatgttactttctgtagcctggatttggcttccagcaacatctcattcctggtatgaggcctagtgttggaccaattccaaattttgtcatgcctatggtccagcaaggtcaacaaccacaacgtccagctggaaggcgtgcaggcactggtggaattcagcaaccaatgccaatgggccaccagcaagtaataatgctcagtttgtagtgacataatgaaactcatttgtttaactttgacaaggagtttgcctccttgtctaacccttgcatctcttgttttggcagatgcttccaaggggtagtcgtggtggttaccgttatgcttctggtcgtggcatgccagacaatgcattccgtggtgttggaggtttagtgccatccccatatgagatgggaagaatgcctctcagtgatgctggtgcaccaccgcaggttccaattggagcattggcctctgcactggccaattcacccccagatcagcaaagactggttagcttatcctttttgcttttatgcacatatgcggatctaaggataaatttcaatctggaactgggatcataacttcctctcatggctgcagatgcttggtgaaagtttatacccgcttgttgatcagctggagcatgatcaggcagcgaaggtcactggcatgcttttggagatggaccagactgaagttctccatctcattgagtcacctgatgctcttaaggccaaggtcgctgaggctatggaagttctccgtaatgctcagcagcagcaggcaaataccccaactgatcagctagctgctctcaccctgagcgacggcgtcgtttcttaacttggttggcatcttatatctgagactgcaagtgatgtagtatgtacttggtgtgttttggaacttgaacctgtggggaagtctgtctttatctttgttaaacggcagttcagttacttcagcattgtgtggatctggatttcagttcctatttgtgttttcttaaaatattgggattgcaatatgatttactcttggattgatgccaacccatgaactagattcttgttatatcaagaaatcatgacaggattagccatgcaatgcttagtttttttcggtagagcagtagagctaactaacatagcgcaattgtgtagtgccaagaaggcgaatggatagtaacacacagggggtgtacctcacaaccgacccaggcaatctagaaaatcatggcaacaatctagaaaatcatggcaatcatggattattccagttactagatggagtccggcggcaggacagtgctcatcaattcggatggtgcaatttttcaagtctccagctaagtgggttttggttttgtgatctgggaccacttaggtgtctatttgtctacaacaagctgaatcacagaaatgttcaacggttcaagcctaagttgattcggtgtgccttgtcccggcggagggctaccaaggcatcaaattgtctctctatcatccaacgaatccagccagactaatcctgtgttcttgttagtgacatcaagaagttggtagccgatttccaggtttgtgttaagaaatcttgggcgatctcatccacccggaggaataggtagcagttgccatgcctctcctcgccaacaatcggtagagaacgaaccgtggctgttggtcgcgccctttttctcctctcggcactcctcgacaaggggcgcagtggaccccatccattgcgcatgtataaattgaacactacgatcaatgagaaatcaatcctctctcgtttcgtgttttgttaacatgttatcagcactgctcgcgaaagaagaagagaagggagaagtagaaatcaaggaagcagcggcctccagcgcttgaaggtacgatgcctatcttaggattgaatttggacgccgttctcggcctccctcgttggccccgaactcaccttctacaccacattccccgctactcaatgtgttagcgccgcgccacccatttcgcccactacggagcccaatacgggcccatggccaccaccaccaaccctggcgccatgtggtcgttgatgccgcgccgactgctgcctcgtaagcccccgcctcgccggaagccatgaaagcagttaattagttttgtaaactctatgtaatggtcctgcaaacccatgatgttatatgttatttggcaaatatgtttgttaaaataccccgctttactaaatttaccggttgtcttaataatatgccttttgcatatttaaaacacactctaattactcactgtgtttattggcaaaattatttaaattttgtatttaacttagcaaatcctcttaattatgtattgttgatgcaaaatttaacacctccacacgaaggcctggaagatttgtttcacttcagtgcaggtcctaaaattcgggttcagcacgtgccagttgatttgatcttgcaatcaacgagcgggacaatagaaaaaagttaaatgacgatagccgatcggcaaatgggctgatgttgtatcgtatcagctgatgctagagagaatcagctataaattatatgaaatattgatcataaaactaggtttagattgaacataaatgtaaatagttctcctttaataaaacctatcctgtaggtcgaacccaattgatccagcacaagattgatgatatcaaagttgattattatacaataatgtgatctaaacagctagtccatgaacataaaaagtatgaacaaaacctaaggtaattacaattggatcaaaagtgaatagcatgggcatccacaatgtgcatctaaagtgggtagtaaggaataaaatactattactactaccaggttgtatacattgtaagtaacaaataccatgtaatatgcttactacctagccataaggaataaataaataatctctctcatccttctctcatggctagtgactgtggggttcagcttactagccacctttattctttcatcattgtgactacaacaacaactaatacccactaacgtattgtaacatcctcaaatttttaaactaaaatttgactgcatcatgctggcttttgactggtttttatcttagattagcaaaatcaaaattctctttaaaagttctctttttatttttgattttggttcgaggattacccttagaacccccttaacctagtttaccaataaaccctaaattttgccctatcctaaaccttagtggatttagcaaattttcttcaaattccaaaacttagaaactttctctagatcacccttctattagtgagacatttttatagtgcataatctttgcaaaactcttccaaagatctctagataaattctttctccttaggcaaaatattcaaaattcctaaatacttcttttgggccgaaatcctctctctcccttcggcccaattggcccagccggcccaagagaggcagccgcctctatcctcctccaggtgcgcgtgttccacacgcgcacgccgccgccaatgccttccctcgccgctaaggaaacgaagccggccgccgtctttcgaatcttcacgccaccgtcgtcgtgcactccttgacctcctcctccacaaccgcctctccccaccgcccttctcctctataaatagccggccatccctccccttctctacctacaaatggagcttcatctctctctttctctcccatgtccggccatgactgcccccggccgatctccctcattggagcttcgcaagccaaacccttgcgccaccaactccgcctcgccgaggtgattccatttttcccgttttccccttttcttccaccccatagcagccaccatcgccacttcttttagtggccggagcaagttcttgcagctgccgttccagccatccctctctctccctccgccagccaccaccctctccggatgcacggtgctcgggaacaccatgcgccgccggcgtcgccgccctccagccgccggaaaaccggcacccctcctccccttcctctctgttcaaccgaaggagagaacgaagagacgggaagaagaagaagaaaagaaaaagaaagagaagaagataaaagactgacgggtgggcccctctatagtaacctttctaatttctcaatttaattcaaatccaatctttagaagcccatatcttttaaaatataaacccaattcccgtgaaacatggaccaaaattcttctaaaatctttctctatcttttgaggctattttttgctattttctcattttattttatttttgcctatttttggattttattcgatttccttttgaatttgaattttatatgtttaaccctaggtcttgaggattcttctgacacattagataatatcagtcaatctcaggacatcgagcaaggcaagttaccatataccttttgatcatttaagcctatattttataaattatttatttatagccttctattcaatattctattttttatgcataaatcaaccatagaaacccagacaatttagtattgcttattttgcttacaatctggttaaaataccttatacttagattgggacagtacgtaagatttggttgattcctgggtggctagtactgtctcaatcgatataagttttgccaggtacttatgtcaaacgaacgggtacgaccgcagttctagaatggggacagacctagtcattatgttacttagcaatgtgatacctctgtgtagtggttcttatttttaagtcctcgagcaggaggcaactatagctgcgaagggaaatttctaccattaccatgtactggtaattggtttgttgagctcaattataattatggttataattctaaaccctgatcgagatgacgtggtgtcatacgatcagttcccctcaagtaccccgggaacgccagaactcctctcgctgctgttaacgtcacgttcagagcgcatgaggatataagttcatggaacaggtaccacaattgttaataacctaatactgggccatgactaagctaatgaatattggcaagtcgtggactgcgggtaaagcgtacatctactgcagtagaatattcatgaaactattcgaatagccgtactcacggaattgagtaccgggactcatatggtaccctggttagaaacctaaagtatatatttcacaaactcttgctttaatatttccagattgtctattattgctttctgcaaagaactctactctatgccaacgcataacatgtttccatggtagcttgctaagtattgtgaatactcacccttgctctcattaacctttttcagatttgggtcaagaggaagacccctatgactattattatgatgaccctgatagcttagaaaatccctagaggttataccttcctagtcagaatgtactagaacttccgctgtgtaatattagtacttatgtttaattaggtgagtacctattcttgtaaaacccttagaattgtaaactttaacatatgcaatgaagaaccagctgtattacatgtatcaatatttactgatccaggcattgatacattaatctcagtcggatccaagttattagttttgggacccgacacgtatggcccacccttattcacaaagtaggtagtaaacatcggtgatgcctaataactaattcaatctttctctttaatacaagcaattatgatagatcggacccaaccgagacagtattaattgctggcaacaaagatcagataatttaaaaattatatggattcacacaaaaagccgatgagattgcttaggttacgggtaaataatgtatcggctaaagctctggtacaatcttatgcaaaaatatcatacatagttaaatctattaaacaaaccatattcttagcagattgtacttaatcaagacagagcaaaaccaatagccaacttaatagatatcaaggtgtgatacaattgcataagaggatatatgtaacatattaggtaaagaaagaacatgcaaacttaaacctaaaatacctatatcatgtaagatcagctgaaactccgatgcaacccctatcagcaattatcgagcaagttagttcttacaactttgactataacttagtatatcaaacctaactgatgcaacaccaagctatattaaaaattgatagatctgaacaaactgatatttgctattcagggtggtagatacattaactaatctaaaacaacactataatttaatataatatcgatattcccaaatttaaatcaaccaacacacgttaaacaatattatcaactttagattacctaatgtatatgataaataattgctatatcaactggaagtcgaatccatctgaagtaaacagtagccccgacgatgtcacaccctgataaatacatcccaacttaaaaatcactttctaaaaggaacaaaggaaattattaaaagcttaaaagaaatctcaaacactaagagcatctccaacagcctctctactcaactctcgaagccaaaaatttggcaaataagccaaaaacactatttgactctgcaagccatcaagcctatccattggccaactttggctagtctcccaggctggctattctcctcttcagctcttcctctactcatgcttttcctctccatcgccgagccaccaccacgccaatcacccgcacctccaccacgctcccttctggccccgccggaaagcccaagtcgcagccgtcgttgtcgtggtgcatgagtgggcggctcgccgccgaggaagatgagcggcagcggcagctcggcgacgaggaggggcgactcatcgacgaggaggagcggtggcggcggctcggctcctcggacctacggtggatgggcacacgacaacgacgacgaggagtggtgcggcagctcggctcctcggacctgcggtggacgggcgcaccacgacgacgaggaggagcgatggtggcggctcggctcctcgggcctgcggtggataggcacacgcggcggatccggcgtcgggagcggcgcgcgtcgcgaatccggcgccgggcaagcccgcacgcatggcgacggatcggcggcggagagaagcctccgtgctcccgtccccctttctctgtctcgcatctccagcgatggcggaacctcgtcgtctcctcaccgccgccgccgacgttgccgtgtccgccgcatctctagcgccgtcggtcgcctcgtccccgcacggcagccccctccgtcgaccacctccgtcagccacctcgtccgcacgccgtgggctcacgtggaaaaggggaagatagagggaagggaaaaagaaattagagactgacatgtgggacccatcaagattggagagtgggatagagagattgttggagtaaaaggcaaatatgactctctaattttttggccattggctaaatggacatttggagagtccaaaatagctaatctgttagagatgctctaaaatacgtcccagaaaaatccgaaagtggcttggagtatttttgttaaattctccatgctctaaaattggttcctcatttttacttgaatttttaaagcaaacaaaataattttaaagcaaaaaaaccaaattcggagtaaatttaaatgaaaaacctaaaaataaatctctcctctttgggccatttacggcccaaagtctgttttccctccccgctggcccgctcggcctttctctccctccctccctccctcccttttgggtcaatctccctctcccagcccgttcttttctccaagccaacccacttcctctcctctctctccatcggacctaagtccgtcctcgacgcggcctagccagcccaactgtaggtcgtcccctacctctagcggctgactgctcctctctctctctctctctctctctctctctctcctccgttcggaaccctagcgccgccgccgagttgatccacctcctcgcacgattctccaccaaattgatcagaaaagtcggttcctttcctcctctttatttttgccataatttcccactcaattgtgtacaaactcaccttgaatcgatgacttttcatctccggcgaactaccggcattgatggccggccagtgagctcccccggccgttccactcctcccctgcctataaatgggcagcaacacctcccctcccctttgaaagagaatctatgcccctagtgggttttggttaattgatgacaaacgattaggggattaatgcgcttattgaatgtataagcaagggattagtctgatgaagaaccaatgaagattacgaagaagaatatgcaatacaacgatgtttcattgtgattcaaggctagaagtgacgaaagatggcaagatgatgtgaccatgcctaccagtgatacaaccattgctcacatcattgatcaacaagaagtcatcaaggtcaagtcctccaagtgctggaatccgattcggccacctgctgcactgttgacttcaaagggccgccaaagctgcataggacctctgtttttggcccttgagtacttgacggaaagctctcggagtcctatttccaatagaaccagccacatctccgaattccagttcgtttggctgcaatcacacaaacaaggttctgcgtcacctatattgggccaatgggcttgtaactttatttgggaccccggccc

SEQ ID NO: 46175 - DNA, 7316 bp, Oryza sativa
  unsure (1)..(7316): unsure at all n locations
gtcggacacgactcttatctctaacaaactcgaagataccataagtctttgcggcagacttttgcccaaacatatctctaagaaaatacataaaacatcctaattaatagatacaattgccttctcatgactctatccatgcgtggcaatcctcatgaagctcattaactcaatccgacaacgtattccttgtcatattgtcggactcggctcaatcggctaaccctgtccaactcggactctgccgatccaggtcgtagccgattcggactccagccgatctttactccgtttccgagacgatctccatctcgaactccatctcgatttattcatctccgatccttggattaccaaatttggtcgttaacaatatggaagtgagtaaatacattaacttatatagaaaatattctaccttaattacctttataagcatcctcttaatttaatactaaagtcaacttatacataaataggtaagaagcttatgacatgtgtaaggtaaattgtagttctaacatatcaacatcacttcacgataatgagagtccaaatataacttttataaacatttacatgcatttaggaaagggaaacacatataagacataagtcttgcgaattatctgaaataattcgtgcaagataaaatcgtgggaaaattcatgtaggctctacttaacatatacaactcactgtaattttggtataatttaataactacatttgatactcgaataaatcaatcaaaccagtcaaataatagattaattataattcctaatcggctaaaaccatactttgtctaaaagtgcatttaattgcatggaagtgtataggggaaataatttattcaaatactaggttaattatcatgaataaatatatttttttccagaatttatcttctcattttaggcctcctaaaaattcaaactaatttctaaagagcccatcttctaatttctgtgagtaatctatccataatttttgagtgcaaccaaagaaaatggaatctagatatcttcatgtaccttcattaaaatccacatgaattgatctgcaccacaaattaatctatgaattaacaaagatgggaaaagaaataatcctggaaaaatcattcaaaatcgagttcacccagtttcttacccatccctctcacactcctacctagcttacatcgacctgggcccacttggcagcctccttgggtcgccccctctctgtccttcaccccagccgaccagcgtgagagagagggagagatcggcgccgaccgcgctctgggcactcatcaaattataaactttaaagttatgaaataaaaacttgcactcacaatacaaatttagcctctaaaattcatctaagataaatcatacataaaacatatacaaatttataaaatgcatacaaaattcatttcaactcattttagagcaaacttagtttctacagatccattaacatgttctctaaaaacaaagtgaaataaaacatatacacactttacatcaaagcctctaaaactattatctttaaaataactaattttacataagctgaactttagaagtttatataaaattcatcttagatcctctttaagtaaacccaagttctgtagaatcaccaaaacatgtacttccaagttataaaataaaattatatacttactatgtaataaaagcctctaaatatttttgtaagtaataaccaacatagagcagcctttaaatttgtaaaatttgtagaaaatttatctttagtccaaatggagtgaactaagtttctatagaataaaatatggcaccttttgtacaggttatagttctaaactttaaatttatatgataagtgctaaacacaaagtgttgattaagcaatacatatgtatgtatatgtatatagttgcactctagctctaaataaaacccaactaaaacttgttagaccagagaagttatagtttcatcctcatccaccaaaactctcatataataatctctaagtcggtatgataagtaattaacatagaacattcccaagcatataaaataatgaagtagagtaatatgatctataaaatttatgaactaagattagattagcttactaaaatactcatcttatacaacactagcaggttagagcaagttctggacctaaatttccaaagccatgtacacatagagactatatgcctagaacacgttataacttgtaaaatacataaataattcatattaactctaaaaattatgaaaccaaatgtgttagtcttataaaacacatatattcaccccagaaaacataaacttaataataatcaccttacaacagcatttcacaatagtacctaagtaaatcctacactataccgacgaaacttctaaaactcataactctctaatgaaatgagataaaatagaaattctttcacctaaattcattttagaccagtacctatccactgtgtacaaatcattcattttagtgcattttggatttttcgcatatttcggtgtttaactgcataacgtgtactttctatagatgattgcttaaacggtgaagaactgatttaggtgctgaatttttccagttacaaggcaggtcccacctccctctctttgatcactttgaacctatgttttggaggttattgaaaatgtttgcaaatcttgcatgtcgattgtacactaataaattaaaattttgttaaacttgttagacaaactcctattatttgcattattaccttaacctcacatatatccatatccctcattcctaaccttaggaatcatatcctaatactacttggaatatgagttacattgtcactagtttactatattgcttagctatgcttagaatagttttacttatcacttgggctcatattaacatgaaaaatgattttattaagattctagacagagatgaataaatgaagtatttgacaaataaaatgatggacaacatggattttaggtttgggcctcatgtgatacacatatggtgattagttgtgtaccgatagggggagtgtgcacccaaaccgacctaaggacttcactcaatgtcagttcatttcgtatacagtacaaccacatgtgctagtatgggatagccaaagcttagtaaattatttatggtttagccttatattctggtaggctggtgtgtatgagttcgtataattcagaggagcttcctatttaccccgatatggtagtttaggtgactaagcgtgtccaatacaatggtattgtgcccgttgtgtccgttgtgtccgccaccacgctgttaagtttaaggcatgggcctaccacttaacgttctaggttatatttccagtatgcttaggatggaggaacacgtatcgcgctggtgtaaggctaaatcatgaattttggaaaagctttgctgcgggtaataaatcgggtacttatgtatcacgtgccatgctcttgcatgattattatttcgcatcatgtgggtcatgagcggcgtgtggatatttattgagtatagacttatgtttacacttctaaatgctgaaatttaccttcaaattatgtaattatgttgagatttgagaatgatctcattgctggcatggatgacaatgaggtgcatatttatacatgattaatgcctactttgatgcccatatgctaagtactagcttgctgaaattttatttgaaaacaaatctgattttaaagtgttttatgcaaaataaaacttgctttatgctaaaaagaaccatattatgccttccttgattatatgccttgcaagtagctagggtgttaggcttgtcttggtgcttgctagtatattatttggtgttaggcttgtcttggtgcttgctagtacattatttctaataatgtactgactcttgctattagattaactatttgcttgcaggttgtagacttagtcttttgagtgatgcgggtaattgactgcttcttctaggacttgaacttaatgggggtaaacccctagtcggtgtgcttgtggtttgggtagacaagcttccgcggttctattatctatattcggctggtcggcctatgtaactatgaagtagttgtaagttagatcatttttgtcttaagtgtattttgctatgtatttccatgcttaagatgaaagtgtgaatctagtgcacatcctgggaactagattcatatgtgtatgagttaagaatatttgagatgttgtagatctttagctatttttgtgtcacgccctgaagttctctccctagctaaaattcaattaataaattgttgcaagaaattatttgtttaaaggcaagagggaaaccctaaattaataaatgcaaataataatcggaatcggcatgtggaatttttcttgaattctacatgtcaaaatatgctaataggatttttagtggaattttcaaagcctcggagataattaaaatcaattaaaaatgagcacaagcattaaagaatccctagaaattctttttttccttttcctttcttttcccccttttgggccgccggcctgctcctcccttccctccccgaagtccttcctccctccctctctctcgggcgccgataggtgggccccacctgtcgggccttcctccttcctcccgcgccccactccgcgccccgtgcccaagtcgccacccacgtcctcgccttcccgcccgcgcacgcacgcccacaaggggcggattcaattttgaagccccctcccactctctctctctctctctctctctctccacctcacacgtcgccggtgaaatcgggagctttcccggccacgtccgcccctcccttgcccataaaaagcctccccgcgtcctcctctccatttttccactttccgcctccctctcccgtgctctctatcacgccggtgccatcacacccaccgccgccgccctttagccacctccggtcgccgctcgccaccgccgagccacgccgttgtcgtcttcgggttcgcacgtccgagggctacctcatccacccctcctctatcgaagtccgccatcggaggccgccgttcgctgcacgccggtgagcccttccttagccactgcagtcagccatggctctcgatcgccgcggacctctaatccccctctaacctctctcttttcctctcttagggtgtccaagagctcggccaccgctcgccgttgccgtccatcgtcgcccccgccccccccccccctacgccggccgaacccctgtgaggcctcccgccccctcatttcccctttcactcccctctagtgccggtccgcgctgccgccttcgtgctggccgccgccgtctcccgcgccgccagtccccgtcgtgaccgcgcgcgccgccgccgctcgccatggccaggcagctggcttgaagccgagccgagcccggccggtgccaccccctcccactagccactgcctggtgggacccacttgccaggtaccacctcctccccttgtgccactgtcatgcggggcccgcatgccggcgcccctcccctctctcttgagccactgatgtgcggggcccacatgtcggcgccccccctgctgacgttagctagggatgctttatggcacaataaataattaagggcttttcttttatagtaaaaacacagattatcttctaaaattcataactaattcatccgagcttcgtttaagtcaattcaagtctccgtaaattcataaaaatccctagaatcctttaaaaatggttttgtttcttgtttcagtagtcttatagcttgttttgcttgtgtactttgtttgtcgcgtagatttcggccgtttcgtcgatccgcggtttctcgaagacgttgctgtggtcccatcagcgcgagagcatggcaagtcatgcattacaattgatcatagtgtacccaatttacaaatgtcccgcatttctattaaatgttgcattcttttacaatatcatgtgggatgggtcctattatatattgtttcccttacgccattgataacttgggtattaaaatgcatagatgttggattaggaattgcttagccatgcttagttcaactagtacacaaaggggatcacattaatgcatagactttgattatgggtaattagtgccaccgcaatggtgttagttaattaaaatatactacatggtgggctgtgggtgcatggttttgctagtcgtgcccatggcgattaaggaccggttcacgagatgccctgaaagaacttatcgtacttaccataagccagcgtgggcaacggctgggcttgtagtgtagctttcctctggccgatgtacccaggcaagggtgggcgtgatggagttgggtcggctggggtgttcggttgatcggcttccggattcaccatggcacgagaggggactgcccgctgccttgcgaggagtaagggtgaaacttgaggtgtggtgcgattggttagagggggttatgcgaagggtcctgtcatggcctctttccggtatgtcgtggtggcatgtcggcgcacgggaacatgtcgtggggctgtgtcttgtgggtacagttgtacacctctgatcagagtaaaactattcgaatagccgtgcccacggttatgagcggtccactagattcaccgtgattagtctcacccctagttagcttatggaactggttagttcaggtagtggtttgggcctgtctccacatggtgtagcgtggagcagtgatcggtttatattgattaattactacaactattttactgctttcaactactgcttttaaatgactgctttattgcaaatgaacctttagcctcctttggatatatcctgcatcataccttcccttctggtatgtcttgctaagtatagtgggtagtactcagtcttgctctctttcacaccagagttgaagttcttctcagttggagctgtttcgaggaagttggttccgtcgctgccgtcaaggatgcctgtggaatggagtcgctcgctgctggagtcaagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46176 - DNA, 2223 bp, Oryza sativa
  unsure (1)..(2223): unsure at all n locations
cttgctggcagcgcgcgtgtcggctagaccgtccgtctgcttgttcttcggaaccccaacttatcttatgtattcattccttttttttacgaggaaagagtgattatattaaaacttaaggaggtttacaatcacgatccagaagctcagacacacaccgaggagctttgaaccgccagactacacactctttcgacctaagagccagctgtgctagcttatgagcaacacaatttcctcctctatgaactttctcaatcttgcactggggaagtagctgtaactttgctttggcctcctttaaaatcgtccacagacgacatctctctgaatccagccccctcatcgcttgaactatattggcacaatcagtttccagtacaatcgggaggttaatccattttagcgctaggtgtataccctccagacaggaataggcttcagcctcctccgcctaactgcagtgcctgatgatcctccaggccgagagcaggacctgactgccatgatctcgaataacaacacccaggctggcttccccggtctgctgaacaaaagctccatccgtattcactttcgcccagtttacctgcggctttgcccaactatttggttgacaaatgatttcagtttgcacccttctaccttcctgcttggatacttagctcttcccgttctggtttccttcatcctcatgtttaatttgctcggagtgtcaaaacagcaaagccccaaagtttgcagtcccaatgttgcaattttctcaacactgggggatttgcaattatgacactgcaaacattaagctttgctataatgacactggacccatatttcatagacacagatgggcccatttatcatccactcggagtgtcaaaacagcgaagccccaaagtttgcagtcccaattttgcaattttctcctcaacggttgcctatcctgtgccaaacaagatgtcgtttcggtggaaccaagctctccataacatgagcaagaaacaagctctaacatcctgagttaagccttgaaggatcaacaaaagccaatcagggcccgtgcgtgccagcaagtattatgctggcagcttccaacaggaacgaagagactccctcagagctctcgccctcatacatgagatgacagcatgaaactcatcctctacttccataccacaaatacgataggtagcatcaacttccaggtttcgggagcatctatttcgtatagtagcaagacccttgttagctagcctccaagcgaaaatcttgatcttatggggcaccggtgttttcgagatggagccccaaatactgcgctcaccatttgcagccgagctggaagaaccaagattagaatcaagcctagcatgcagcaccaacttgtaagcactttgaatagagaagagacctgacttttcataatgccacgcaagaaaatcctgtctgatattgaggcagtttaattttgagaatttctatggcatcaaaaggattgcatattcgccagatcagatccgcatcccaggaacgatcatcttgctttattaactgggaaacccaacgaaggcgacaccttccagcaacaccagctaacataagcgaggattcactcggtatccaccgatcatgccagattcttacttttgtcccatctccaatacgccaaatcagacctttcttcagcaattgaagaccatattccaggctcttccaagtcaccgatgagtcacccaggaaaacagcatctattaactcactgttagggaaatatttagccttcaacaacctggcgcataagctatccggaaactgaatcaggcgccaagcttgcctggctaggagagcttggttgaaaagcctcatatcccgaaaacccaagcctcccatgaatttaggcagaattagctgttcccaagcgatccaatgcactttccgtttattggtctcatcaccccaccaaaaatccctgatcattttggtataatgtcggctcccaaaactaatgattcagaaaccgacatgtttagactgtatcaagccctggatcagtagattgatacaagttcaataatctggatcgtctttgcatacgtctaggcatagctttgaaggagatattattatatgaagtaatagggtatttacaagattgtgtctaactattacagcagnnnnnnnnnnnnnnnnnnnnnnnnnnnnnnnnnnnnnnnnnnnnnnnnn

SEQ ID NO: 46177 - DNA, 8974 bp, Oryza sativa
ttgactacagcgcatacatggcccgacccacttcggcctcgtctggtagggcccaaattatggcccatatctgaggaaagcccgtaaattggcaccgttttcccggcccatcatggatgggacttatttgggcgaaaatctcaaatgaggccttactatatatgggccttggcctccaaagctagggcctgtttgggggagcttctagctgcagtagagatgcaagtgggtagtcccactacccgtataaaaacccgcttgttaatttatttttcacatggtagtacaaattttagaagaaaaataaactagaagtgagataaactggataaaaaacctgcttgcatccctagctacagcttctcctagaatcaggatcagaaactcctcaaacagcttttggtctaaaaaagaactagaagccagaagttaggaaactcagcttttctagattcttataagttggctaacaaccagctgcttctcagaatcttaagcttcccaaacagtccataagcttcacactacagttttctaactttactctcattttcgatgcgcacttttaaattgtgtgttttttaaataattttacagaaaaattattttaaaaattatattaatttattttttattaatacttaattaatcatatgttaatccgttgctctgtttttaagcgtcgggaaagggttcccagccccaaacaacacagccaaaccctgcctcgggctattaattaactcaggtcttctcttcctctctctgaaaaaaaaactcagagcaagtagcaagagttcttgataagttaaacacaggaatctcgtacggatggatagaaataatgccttatccatctggattagcaggaaaaattgaattaaaatcatccaaagagataagaaattttctaatccaaacaagtgtattggtccagccctccagctggtttgatatacgtttcatgaatttggacgggattgtatgggctaactaaaatcatccaaagagataagaaattgttttaatccaaacaagtgtaatggtccagcactccagctggtcgatatatgtttgatgaatttggacgggattgtatggactgttatagttcagatagtgcttcgaaaagaattcagggttaagtaagaagaacttcagagaggtgtcagcaaatttggatggaaaggattaaagaaacgtgtaatcgccccactgcatattgatttcctaagtacatcactgcagaatctctgtggacatggatagcaacgttttcactgtcatctggtaagcaggcaaggtcagacatggtggcaactgacgagtgtcaattgggcaaatatgaaattgcagctaactgactctaatcatagtcaatcatcctattttaaggattggtcaaccatcctaagataaatgtatgatccatacatcagaaccaacgtggatcagaattaaagaaaattccccatgctattcgcgagatgatctcgcgctgtgtacatgttagctagatgctcatttgttcatggatcctggcgtttacttcttgatccttgtatattgctcatgccagagtgttaatccaggatatccagcttgcagtttttattggtgtctgcaattgttttcttttgtcatgaccagacagcaaaagacgcagttttgagtcattgtatatgcagaagcacaggatgcaaaagcctcagccattatgattatgcaaaatgcaggattagcaagtgtttcacttatgaacaaataatctcccactttatataaagtgcacaaagttcatccaaaatataaatacatataaagtacaaacttgcaatctgagcaatctcccctaccatttcgttgcgtttgctccgcgattcccttaccccccatgtgctcctgtgctatcaaacaattcccttttgctagagcagaatcatgaaatgccaaactgatagatctgaggggtacttatcacgctttttattctttttcagatgtagccttgcagtgtaacggatctggcctctgaactcatcccgggttttcaagtgcaaaacaccattagatggcacatgtcacacattgacttcacaaattatatcgggcagatttgccacttgagattaaaacagtcgaaatcgccaccacaaactggagttttcttgaaatcttgcttctgaattctagctgtttcagagaaaagaaataacagcataaagacgaagaagcaacgtcagttctcgtgacgaaaaaaaaaagaacaaaaaggaaaaggacgcgaataaacgtggtttccatgaactgcccagctggttcaaccgaccaaggcctgattaattaattgatcacttccaaatcatgtagcagtactgttcttcacggtcactattgctcgctgctgcttcgctgggtccatcgattaataatctggtttgttaattcccctggacttaactaatcaacttgcctagcaatgtactaatacatgcaaatgtgatgcatttatggatacctgcatcagagagggagctaagctctatgttttgtatatagttgtaaagctgctgttctgttcttgtccctggtgtgtgggtagttgctgtttcagagatgaaggcagctgtgaggagcaagaagagcaagggctctttctgccaccctcctctgctcctgctcatcgtggcaatccagttcttggtgatttactcaccaacccttgatcagtacatggtgatgctaaccacaggtacgccgtaatcataatcgttttgtattcttcagtttgtatgttgattagtagtactgtcagagaagcatatgctgtttgtcttgtcgatactccattcctgtgcatatttggaaacagttgctgaatcctttcaagaaaacaagttcctttatttgttgggataaaatggtaacagttgctgaatgatgaattgattagttcgttgacaatgtccatcatggattcatgataggctactgctcacgttaggatatcagcatctgttgttattcccatgttcttgtgatcgaaatgggttaactgacattgatgggttgtccctgcaggcaagcctggtttcccatcaatgttgattgatggtaggaggagcttcaaacaagtaggtatgtgtcacataatcttgggaatttcaaaccccacaatgtgattaatttctgacgttgttgattctgagtttatcttggagaaaagattctgattttgttttaatttgctcgatgaaattcttgatgcagatgagttcatcccggagcctcacctgcgatgcgacttcagagacaatagatccgacgtgtgcagatggagggcgccatccgcatcctcggccgcacgtcggaggtgttcctggtggcgccgagcctcgcctccatctccggcggcggcggcggcgtgaacgcgacgggcgtggacgcgaacgcgacgaggtggaagatccagccgtacacccgcaagggcgagtcccgcgtgatgcccggcatcacggaggtgacggtgcggctggtgaccgccgacgaggcgccgccgtgcgacgagtggcacgacgtcccggcgatcgtgtactccaacggcggctactgcggcaactactaccacgacttcaacgacaacatcatcccgctgttcatcacgtcgcgccacctcgccggcgaggtccagctgctggtgacgcagaagcagcggtggtggttcggcaagtacagggagatcgtggagggcctgaccaagtacgagcccgtcgacctcgacgccgagcagcgcgtccgctgctaccgccgcgccaccgtcgggctccacagccacaaggacctcagcatcgacccgcggcgagctccgaacaactactccatggtggacttcaagcggttcttgatgtggcggtacgcgctgccgcgggagcacgcgatccggatggaggaggaggacaagagcaagaagccgcggctgctggtgatcaaccggcgctcccgccgccggttcgtgaacctggacgagatcgtggcggcggcggagggggtcgggttcgaggtgccggcggcggagctggacgcccacatcccggcggcggcgtcggcggtgaactcgtacgacgcgatggtggcggtgcacgggtcggggctgaccaacctggtgttcctcccatgaacgcggtggtgatccaggtggtgccgctggggaggatggaggggctcgccatggacgagtacggcgtgccgccgcgcgacatgaacatgaggtacctgcagtacaacatcacggcggaggagagcacgctgtcggaggtgtacccgcgggcgcacccggtgttcctcgacccgctccccatccacaagcagagctggtcgctcgtcaaggacatctacctcgggcagcaggacgtccgcctcgacgtccgccgcttccgccccgtcctcctcaaggccctccacctcctccggtgatcgccggcgatcgatatatatatactccggtgaggcgatcatgcatacagaacacacgtacacaggattaattacagcagaagatggagttcattaattaattaattacagtggtagatgatgatgtagtttaattaattttggtggttgcgcaaggcggcaacgtttttgtatgataattaatcgatcctgtttcttttttttttcttttttttctgttgcggagccgtgttgcgacgtgcgtacgtgtgtgttacggtaagttggcctgctgcaattagctggttcaacatgacagaaatgcatgtgacacttccatcctttcttgtacagttgtactgttgttaccttacaagctacgattattggctggaagcctgtgaggaggatactggcccaggtgatctatgggccacagcccatagaaggagctgggctgtgtgctgttgctcgtaatggcccagatcagtctatagtcttgggctctacaaatacggcctgtttctcggcttctcgcaacgccgttgctgatgatgttcagccgaacggtcagggtccaactcgacctttgaattttcacggattaaaactctcgggagtttggccggagtagtaaattctgattcattcttcgcgttggtaatgggcatatgcatgggtcagacgtgatatgcgaggcgtcgccatgaacgcggctttgattgctcgcgcttatcccggtggacgtcgtcctctataaaacaaagcactccagctcgatacagcataacgcagttcgcaagttcaatcgcaagagtactctacttctgcaagcttattcttcgactgatcaagcaaggtagagacatgggcggcaagggtggcggcggaggcggaggcggcaagggtggtggtggaggaggtggaggcggcaaaggaggtggaggcggcagcggaggtgggggcaggagcggcggtggcggaggaggaggaggaggaaagggaggtggcgaaggaggttcaggcaagtacggcggcggatacagcggcgggcacgctggtggcggcggtggcgcaggcaagtccggcggctaccacggcggcggtgggggcgacagcatgaaggctcccggcggcgacggatcgtacatctcccgctccggcttcgagtccaacccgcagggctacttccagggcctccatggcgatggcaagtagaggttttggagcgctccaaaagttaggctgctaatcgatcagaattcgcgattatggcccatgaatggtggcttctaaataatgtattatcgagtctgtaaggcagtctactttctccaaatctctgttatgtatcggattatcgtggaaatctaagtgaatgcgttcgataattttatgtcttttaggttggtacgtaatttcagcaagatcaccgatgttcttcttgttactcccctgcagtgtattggaaacttctcgaggggatgtcttctcgtttgtttaaaaaccatccaaactgttttaaaaatttctaaaaaaaaatttaaagcactcatgacatgtctatatgtacaatttcatgaaatcttaggtccaaactcaactcacatgtcgatatataaaaaagataaaaaaaattgttaaacaattactccctccattccataatataaggcacaaccactttttttaagatattccataatataaggcatacatgtatgtatgccattaactataacaattctccattaaattactatttttttaaatccttcactcacattctctaactctattggatggatgcattacatttattaggatgatctaaactacaaggtgataataactatttcttggtctttgggttaagggtggttgtgacttatattttgaaatggagggagtatttgtattcagttcgaaagaaaaaaaaagtacatgagaaatatcccatcgagagtttagaacccacccttatcatagtatgtcttcttttcaataaaagtatgatactccctccatcccaaaatgatatgatatatatttatgtaccaacgttaaggataatttaaatcacatcaatcaagatactatacatacattctttcataatgatgatcaatttaagaaattttggatttcattatatgattatcaatttgggaaggagagagtagtattttattaacaagatatctttgaatatgtgatattttaattgaaatgaggaatttgtgtaaacaattagttatgaatgtgattttaacgttcaaatttgggtttattattttttagttgcaaggtgtttaaaaggtagcagtattagtttgttcttaagataacttattgattttctcatttcttttagtttggggtctcatggtttatctgccctaatataagtttgggcctcatggtttgctgtttgtgcttatgctagaaactgacccaacctggttcagttgccaatgtgcatcagtgcatctcaggcggataggcacgagcagcggaggaggctacgcacaggcgtttactagcgtttcttttgccatcttcgatgcgtaagccgtcgcgtcaattaagtcttttttttatcaggagtcaaccaagactggacacgatcgagccgattatgcgtgcatggtcatggagggcgagggccgttcaaaattgaaaacgaccacgtcaaaggtcggctcttcgatagttcgatcatctacgtccactaggcccaattgatcggccagattgaacaaaaaaatgaagtcggctatgctagaattctagatgcatcgcacggcatcatttgcattaaatttcatcactgatcaagaacactgaacactcaatgttggaaatatagtcattaatcgacatattttaatccaaaaagttaaagcaatgatcatggcataagcagtatagggtgatcttaacataaccagtagcatactatgcgcatcatgaatgtcaggaacaggaatataccagtaacgcgataacatgctagaggcattatgtagaacaggaacaagaacatagcgcacatagtatagcgatagcgctaacaatgggaacaggaatagcgctaacaacagtagcaggaggagaagagtataccccgagaatggccctccgctggatggtgaggcagaattgcctccgttgttgttgtcgttcacggcacctcctggcgcaccagctccggatccagctcctgtcggcggcgtaccaccaccgccagcagtggcggcggcaactccagacatggcgatgagcagtcgagcagtcgtgcgggaggcactccccaaaaacctgatcacccgcctacccggtgcagatctcaggcgaaggtgtggtttcggaggcactgctccttccaatctctcgtgcgcgcaagagatcagaagcgaggaagcgagagcaactcaggcgcggagaagaagaaactaacaccgggaaagaagctaagaaaatggatcggactcgcggcctccttatctatcaggagaaagaacatggacgcgctgttgcggagggaatcgtgggaacgtggaacgtggacgcgctgttgcggagggaatcgtgggaacgtgggttagtgcctgcaaaaggatagtgacgcccgcccgccgccatccacgccctcgccctcgccctcgcccacggcccggcgcgcgcgtgtggtattccgacccctacctcaactggtcaacagggagcctccaataactccctatttaggttgagatatttctcgcttaaatcctgaggtggtattattatcctcaacacttattatgggcctttgagatttaatattataagttgggcctagcccaattattctaacactcaagtcatcgggttcgcccaagtactatataacatgcatgaagctagcttagcatagatgtcaagtttctcaagaatttaacacgcctatacattctcctctcaaaaattagcatctgctacgacagccacctccaggcacggatgacgaagcatcatccaatgctgctcttccttggcctagctttgctcgccctgcagcctctgatcgcggccgcatcacggcggccgccgccgtcgccgctgtgtccgaagaagtgcggcaacgtcgacatcgagtacccgttcggcatcgggccaaactgctcgctgtccgacgatttcagcctcgagtgcgtccacgacaccccgcagcttcgcctcggcaccgatcggcagcaagtggtgccagaaacacctagggatattttggctagcttcacaaagtagtgggctggacgatctgggttcgaagcctcaccccttctaattatatttgatattaggtctttcgggggcggagacaggcctagagcagctaaggcttgagccctaggcctgtctccaaaaacttgcttaaattttgttgaatcaccatgtaaatttttcagaaaactaaaagtccattagtcgagccctaccttattcttagtcttatataatttttggactccgccactgg

SEQ ID NO: 46178 - DNA, 1417 bp, Oryza sativa
aaacctccatctgacacatactcgaactctgggggggttgggaaaaatagagcaagactgagtactacccactgtactcagcaagtcataccggaataggggtatgatgcagggaattatcaaagaagagctagagtggttcatttgcataaagcgagcatttataaacagaagttaaaagatttaagcagttgtaataattaattaatattgatcatccgctgtccaacgctatcccacgttgcaacaggcccaaccatccacctaaaccatccaaattcaaaagattacactagggtgagactaatcacggtgaatctggttgaccgcccataaccgcgggcacggctattcgaatagttttactctgatcagaggtatacaactgtacccacaagacacagccccacaacacgtttccgtgcgccgacatgccaccacgacacatcggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaggctacactacaagcccagccgttgcccacgctagcttgtggtaagtacgataagttcttccagggcatcccgcgaaccggtccttaactgccatgggtgcgaccagcgaaaccatgcacccacagcccaccatgtgatttattttaattaaccagcaccaaagcggtggcactaatccaacactaccattagaaccaacagtctaaacattaataagattttccccattgtgcactagttgaactaagcatggctaagcaatccctagtccaatctctagtcatgttataaccccaagctgacaaaagggacatggtgcaacaatagcatggctatgacaataggtaaacaccccatagaaatattataaaacaatgcagtatttgaaggaaaacaatagagcatttgcaatataggatcaacatgttcaagtgacaagcatgacttgccttgctctgctgctggaggaacctcggcgactatttcgaagtacaccggagcgtcggaagaaccggaatctagcgacatacaaggcaaacattgcaaacaggctataagactactgaaacagagaacaaaaccatttttaatggattctacacatttttcttgatttactgatacttgaatgggcttaaacggatctcggatgaattagttatgaattttagaagattcactgtgtttattactataaaagaaaaaccttaaatcattcattgcgcaataaatcccagggctgacatcagcacgggggggggggggggggg

SEQ ID NO: 46179 - DNA, 887 bp, Oryza sativa
acatggtcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtttctaaatatgggacttttgttggaaaaggttatgacagcggaggcttgttccgcttttctttgaatgacatgtgtaataatcataatgctgtgaaccatattagcgagaatgatgagtctaatgtgtggcattcgtgactctgtcatgtgaatttcggttgtatgacgcgcttagctaacatgagtttaattccaaaattcactttggtcaaaggttccaagtgccatacttgtgttcaatcgaaacaacctcgcaaggctcacaaggcgtctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaat

SEQ ID NO: 46180 - DNA, 3801 bp, Oryza sativa
acatcaagatgacacggagtgcttttgctttactcaacaaattaccaaaaggaatgacaaagctcccatgatattgtccaaatagcatcaaagactgtagtttttcaacatctagtctcttatgtagagtgctaaaatccttcttaacattttcaaaagtcactctatgatttacatccgtgtcgtctatcacaatagacaaatgtcgtacagatggtggaatttgcacacttctcacactagaactacttatagcaagatattcatatgatgaaacctttagtgctaactcatgtagtaggtcatgcattgtatagtacggagacccatttttgttcatgtcttttctaaaaaatccataattaaccaaatcattcaaatagctcagtcctatctcttcgacttttttgttttgattccgcgattgtaatatgtctagtcctatccacaagtgaatcatctcgtcactttcaaatctgtaatcttcagggaacagagcacaatatgtaaaacaatgctgtagatgaaaagggagatagtcatagctaagctttagcgctggcataatatcattctcaccggtttgcagttcccattctctactttcgaggacacttgtccaatgctccaagtcaaggtgatttctcaataaccgtcctacagtttttgctgccaaaggggagcccttcaatttttccgctatcttcttcccagtgacaagtaagtccacgtgattgcctattgatttctcatcaccaaatacacatgcttggaatagttcccaaaacacttcagattctagcccttccaactgtattgaatgatcaattgttttaaccatttctgcgactgctagaaaacgagtggtgactagaattatatttcccgttgattgtgcttttcttaggggtgctaagagccttctccactcatcctcattaccacaattccacatatcatccaagacaagtaaaaacctctttgatttcaacctttgctcaattaaatcgtctgggccaccagatttctcatctttgagttcaggcattaacttggcaatctcctctttcaatctatacacattgaaattgagagagacacagacccaaaccttaacatcaaaatggttctgtacctccttgtatatatgctgagtgagagttgtctttcatatcccacctgaaccaacaattggaatgatggtcaggtctttgccacaataatcaccccgagtaatgccaataattttatttatctcactcatcctcccatgaaatttagggtctataaactctgaagtggttacaggccggctcatagcaacgctgcttggaagaaaaggtgcttgccctggcatccgggaaagcgcagcattgagactcatgaggccaatgttgcggtttgattccaacaactccagattaaggatggtggagaccttggcgcagactggttttagctgctcgacgatgtgcttcattcttgggacagatccaccctgtcaaactttcagctttggtgttttcatggtgtgctctatgtgcgatgctttgcaaaggataggcgcaacagaggaactggctttctttctgtaggaatgttgcaatggtgataaaggtgtcacaaccgtcatgttcagttacaaaagagaggcgtgggaggtgtttatattatcaatgagatggatagtaagtacctcgagcattggaaaagagcttgtgaatgcagctgctgcctgcaagtgcttccccatcgttggtatggcgactcgcttccccattatctccgcatgagcacgccttcttcttgatgtttctgactgtgcggcgtgtgttgagcacgaggccatagaggcagcccttggcgtgctcttcggcggcttcgtaggtgccatcaagctcgtcctggatgcgaaagtatcgagctctccagcacgtctcggggttgtaggcaagccgcggaagcttcaggagcagctgctgcagcgcggggttgctggtctctctgctgcgagcgttgtgcagcatcccctgcgcatagagcagctccatcttgatggcgtcgacattagggccgagctccgtggtggcagcccacgcctcgacgaaccctcccgacagcgggctcagcgccttgccgaccacccatcgcgccgcgttcacggccaccgactccatcgcgcgctctcctcgaccccgggcacgagtaggatctctcagctaagccggtggtcgaccagagagatcagcgtacaatgaaactgcacagattcacagagaggtagtagtagcagtggcaaagcaataaaggcctttgttttgattccctcctgctttatccttgtggcaactttggttgcacctttattctaaaaaaaagaggcagtcaatgaaaaggggcagtactcttgccctcttattctaaaaaaaaaaaaaaaaactttggttgcaccttgactcctacgatcaaagacagcctgggactgcggtagcatctgcttcgcttcgtttgagatggttcatgtctggacatccgatgcggcagcaggccagcaatcaagcatctgttcgatgcttccttcgctaccctgatcgtgaaatctccatgtgccgatgggcatgtcacacagtcacaggcatgaattccttgggaatcacagtgccaggctgctgcttgtgctgcactacctgctgcgcaaccaagaagttttgtgttcctcttcagctgcttctctgaggaaaagatagacaaacctggtttgcacagtaaaaattttgcctgcagacgaaacgctagagcagcatggagactctttttcccagtgccgaaccaacaaaattgttctaaagtagatgatgcactatgcaagttctcaagaggattcagaaatggaaggtggaagaaaacacagagcaaacaggaaatataaccaaacagtgcccattgcttgatttaaagatggtacatttcggaaatggtggcctctccttgagtgaaatgttaaattgattggctacctacgatagtgcattttaaactctcgcggaacatctcctcattgtctgggtaatccaaatagttatgaaaacaaaaattaaagaagacgtattaatatgtgatatatcactctacaaacataaaagttaaactatagctattcacaataaaatttattattttcgttgtaacatgtagaagttaaatttaatattacacgtttgtagagtgatctattacatattattatcttcttttatggtttttcataatcatttaagtgacatgcaaacaacggggatgtcccctcgagagctttgaatagttcccgctaattaccactttctcttttaaaaggagaatctttgcttttattgaaagcaacatagcagtactgatcactagtgagtaatgattctccctgatccacatcagcttaccagtcacttgtttctatcatcagtccaatttgatagcagtgttgcctgcacatcttgcattttccaatttctactcccttgttttttcgctgcgtgcacatttcctgaacagctaaaccatgtgttttttaaatctatacctaactaaaaaatgcatatggctttcacacctattttcgtcaatcccttcctccctccctcccacacagcgccctccttcccggcgccccatctcttttcgtccctccctccctcccggaggcgcctttgtgtagcgcccgttccgtcgtggcgcctagcgggaaaattatctcttaaaaaatctaattgcgaaatttgtttatttgcttgttgtctagtgtcc

SEQ ID NO: 46181 - DNA, 2072 bp, Oryza sativa
tgatcccagcgtgctattaaggaaaaaccgaacaatagtaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatttaaagggcactacgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagtagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaagggctaccacgtaatgtgatagacagtgcatcgagggaaatgggcttgatacccacctaagggtgtataatagtggaaacctgtccattgggatcggagatcccgtgaatttggatggtgaaacaaactattgtgtgactgagagaagagacccttgaaaggggctcattttcatgatgtgcttatcttctttcctgcatggtaggatggcttatgtattaatgtgatccgagtggcttttccaagcagagatgttgacctgcaaaacatctcagaaggaacacacctatatgagttcgactgctagtcacagtctatgaggtttgggcgatctctaaatactcatgaaagggctggagtttgacttatatgctccaaacagaggggataccaacggcagtccagtaccagtcaaggttttagtgaaatttgatcacacaaaactcacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaacttataatattaaatctcaaaggcccataataagtgttgaggataataataccacctcaggatttaagcgagaaatatctcaacctaaatagggagttattggaggctccctgttgaccagttgaggcaggggtcggaatgccacacgcgcgcgcgcgctccgggccgtgggcgtgggcgagggcgagggcgagggcgtgggcgtgggcgtgggcgtggctggtgtcacaccctgaagttctcctcctaagcctaaaattgaattaataagagactctaagaaaacaccggtgcaaagcaagagtaaaccctgctaaatcaatgcaaataataatcggaattggcatgtggaatttttcttgagttatacatgtcgaaattcactaacaagatttttagtggaattttcagagctctcaaaataattttaaccatttaaaatcgagcttgcaatattttaaatcccagggaaattcttttcctccttttcttttgttttcctttcccctccttttcctcttcttgggccgtcggcccaatccacctgtagcgcccgttccgtcgtggcgcctaacgggaaaattatctcttaaaaaacctaattgcgaaatttgtttctttgcttgttgtctagtgtccgtgccatctcaagatctcaatccccgatctatcgtcgagttcaaatccaaatccaaatccttccaaatcaaattcctccgcaaaagtctattttgcctcccccgggggtcgatgggccgatttcctcccggcccatctccccct

SEQ ID NO: 46182 - DNA, 3389 bp, Oryza sativa
ccggcgcgctgcctctcccctctccctcagctccgctgcgctccgcccgcgcgccgcgcgcacgtgcgcgggagcggcgccgagcgctcctcctcctccgctctgtccgcgcgcgtgcgcgtgagtcaccgcgccgagcgcctcctcccctcgctttccttctcctctccctggcgagctccccgctcgcaaagccggcccccgcgcgctgttgttcgcgcgcgcgcccacgtggtcctcgcccgcaccgcgtggtcgccgcccggccccgctgccctgccgcgcctgcagccgctcggccccgcagccagcgcgcgtgctcgagccgcgcctctccatccgctgcgccctcccattgcaagccgcgcgcgcgtgccgagtggccgaccatctggtcgccgccgccgtcaccctctaccgcgccagcccgcgcctatcgcccgtgtcgtcgcgccgctccaaaccgccccgccgtcatcgccgtcgtcatcgcctcggccccgccactccgcgcgcaagccgccaagggacggaggccgagccctcctccctctgcctcgacgcccccgctccccttccccttttcccaaagaagaaaggggcgagcccccctttctctccctcctttttccccttttcctcccgccggcgtcatcctccctccctcctgtcgccgttttggccgctagccggagcgacagctcgcgccttgaccgccaaagtcggtttccaaactgacattgccgccccctataaacccaagcgccctcccttcccttttctcccattcttccctgtttctcgcccgcgccattgccgtccctctcgccgaccgcagccgtcgcgtgtgtgccggaggagccggtgcgcactaggacgcggaaggggactccgggcgctcgtcttcctcctcttaaccggcccgatgccggagagatccctcccgcgccgtcggcctctcgtcacagcgcccctcctcacctcgtgatgcctccctccgttcttcctcctcgctccatctcctccccctagctttcggtagtagctcgagtagactccccgtagttagccggcgccgccccgaccgttgccgtcgctcgccgtgtgctcgccgccgtcgccgctcgagctccgtagcacccacacgtcgccagcctcgctcggtgtagctccgtccaatccgacgctagcatcgagttcccgaaaccgcgtagatgctctcaccgccgggaatcggtccctcgtgacctcgtcggcgtttccctcttccctccccgccggttgtcgccgccgcgattcgccgccgtcgaactccctctggcgaatccgagccgttggctcgcctccccctgtcgcgaacaaccgcccggtgtgctcgcttctgcccgtatcaccatggttcgcttcgccgctcgccgccgccgcccgccgtccattcgcggccgggtcgtcgtctaccttccgccggcctgcatggcagccacgtaggcgccacgtcggcgccagctcagcctagaccgggtcgagccgaccccggtcggtccctccccgtgcgcgcgttccaccgcgagccgtgaggctgcgcgtgggcccgtcgcatccgcgtccaccgcaaaccgcgcgcgtgcaccgcgttcctccccgcccgcgcgcgtgcgccgcgtgctccctccgcacggcgagccgagccgttgacaagcgggtcccacccgggaccgcgcgtggtgagcccggtccaccggactctctctcccctcccccgcgcgcgcgcgcgcttgggccgttttgggccggccggcccattaagctcggccgagccgccccagatcccttgggccgcaccctagccgcccgaggaaagtctaaatttcctccctccttccttttctttctcttttccaaaaaaaaagggatttaatttaatccttttttccgttagaccaaaaatccaataatcttagaaattcaatatcttcccaaccgtaaatccgtttgactccgttcaacttccaaaattcatcaaatctcgagatctatctaatggcacgcttagaggtcgttaatagggctttattttcgctgtttgttgagttgccccgtttcgcgtgtagtttcggagcccgaagacccgcagtgcgaggattttgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgtgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaatgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgtagcgcccgttccgtcgtggcgcctagcgggaaaattatctcttaaaaaccctaattgcgaaatttgtttccttgcttgttgtctagtgcccgtgccatctcaagatctcaatccccgatctatcgtcgagttcaaatccgaatccaaatccttccaaatcgatttccctccgcaaagtttagtttgcctcccccggggttcgatgggccgaattccgctcggcccatctctctctctctctctcccgggctctctttctctctctctctctccctcccccggcgcgctccttcacccccgctcagcctcacccgcgcgctgcccgcgcgtgcgagagccgccccgagcgcctctctccctccgccccgctccgccccgcccgcgcgccgcgcgcgcgtgagcgcgtgtgccgccgcgcc

SEQ ID NO: 46183 - DNA, 15279 bp, Oryza sativa
aaccgacattgccgtcccctttaaacccccgggctccccttacccctcctcttccattcgtctccgcgctgttgccgccgccccgtgctctgtctcgcctccgccgtccttcgccgagcgccgggagagccggtgcattcgaggacgcggaaggggacttcggccgcgccctctccttccccttccccggcccgaggccggagagattactcccgcgccgtcggcctctcgtcacagcgcccctcctcttctcggtgatgtctctctccgttctccctcctcgctccgtctcctccccctagctttcggtagtagctcgagtagaccccccgtagctagccggcgccgccccaaccgtcgccttcgctcgccgtgtgctcgccgccgtcgccgcccgagctccgtagcacccgctcgtcgccggcctcgctcggcgtagttccgcccaatccgacgatagcgtcgagttcccgaagccgcgtagatgctctcaccgacgggaatcgacccctcgtagcctcgtcgccgtttccctcttctcccgccgccggttgccgccgccgcaatccgccgccgtcgagcaaacctccgggaatccgagccattggctcgcctccccctgtcgcgaacaaccgcccggtgtgctcgcttctgcccgtatcaccatggttcgcttcgccggtagcagccgccgcccgccgtccattcgcggcggggtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgctgcatccgcgtccaccgcgaaaagcgcgcgtgcaccgcgtccctcccccgcccgcgcgcatgagccgcgtactccctccgcacggtgagccgagccgctgacaagcgggtcccacccgggaccgcgcatggtgagcccggtccaccggctctctctctcctccctcccgcgcgcgcgcgtcttgggccgctctgggccaccttcttgggccggccggcccgttaagctcggccgagccgccctttctctcgggccgcgccctagccgcccgagggaagtctatattccctccctctccccttttcttttcttttcttttcaaaaaaaaaggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgccccgttttgcgtgtagtttcggagcccgaagacccgcagtgcgaggatttcgaggatcaagccccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgtgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacataccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttccttgcacagtatggtctgggacctaacctgttgttggtctgggacccctctcgtcggcatatggtaaacctgtatcggctttcgaaatgccttgtcatgaaagcttgaagttctcccgacgtggctgatccccacgggctggttgacccgggttagtaatgtcgtgtgggtaaagcgtaccccctcttcagaggtcattaaactgttcgaacagccgtgcccacggtcacgggcggatgtgaggtgattcctagcgtagttttgtttgactactgcttgtgaaattgccgtgtgaaaaggggttcggtgtttgaaaaatctgcagctgatgggatcagctaggcccgggtggccgtttgaaaagttgttggcctgggtggccgtttgaaaagttgttagccgggtggccgttgaaaaagctattggccgggtgccaaccttgtttaaattctaaagactgatacattgcacatactccgaccggacaagacgcactgtctcatccgtgtcgtttgagaagcactcacttagttgcttttagaaaataattcaaataaaatcaattgcaaaaacaacagcctttccttgaagcctgcattaaacacttatttcccctggcttgctgagtactcccgtactcacccttgctctatataaatattcccccccccccctcagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatactctgtctccctgtgataccagcactgtttcctgggactggtatcgattaacaggttaatttggagcgtcacgggctagttccggtcgggactagttcggggcgtgacactttgcttccgcctccctctctctctctttcaggaccatgtcgttgccagtcgcgttcatgctattcttattttattcgttgccaacctccaccatctatggacaagacacatcatgggacacattcttccatcttcctcagcaccatttggtcgcccgagcaccggcgcccatctttcctcctcttttgtttctcacctttggttatgaaagacaatgaacattgcgtattgtgcactattccttcttggtccagtccaaccatgcttctagaccactcacataatattgagatcataaaaatagaacatgaaaaattctaattatgtcaatgaaacgggcactcatccaaaattaatggattaggttttcatctatgaggtaaaataagttttttttttcaatttctagctaatttcagtttttttctatttgctgtattagttttagcactatttgatccattaaaaatttattataatttataatttttctctgtattgaattatttatagctaaataaaaaaatggggatttagttatataattttcctaatattgaaatatcattccggccaaagttatttgcagtttcatgttgttattttattgattatattttcttcatcatttatgtctaattgtgatatatggtttaggattttaatttgtgtcaatgaatgctaatccattgcaacgcacgtgcattatgctagttataaaaaaattgcttgaaaaaaatcatattaatccatttcttaatttttaaataatgcttaattaattatactctaatgagctgctctgttttccgtcctaagggtctgatgcttggattaatgagcaatcgattgcccaacaagcacctcaccttgtggaggtagtttcagctcgactgcgacgctcccgaatggtggcggaggccatcctccataggcagtggacgagggacataatccaaggtgcactgaccatgtgactgatcgttgattacctctgtctttggccagtgatcgaggctactactctgatccccgacgtcggcgaccagatggtccggcgatggtctagtgatcatcaatacttgtcgagttcggcctaccagctcttcttctccggcatgcagccgttcccctgctggaaagagctttggcgggcttgggcactgcctcgatgtaagttcttcctctggctcgcacttcagaagagatgctggatggtggatcgactcctaaagcatggcatggcctagacacacatcctgcccttgtgcagccaagatgccgaggacgtcaatcacgttcttatctgttttgtcttcttgaggcaagtctggcagaaggtgttgccatcgcgaggctcactcttgctgcgccaatggaccaagacgacctcgtcgcgggtggtccagtgctcgatgatcagtggacaaatgcaccttgcctagcctcgactctctcatgctactttgtgtcctggtgcctgtggaaggaaaggaatgctcgggtcttcgacaacaacctatcctcaattcaggcggtggttgatgagatcttgcaggaggttgctgctagcatagcgcgatcgtgtaaatgtatttttcacagcttctaacatattgacatgcaaaacttttgcgtgttatgaaaaaaaatattcaggtaatgttcattcagcttctgagcttcagctcgacttctgtcagccatttcattaatcagacttgttaccagactgatgcatcacaaccctttccgacattgcactgtctgaatgacgtgcgtgtagatggttacagattgcacatttcaacttgcttgatgacgccgccctgcagctttgtctgcgaataattttacaggcatgtcgatgcaactatgggagaagttcgatagagaaatggtagtaatctgcaacaataaaacatctgtccccaaaatcagtactctgtctggtttagtggcaaaaggatgccttcttttttccctgaactcctaaagcatatactcctatataagttaaaaaagaagagaaaaaagaaagccagagaacaggccattttacaaagagagatagagaagagtgatatgatatctgcagccatcatctgattttttttctttgaacatttgccgtatccccttctggccagtctgcaaaacagcccgggccaagtcagataaccatgcgcgtcatcctcccggtttacttataataatggaaagatatatcagccgctgcaccaccacaacctatatggctatattactagtgaaataacaaagtacatatgtttaaaattgtaaaatttaccagacagggtgtagaaaatgtcccttgtaaccagcagcctccttgactccttcgttagggacttgcaggctacacctactgcagggaaaacagaacttaggtgtgttttacagtctttccttggcaaaagagatgaaacaattatctttagaaagcaacttacatgaaaaaaagaaagttaatgcaggagcaaactatccagctaaggatgccatagtacttctgaaactgttgagattagttaaatcactcctgctgacaaacaagtggaagttgttcgctgtcagaggctgagggaaataatgaagatcgtatttcatatgattcaaaaagaatgtctgtttctactgtgaagttttaactgaatgtctgaatacattgcaccaccttgatgaactaaagaagaagaaaaactagcatggcatgctgataagttttaacccgtttctcgaactaggcttacacagtgttattagttccagttcatcagacagctattttgtgcatcgaatctcatggtgtcaaattcaatgatcaaactaactagtaaaattgcagtgaaaggcaacagttttctcaaagctaataattctattaaaacctggaaccggttaaagatctgatgaacttgtatggtatcatcaaccagctttgtgtatgtttttcaaaacaacaacaacaacaacatcttttgtgtacagacgaaggaagaagcacaatccaacactaccacacctatcaacataaaaaaaaggttgtgcatggatgcaaagaaaagaagagattctgagagggataaaataggagtaccttggattagtactctctatctttgatgatcggaatggttcctcttagctcgcggcactgccttttgagctcctcgttgtcacaacgacagacatctagtacttgcagtgaactcggaaggccacccttgggcagcgaacggatggctggacaggaccagatctttatctcttgaggctggtgagtctgtgtaacccagtggggagggactgcagctccgagcagtaccaaaattcaaggtcctggagggaggagaggagcagaagtgccgcgctttgccctttgtgaagcgctccacctcgtcgttccaactaatggttaggctggtgagtgaggaagcaaggaggctgcagatgggcgcggcaaggacctttgtgatgtcatctgtttggaggcactgcagccgcaaggagtcagagccacacccgacgaagaatttgggggtctcgaagatgttcaggtttgtgagttggccatgggcgagcagagaagacaagtcctcaccacttaagtccatacatttccatatggttaatctggtgagagagctgaggtttgagaggggagcaagagtctccatgcctctcacatcactcagatacatcttttgaagggaggatggaaacgggaaacaagacaaggaggtcgagtagtaggaggagaggaaagtggggcaaccccaaatagagaatgctcgtagggagtgcaggccttgtaatcctcctcctatgcctcttaagcctccttccatgccatctacaagagaatggatctgcaggatcagctctgggatttcgctgatgttcaactcctgaagttggtgaggcaagagcaatagtcctgcttcagctgacactttctcatcctctcctcttggttgttgctgctccagtccgaaacgagcatcctccaacttattaccacaaggtgatgatgacgatgccaacattgttgtcatctgcttccccagcacaccaagccctcttatcttattacatctccttgaaataaacatggagagtttggggaaatgagatagaaacaacgtcaattccttcccgctacaaccacactcaaagatctccaatttctcgattggaaactggtagctgacagtgttctcagattcaagatgtgacatgacattgcttgagtcagatatagtgagtctcctcaaacatgatagcattaggaggtattccagcggcaaaggagggcatttcttcaaatccaactctttcagatcagttagattaccaaaaaccaatctcctccagaatgcaccatctagatgttcatcctttcccttgactagcatgcataattcatattgcttattttttgagtaatccaactgctgaaaatccaatccaactccttcaatcagcgcacggcatggagagcctctccaaggaatgggagggaatgatgacagctttggacaattaacaatctcaagctcctttagtgtacggagttgggtcaagttcatctcttgctccgatcgagggcatgtggaatgtgaaaatggcaactccgtgagctctggacaatctcttatgatgagcacctttagcagagagaacacaaagcaagaatcatttccaacccattttgctagtctctgtatgccaacaagctctaacctttttaaattcggaaagctcctctctgttgtacaaaccagggattcttcaccatgctcattaatcaacaacaacttccctagaggaggaaatttgttccagtctacaccatcaagacgaagagtttgcaagcctttgatggacaagttaacacccaaccatgaagggcaagtagtgcccccacgcccattaatgtgtagctcccgaagattgctatgtggtttaagactttcaaggatatgctcttcttgtaaagaatcctttgtcaaacgtttaatatcacaatctaatatcaacttgtgtaagcgacttttgtttgaaagttctgcttcctctggtgcctgcgcattttcaagattatagatgcccaatgacccttttaggtcttccaactgccccagctgtcttagtgcaaatgcctcaacttgtctttgaacttcaaatctccttaactcttgtaaacattttagctttcccacactagcaatttcagagtgaagattatcatttgggacaagaaaatgccgcatccttacaaggtgattcatatctcttggtaaaccaaagtgaccactgcattgtctcacatcaaggatcctcaggtgataaaatcttgaaataatgttggacagacttagttcaggaaaatatcccttattaatccttaagtaacgaagatgaacaagatttgaaaagttgtgcaacatattctccacagcataagatgctacagacaacaagatgacacggagggcttttgctttacttaacaaattaccaaaaggaatgacaaagcttccattgttttttccaaatatcattagagagtgtagcttttcgacatcaagcctcttacttagtgtgccaaaatccttcttaatattttcaaaagttgctctgtcgtttacgtccatgtcatctatcacaatagataagtgccgtatagatggcggaatttgcatagacattactttagtattacttatagaaagatattcatatgatgaaaccttcaatgctaactcatgtagtaggtcatgcatagtgtagtaaggtgacccatcttcattcacatcttttatgaaaaatccataattaaccaaatcattcaaatatctcaacccaatatcttcaattgttttgttttcatcctgggaatgtaaaatgccttgccctatccacaagtgaatcatctcctcactatcaaacttgtaatcttcagggaacaaagcacaatatgtgaaacattgttgtagatggaaagatagatagtcatagctaagcttcaaagctggcataatatcattttcactagtttgtgattcccattccttactttctaggaccctcatccaatcatccaaatcaaggtgatttctcagcaatctacccaccgtttttgctgccaaaggagagcccttaagttttttcactatcttttctcctgtctcaagtaagttagcatgatcatctattgatttgtcatcaccaaaaacacatgcttggaataattcccagaactcttcaggttctagcccttccaattgtattggtcgatcaaatgttttcaccatttctgcaaccactggaaatcgagtggtgactagaattatgtttccctttgtcattgcttttctgaggggagctaagaactttttccactcatcctcattatcacacttccacatatcatccaagacaagaagaagcttcttagatttcaatctttgctcaattgaatcatccatgtcgacatatttctcatcatccttgagtttaggtatccactttgagatctcttctttcaatctatacagattgaaattgagagagacgcatacccaaaccttaacatcaaaatggttatgtacttccttgtatatgtgctgagtgagagttgtcttccctattccccctggaccaacaattggaatgacggtcaaatccttgtcacagtaatcaccccgagtaatgtcctcaataattctacttctatcacccttcctcccataaaattcagggtctataatccctgaagtagttacaggacgattcatagcaacgttgcttggatgaactagcgtttgccctggtttccttgaaaattcagcattgatactgatggcaatgcatgattccaacagctctagattaaggattgtagagactttggcacatacgggcttcaattgttcgacgatgtgcttcattcttgtggacagatccaccctatcgaacttcagctttggtgttttcatggtagatatgtgcaaggcaccggagtcatcacaattgtcaagaccaggtgcaaaagggaagcatggaagtgtttaccaacgagatggatggtgctctgagcactgcaagcgaggatgcgcatgcagccgctgccagcaacagcctcctcttcgttggcgtggcgactcgcttcctcgtcaccaccgcacgagcaagaggcaaagaggtaccttcttttgatgtttctggcagtgtggtgagcgttgagcacaaggccaaggaaacagccgttggcatgctcatcggcggcctcgtaggggccatcgacctcgtcctgaatgcggaagtagtcgagctcgtcgagcacgtcgccggcatcataggcgaggccacggagctccaggagcagctgctgcagcgcggggttgctggtttctctgccacgggtgttgtgcagcatcccctgcgcgtagagcagctccatcttgatggcgccgacgtttggcccgagctccgtgctggccgcccacgcctccacgaaccctcccgacagcgggctcagcgccttgccaaccacccaccgcgccgggttcacggccgccgactccattgatctgtctggtctctactccgctagctaagctgaggagagtgggagggatggaagagctgtggactgcgaaagaacaaagcagtccaggagtagtagagaagggaatggtgaatagcgagcagacagtgaagtgaaggactaccaaaccacggcagaagtattgtttgttttctgaaccctctgttcgaactttaccaaatggggttctcaaaaatggatttaaaaaaaccaaagtcgtcctgctcttcttgaatctgatgccattccgtgccatttggaagataagaaaaaaactaaacgtctaatcagcccccaaaaccataattagaacgcaatagtaaaggtacaggcggtacagccaatggatttacttaaatctgttgcgattgcaaaggtgcataatgccagattcgccactgttcattcagtaaactaccgggatagagcaatttgcctgcatgtgggatgtggcacagaggaagaacagatctgataagcaacagcctgtgctgtatcagtgatcaaagtaggcatgaacagaaacctgcaagcaaccaaatggaagtaactgtagtgtagatgcagagagcttaaggaacatacgcttcaaagcgatttgcgctctgggggtgcaggcacacaagaagagtagcctcacgtacatcgtggccggcgcagcggcggcgatcgtgtggaggcgcgtgtgctcgttgccggagcaaggccggcggcgggagcggagcccctcgccgaccgcccacccgccgagattctccgtgtctaccactctcgagtctcgagtgagtctccgatggtcgagtccaaccccaacaaccaaacagtcccgcgtgcgcatgtatgcctccactccctaggccaccccaccacatgtacacacacaaataactctattaaaaaaaacccatatattttgaaacacctctattaagagaattcggtttatttttgtttcacaaaaaaatatttcacctagtatactcacaatgttttactgtgtatagatctaatgttgcagtgaactgaaatattccattgcaacaaaaaagcccacatattttggaaaccccctattaagggaattcgttttatttttttttccaccaaaaaatgtttcacctagtgtacttgtaatgtttcaccatgcctacactcccctggctcaccacgtgtccacacacaaacaactctattgcaaaaaaaaacccacatattttggaacccctctattaagggaattcggtttattttttgttccacaaaaaatatttcacctagtgtactcacaatgtttcactatgtatagatctaatgttgcagtgaactgaaatattccattgcaacaaaaaaacccacatattttggaaaccccctattaagggaattcgttttattttttgttccaccgaaaaatgtttcacctagtgtacttataatgtttcaatatgtatggatcaaatgttgcagtaaattgaaacattctttcgctatttgctgaaacattgtttttatataaggtgaaataacacccgatttaaacgagtgaaacattttcagtctacttagtgaaacaattccgatatacctggtagaacatcgtgcaacatttaaaaataattcaataataagctaaaaaaaattcgtcggaatatatccatgtgtggtcttgttttaaagatttaattgcaacgaatttaatggtgcaatcggatcatgatttggataagtaatttaagagaaaaaacagtttaaagtaattttgcacgtaaattggacgctgacgtcatgctgacattagcgcccgatttcaccccctcccgattgggcgcctgaccaggagtcgtcccatttcaggtcccttaacttacaccgaatcctattttcatcccggaaccgaaaaaccagatacaacaagtctctcaacttataaaaccggtacaaacaagatccctcaataatattatccctaattttaactcacatacacctacgtggctaatttgactaggtcttcgtcctacgtgcattgattgacatggcgcttacgtggtagtttaattcgggaaaaaaaatgaaaggagcaaaattgaaaactaaataattaaaacaaaatatggggtccccatgtcagtcaaataagataaaaatagtgggactcacatgtcgatgggtcccacttcctccacctcactctatctcctcaatctcttcaccgaggcagtgccgctatcgacgacaacacaccgaaaaggcagaggagatgcgaggggatagggtgggagccctgcccatggcgagaacgcagtcgaggtcatctccgtcgcccccaccgacgcctagctccttgtctcctctagcgacagggcgggaatggagcggcgtgctattaacaccaaaatttggtaagcccgaagtcatcatcggcatagagtcactatcggcttcagagtcttggaatcggccgatgggagttgtcaagtcgccagcaattgtgttctatatgaagtcggatcaattaaagaaaatttatccaaaagagtccgagttcaaggaggatgcggcatgacaagtatatctattaattaagaatagtatgttagttttcttttatctctagaaaagtgtgtttatgtttttcgatacctaatttataagcaatccccgttcatcatctaaaaatccaatcatattcaaaaccactttgccaataatctttaaatttaaaaactaataatctcactagtgaagtgaagtggagcggagagtaaacatactattgagtgagctgatatcgtcatatcatgcgcctgaaaaggtaaagaaaaactattgcaaagttaagaacctcttcctgatcaacaagtaatagctatttgctctcagaggctgagggcaaaaatgaagcttgcattcatatgatttaagaagaatatgtgttccaattatgaactgttaagaattaataactgaaacaagtgttacgaatagtagaagaatatgaaagatcaacaagagtacatgacttgtcaatgacacattgacttgtcttccttaaaacaatacaatctctcaaaccgtgtcattaacattttgcataagttttagttcatcagataactactttgcacactgagtctcagacatcaaatttgacaaggagctgaactaacagatcattaatttccgtgaaagcaaacaattctctcactgacagaacagctgaaagattaaaaaagagaacagtgacaaaataagtatataaccaaataaaggagcgacagcgaagaacttatatgagatgttagtgtagacgctggaagcggaacaagttgacgtcttcacacttatcaacacaaaactgtgtaggatgcaaaagattatgcagaggcgctagaataaggcccatatcaatccaagatgaaacctgcacagcaggttacaaggttgatcagatcgatgagtcaagcagtgcgtgcattttaccaaacagaaagtaatcgggtatgagttgaaaaggggcatgtttgttacctgtaccttggattattagtactttctgtcttggatgatcggaatggttcctcttagcttacggcactgtcttttgagctcctcgtttttgctctcactgacatctaatacttttagtgatctcggaagaccgcccttgggcagcaaacggatggctggacacaaggcgatctctaatctcttgaggcgggtgagcctgtgtagccctgttgggaggaatcgcagcttcgagtaacaccaaaatcggaggtcctggagagaggagaggagcagaagggccgcgttttgccccttggtgaagtgctccacctcgtcgttccagccaatggttagctcggtgagtgaggaagcgagaatgttgcagacaggggcaacaaggagccatgtgatgtcatccgtttttagttgcaataatagcgagaggtcggatccgacgaagaagttgggggacctccggacatctagctctttgagttggccatgggcgatgagagaactcaagccatcagctcttaaatccccaaagtcccatatggctaacttagcaagagaattgaggttagagaggggtgacagagtattcatcccactcatataactaacaaacagttcttgcagggaggacggaaatggggaatgatgcgaggaggacgagtaggaggacaagaaattggggcaattccatatattcaaattttttatggagtgcagaccttgtaatccttctcctacgcctctgaggcctcctgccgtgtcaaatactaatgccagctctgacatttccccgatagtcaaatactgaagttgctgaggtaagagcagcagccctccatctgcggctgctttctcatcctcctctcctggttcttgctgctcctgtccgagacattcatcctccaacttactaccagcagacggcaatgacgatgctgacattgctgtcatcccctgcttcggcacaccaagccctcttatattctcacatccccttattacaaacattgagagcttggggaatgggatgacaacagtgtcaattccttcccgctacaactacagttaaagatcctaagtttctcaaca

SEQ ID NO: 46184 - DNA, 21691 bp, Oryza sativa
atccaaggatttatgaccatgctcattaaccaatgacaactcccctataggcgggaaattgttccagtcgacacaattcagacgaagagatttcaaacctttcatggacaagttaacacccaaccatgatgggcaagtggcgccaccatgcccattaatgtgtagctccaggagattgctatgtggtttaagattttccaggatatgttcttcttgtgaaggatcatttgtcgaacgcttaatatcccaatctaatattagcttgtgtaagcgacttttgtttaaaagttctgcctcctttgctgccttcacattttcaagattatagatgcccaatgatccttttaggtcttccaactgccctagttgtcttaatgcaaatgcctcaacctgtcttttgacttcaaatctccttagttcttgtaaacatttcagctttcccacactagtaatgtcggagtggagattatcgtatgggacaagaaaatgccgtagccttacaagattattcatgtctcttggtaaaccaaagtgacccctgcattgttgtaaatcaaggatccttaagtgataaaatcttgaaatggtattgggtagactcatttctgggaaatatcccttattaatccttaagtagcgcaaatgaataagatttgaaaagttgtgcaacatattttccaccacgtaagatggtgcatacaacaagacgacgcggagtgcttttgctttgcttaacaaattaccaagaggaatgacaaagcttccatggtattgtccaaatagcatcacagagtgaagcttttcaatatccaattgcttatgcagtgtgctgaaatccttcttgatgttttcaaaagtcactctatcatttacatccacatcatctatcacaatagacaagtgccgtatagatggtggaacttgaatagatctcacattagaactacttatagcaagacattcatatgatgaaaccttcaatgctaactcatgcagcaaatcaggcataacgtagtaaggagacccatcattttgttcatcttttttgaaaaatccataactaaccaagtcattcaaatagttcaatcctatgtcttcggttcttgtattttgatcatgtgaatgcaaaatgtctagtcctatccataagtgaatcaattgctcactgtcaaagatgtaatcttcagggaacaaagcacaatatgtaaaacattgttgtagatggaaagggagatagtcatagctaagctttaatgccggcataatatcattcttaccagtttgtaattcccattctttactatctaggattcctgtccaatgatcaatatcaaggtgctttctcaacaatcttcctacagtttttgccgccaaaggggagcccttcaattttttggctatcatttttccagtctcttgtaagttaccatgatcatttactgttttctcatcgccaaaagcatatgctttgaataattcccaaaacattttaggttccagcccttccaattgtattgaacaattagttgttttaaccatttccgcaaccgctggaaaacgagtggtgactacaattatgtttccctttgattgtgcttttttgaggggtgctaatagctgcttccactcatcctcataaaccaaattccatatatcatccaggacaagcaaaaatctctttgatttcaacctttgctcaatcaaatcatccggccaaccagagttctcttcattgacttttggtatcgacttggcaatctcctctttcaatctatacacattgaaattgagagagacacaaacccaaatattaacatcaaaatggttttgtacttctttgtatatttgctgagtgagagttgtctttcctatccctcctggaccaacaattggaatgacggttaggtccacgtcacagtaatcaccctcaataacgtcattgataattgtacttttctcaccctccctcccataaaatttaggttctatgaaatctgaagtggtcacaggacgattcatagcaatgctgcttggaagaacaactgcatgccccattttcccagagaactcagaattcagactcattgcaatgcactggccaatgctgcggtttgattccagcaactccaggttaaggatggtggcgaccttggcacagactggttttagctgctcgacgatgtgcttcattcttgtcgacagatccaccctatcaaacttcagctttggtgttttcgtggtgtgctctatgtgcaatgctttgcagggataagcgcagcagaggaaccggcttctttctgtagaaatgtttcaacggtgatgaaggtgtcacagccgtcatgttcagttacaaaagagaggcgtggaaggtgttttatattatcgatgagatagatagtaagtagtacctcgagcattggaaaagagcttgtgaatacagccgctgcctgcaagtgcctcctcatcattggcatggcgactctcttcccattatctccgcatgagcacgccttcttcttgatgtttctgactgtgtggcgtgtgttgagcacgagtccttggagacagcccttggcgtgctcttcggcggcctcataggtgccatcaagctcgtcctggatacggaagtagtcgagctcgtccagcacatcctcggcgttgtaggcgaggccacggagctccaggagcagctgctgcagcgcggggttgctggtctctctgccgcgggcattgtgcagcatcccctgcgcgtagagcagctccgtcttgatggcgccgatgttggggccgagctccgtgctagcggcccacgcctccacgagccctccggacagcgggctcagcgccttgccgaccacccaccgcgccgcgttcacggccaccgactccattgctctgatccctgcaccgctagcaagctgggttagagatgagaagcaagcagtggcagacgtgtaggggagaagaggctggaatgttactctggctaagagagaagcaagcaagcacactggcacagcgaatagagaagggctaaggaaacgtcgtgcagactgcagagttgagatccgatcggtgtcagtctggctgggcaaattggcttgagtgtaacatgcttaggcactacggcactaccttgccgcatttttatttggaatcagaaatcagtaacatgttctccctgcatggcttgctggctgcaatcttcagaggcttccctatttttgcctgcagcaagaatgttagaaatgcgtggttttcgttccagtcatccagtgccggacaaagcaaaagtagttttgcaggcttacagtacatctgtttgctgtgcaagtactgcagaggcttcaaaaggaagaaaaaaaagaaagagagggtgttatgaaagacaaaatggcaaggtaacagttatacaacaaagaagaaacaagtgttggaatattcagaccgggaagaaagcacaagcattcaaaatttctcaataaaaattaaactatccttactggggtaatctgttttccatttcttataaaaacaagcaggtttattttctacaatgacacgccatatataattctctgcagctacagagagtgtatacaatgatagttaaagataacttaaactcacaagaatacacgtaccttttttttccttataaaacaggcagtttatttttttcatcaaagtcatcagaacaccatggcaacggaacagaggtgcagacgttgcaattgaaaacgagcatcatgccgcattccccggtttgttcagttgaaacgaccatgatctggcataggcctcatcttttcattgaacaatattaaagctgccatataaccaaataattgatgggcaacttgcccactttcaaagcaattaacatggctgtacaacatgtgctctccttgagcgcagttgactatccattaggttctactaataatcagaaatctccgatcagcatcagtattcattttctaacttcagtttttcttgttaccacttgtgacctcctcttggcttagaacaacatgccacattcaccaaacgccagagtaaatatcaagaaagcaacacctttctggatccactaaaccatcaactgcgttggctgctatctcttcatggtatgttcatgcaggttgtgatctccaggttgccattcatgcctgcaacatcagtatgaccatgatctgccacttgccgcttgtgcaggttctctccagaggtgccattgcatgtgtaccattgccatttcaacagcaatatttcaggcttcacttataacacctcatcttttataaaaactttgatcttcagctaccacatgcttgaccacttccctttcggctcttttggtacttacctacttatcccacataaacttcatatcatctccaaaaaaaatacaaatttgaatgtgtatttcttggaagctacaacttcagttgaccggactcctaggccgctcaatttgaaggaggtggtttctggcgcccccaaagcccaccccatagccaccctccttcccacctccttcctttttcctctcattttcctttttccctctctttctactccagatccgttttcttgcgtttttgaagtcgtctggcgacttggtggtcgtcgggctggcgagggccggatccgcctatggcgcccctggagaaatacggattggaaggcagctgtttagggcaatgtggcggcagggaggtgtgctggttgcgctggtcaccggttgctacttgcgtctcctgcatgcgtgcggtgggatggcggatcagttgttggtgacttgatggctgtcatgctgatgaggaccagatccactggtggcgctccaaaaaagcttcagatctgatggtggtcgttcagggtggtacggcggatggtggacggccatgctatggcggtaccacctgatggctgtcgaccgacgtgacagtggtgatggcattggtggtggccgagggaggtggcagtggaggcggttaccagtcggccttgcactccatcgatgtgtggtcgtgccatcgtggttgtggtggcagcgaggactggtggcatcggcactcctgatggcggcgacgggcagtagtgaagttgggtggtgtcgggggctagtcctccgatccatcccttcctctgtcaccggaggagagggctggtgatgacggatagtggtgggggctagcttccccctgcaacgacggatcaacaaataggtatggtgatagttgtggacttgtatttcggccatggtagtttgtgatgacgatggcagatgctctcggtgtcagcatcctagggatggcagcgacttgacgaggtccgatgcccggttctgaccatgaccaggtgaggacgagggatggtgatcgtcgatgacagggctagttgacgatgcaatggtcgtcggctcgcccaacgcggataaggacgatggcaatggaggctcttggtgatggcatcctagggaaggtaggtaccaagtgagcatcggcgccaaggtctggttgcggttaggggtcgacggcagtggagcatctttgacaagttcttgattgtaaaggcagcgcgtgtcatactaggcggctccacgacgctctagaagcgacagtgagatcgatcgtctacagagaagactggtggtgcggcaaggcggcttcgtgacgcactaagggtgttcaaaatgcggctgcggcgtaggtgttttggatggcgacggcggacagagggcataaatgttggtagcagatggtggttgtgttccgtagaggcagagatggtgcgatgataggtagctcggactagtttctattctcctctttccccatattgcgctgcgacggaaagaataagtcatcgatgaaggttggagctaaatcttctaggtttttttttgtgtgtgtgtgtgtgtgtttagagtctaagaactcatgtatatgttttggttgtgtatatcctttgtggatatagaggccggattaatgaaaaatccattatctaaaaaaacctacttcagttgaccttatagcacaatctcatgctgattcctttcaaaaacttcagttgaacttttctcctcttgcagggtacttctccctaaaagctgcggcaactctgaacttgattggcatatgcattgttgcctactcaggctaggcagtgaccttctagaacaatgcagcagataagcaaagaaggctaaaatctcaaaaagaatgtgattaatgtatataaataaaatgcaatataacttgaacaagtaatatgcaagtctctgctgcagcatgtaatgtcatgcatcatgaattttttgccgagacggccgaaggaggtcacccaaattgtattaaggagaaagagagttataagttttacattaatcgactttagacagtcgaggaaaaaaagcggtcaccatagggtgacgcctctaagagctcttacaggcactgattaatctactcgcttaaagatctctgcttcatgaatagaggatatgaaaatatggttgtgccataacttcattgattgattagaccatatgtatatgtcaacatatactgtactagacctgacgaatcctagtttgtgcaccatgcttggtgtatgccctagacaacctatgggggaaaaaatcaggtttctaaaatggaaacgtccaatggaacttctttatcagcttgagaatatacatatcttcgctcgtgaccagtacgataccagcttcgtccatttggcatgttggataatatcatttgagcaactgatggttccaacaaaagtattactgtctctactaattagtaagtgaatggctgacttttgaactaactgttcattgtgttcgatgaggatactaaacccagagatcaagacatgcatgaccacccaaaaacatgctactcatagcatacactgcatgttacagacaccgttttatatgttaatttaacaattcaaaacaaagtaagcttttacctgcattctggaagttaaaatggagaaatgaaggatccaatcataactgattgtatatgaagatattggatgtgctctaacagaagctcatgttcttaaaatagaacttccatgcagacattgtgtccagaactgaagatagtgtcaatttcaactaaactgtttacatggacatgggaacacaatatgagatctgttcagttgatcctagatagaataagggagcacagaaagcagcatcatagtcatgctattgaaaccaaaggaattcactattctacctcggttagttggttggccacttggccttaaacaaaccacaaatcgatgcgtactaaactgcgaactatttttctataagagctaagtgtagatgtagacatgaagaactgattgactgtatgcatagaaaaaaaggtcattgaggcatccagactccagaaaatgctagctttaaaaaaaatccccaaaaagaagagatcctgaaatcccctttctgccattgctgatgctgtaggattacttggacaattgctactgctaataactgctggtactactcccaattaagcgcacacaaatgaacctctcgtaaaatgtgcactacaataagcaataacacatgccgcatcagtaaccaatacagccatgaacagcgaagccaaaccaaaccaaacggaacttacgcttcaaaagcagggtggattctggagttccgcacattgctgccggggacgcggagcgcggattctgcgaagcccgtggaggcgtcccgcctagagccgccggagcgcggcggtggctgaggcgggcgccgcctcaccgcgtcgccgtcgaccgccatccgccgcgagaaggagccacgccgctcgggaggcccgagacggagagattttccgctccgcatctccagcatgcaaatgggccgggctgaaggcccaattaaggcctcactcctttccgacggcccagtatttgggctcaccaacctctcctatattgcactttgtctaccattgctggacagcagtttttgtatgcgaatgactttattagtactggcatatgtcaaagcaattatacgagaagttggatagagaaatgttaatctgcaaccataaaacatttttagtgcactttttttcttataagaacaattcagacggttcatatacaacgcgcacactcccacatataatgcacacctgtcacgtttgatagcaacaagatgccaacgtttttccctggagcttatggatacataaaaaatagaaagtcacccaagtcttaatcaatgatgcgtaatatttatgcgaattctccggaaaaaaaagtcagagagaatgcgttgccaagttcatgatctgcagccatcatcatctgatatttctttgtgcattgcggtatcgccgtccgtccaggctccaaaacagcccaagaacacatacgcccaaccaagtcatatccagcgtcccagaggcactgaaaattttcagaatcaaaatagatcaacaccccccccccccccccctctcactgtctctgcatccactcacctgatttaatttgaagcttcaatcaagcttcccgtatacatagagtacattcatatgcacagaactggattcaaactagttttttttagataatggattcaaactagtatacatagagtacatgtacatacagcataactgctgttggtacacacaacaggagtgcccgaatggattggctgtgcacttgtttagcagcacttctgattttctttttgattgcaacacttctaacaggatgactaagatcctgaaaaaaaaaacacatacaaaagggcatgtggataaataattggagtgaactcttttgttttgacaccaccaaggtgtaaccacaagacaattcaataagctcgtagacaactgctagtgaaacaacaaactgcacacaattctttagacgacactgaactgcagattttgtaccaggcaaggatagggatgaagattgaagaaactgtaccttgttacgaggtgattgcttgttattgtaggaatgacatgccacagccactgcaggcagcagaagaatcatgttctgaatgtttgaaacaacgtcccagcgaaaaaatgtttgaaacaacgaaacttgtgcgttgtggggaacggcgtgaaggccttgttctgggaggataactggctgcagggagaatccatccgctgcaaggcgccggctctctatgctgctatcccggctcgcattcgcaaaaaaagaacggtcgcagaagctctgtctgataggcggtggatcaaggacatctctggtgcccttggtattcaagccattcttgagtatttatccctgtggcaagacattcgtgcagtgcacctcacggaccagcccgatgtgctttcgtggagatgggaggggtcgggcaattactcttcccgatcggcttatcaagcattgttcctagggataacccggttccagtctaccccgatctggaaatctctcgctccacctcgatgctagtacttcgtctggttagtggcgcttaacaggtgctggacgggtgatcgattgaggaggcgcggactgccacaccccgaccaatgtgtcctatgcgatcaatgcgatgaaagcatcgatcatctcctggtcgcttgcccaaagtcccgctagttgtggtggatggcactgagggccattggacaaacaagttctctgccgacgaacgaagtctccttccacctctagctttgcgatagccgaaagagattgaccaaggcagctcggcgtggtttcgacaccattgcaaccctcgtcgcctggacaatctggaaagagaggaatagcagcgttttcaatcagcagcaaaagacttgggcggaagtggcaagggcaatggccgccgaagcagaactctggagacttgcgcgagcagccattccggagttcttgccacagccaactgtcgagaggtcgcaacatcggataggagaatagatcttttggggcaattgtattcctgcatctccccttcacttcttgtatttcctgtaagtaaactttttttccatccttaatacaaatatgcgctccttgcgtattcccaaaaaaaacgaaactttagcagcacctttcacaaaatatatctgaacttaaggagccgagcaaaactaagtcagctgatttatatcatgtgcctgaaaaggttaaaaaaactatggcagagttaagtaccttaccgcttcctgatcaacaagtgatgagttatttgttctaagaggctgagggcaataatgaggcttgcattcaatgataaagaatttttgcctactgtgaaatgttaagaattactccactgtgttaaattgaagaatatgaaagatcaaatgacatgcaaatgacatattgacctgcgttccttgaaacaatacaatctgtcaaactgataacatattgtataagtttcagttcatcagaaactagttattttgtacagcgagtctcagccagtaggcccagagtcggcccagtatcaaatttaacaatagcaagatcgtcgacggacagtgtcaatggcaggaggtgggctccttgcggatggcacaatagcgatgacatagcagagtactggagtagccagggcctgggggtagtttcagtggtcgggatcagtgttttttctgttgcacaggtcccggccttgcctgttgtgattgaaatcactttgtaaccttttctcctccaatctaataaaatttggtcggcgtccttcagccatgcccagcgataaataaattaccatgaaatcccacaattcttttttcgggaatacgcaaggagcgcattttttccattaagagaaataaaagttatttacatttgaaagaaaaaaaaacagcacgggactgatacaggacaataacagacaatcctaagtctatctctcacgctaattttggcgaccaaactccctcctgaattacagcgcaaggatcgccgggtttgctttacgccaaagagaggcttcgtccaccatccctctggccacatccgcccaagatctacactgctgattgaagatccgaccgttccgttccttccatattgtccatgctaccaatgtcaccaccgtgtcgaagcctcaacgatgtgactcacttagcaccattctgctatcgcacatccattggtgaaaagaagcttcattcaccagcaggcagttggggtggccgattgctctcaaagtccaccaccaaagctgccttgattctgggcagccgactaggatatgatcaatgctctcatcctgctgatcacagagaatgcagcggtcgggatgcggcaatccccgactccgcaatcggtcggctgtccagcatctattcaacgcgaccagccagaggaagaaatgacagcgaggtggtgccaacgagttctagatcggtgtggattcaaaggcaattcgtccaaggaacaaagctcggtaggtagattttgaagtgtatttgcttgagctttcccacttccaggagagtgagtcgggctctgcggaagaacaatcaactgactgaatcagcgaccaaagtttgaggtattcgagtattgcctgagtcccaagcgcgccacttatgtccttgatccatctacggttagacagcgcttcagccaccatccggcgcttccggatacgagtagagacatgatcgtagatggagggtgcaatagctcggatggttcctccttgcaaccaattgtcctcccggaaaaggattgtttgctcgttacctagctgacagacggtggaggcggcgacaaggtgaagttctttctgtgtgcaggggattaaatcccacaattctctcactgccaatacctattcagaacagctgaaagattgcaaaaagagaagagtgcgatcagacagataaccaaaaaatgagcatctaaagcatcagatatgaactcgtatgaaatgacagaccagtttttgtacacgtgatggaagcagcacaagttgattatcaactcaatggagatggatgcagagaagattctccaagactagaataaggcacatactaatccaagaaagaatctgcacaggatttcagaacaatcaggtttttcaggtagatgaatcacacagtattaacgttgcgccaaacagaaagtgaaccgggatggctcaaacaagagaatgttcattaccaatcaaatcccagtcgctgtctttgatgattggaatggttcctcttagcttgcggcactgccttttgagctcctcgctgcctccagagacatctagtatttctagtgaacttggaagaccactcttgggcaacgaactgatgaactcactgcacgagatctctaatctcttgaggctaacaagcctgtgtaacacagaggggaggaactgcagccggcaaaaactaaaactgagctcctgaagggaggagaggtgctcaagggccatgttttgctccttggtgaagcgtttcacctcgttattgcaaaaaatggttagcttggtgagtgagggggagaggagtctgcagatgggcacaacaagcactcctgcgatgtcatccgttacaaggtgctgcagtgatgaggggttgatcccgacgaagaatttggggttcttgttgactcgcagccttgtgagttggccttgggcgagcagagaacacaaatcctcgcctcttaaatcaccacattctatgcctaagttggtgagagagctgaggttagagaggagcgacagagtctccatgccacttacacggtcaatagacagatatttcagggaggaaggaaatgggaaagatgaggaagatgatgagtaggaggagaagaaatcagggcaatcgataatagtcaatgatacgagggagcgcaggccttgtaaccctccttctatgcctcttaggcgtccttccatgttttctccaagtgaatcgtggtggaggatcagctttgagcaacaggagatgaacaactcctgtagctgggtaggcaagagcagcagtcctgaagatgccgctgctttctcgtcctctcctcttggctgttgttgctcttgtccgaaacgtgcattctccaacttattaccagaaagtgatggtgaagatgccgatgttgccgttatctgctgctcagccacaccaagcattgctatcttctccaatctatacattgtcaagtcagagagtttggggaaatgggacagcagcagcgtcaattccttcccgctagcaccacactttctgatcacaagtttctttactggaaactggtatctaacagcgctcccaccttcaaccatcaacaaggaactacttgaaccatttatttcaagcttcttcaaacatgataacatctggaggtgttccaacggcaaaaaagggcattttgtcaagatcaaatatttcatctcagttaaattactagatgcaagtacttttgagaatgcacaattcagatggcccttctttcccgcaacccacaagtgtgatttagattggtataaatttgagtacttcaagtgctgaaaatctgatctcacttcttcaatcagagcacggcatggagagtttgtccaaggaacgggaggcaatgatgatagcgttgggcattttacgatatcaagctcctttagtgtagggaattgagtgctgtccatctttgaatatggcaactctataagttttgggcaatctcttactatgaacacttctagttgagagaacacacgggaagcatcatttccggtccatttttctagtcgcggtatgccaactagctctaacctttttaaattccaaaagctttgggctttttatacaactcaaggatttttcactgtgctggttaaccaaccataactcccctataggtgggaatttgttccagtctagaccatgcagactaagagattgcaggcctttgattgacaagttaaaacctaaccatgatgggcaagtggcacctccatgcccttcaatttgtagctcctgaagattgttatgtggcttaagactttcaagaatatgttcatcttgggaacaatcctttgttgaccaatgtaatattaacttgtgcaaatgacttttgtttaaaagttttgcttcgtccgccgcctgtgcattttcaagattataaatgcctagtgttccgttcagctccaactgtcctaactgtcttaatgcaaatggctcactttgtcttttcactttaaatctccttagttcttgtaaacattttaacttacccacattagcaacgtcagagtggagattgtcatcggggacaagaaaatggcgtagccttacaagattatctatatctcttggtaaaccaaagtgaccattgcattttcgtacatcaaggatcctcaagtgataaaaccttgaaatggtgttgggtagccttatttctggaaaatatcccctaataatccttaagtagcgcaagtggacgagatttgaaaagttgtgcaacatattctccactgcatatgatggagtagacaacaagatgacgcggagtgattttgcgttacttaacaaatcaccaagaggactgataaagcttccatggaatcgtccaaatagcataaaagagtgtagcttttcaacatccagtctcttacttagtgtgctgaaatccgtcttgatgctttcaaaagtcactctatcatttacatccatgtcatctatcacaatagacaaatggcgtatagatggtggaatttgcacaaaccttacgttagaactactgacagcaagacattcacaggatgaaaccttcaatgctaactcatgtagtagatcatgcatactgtaataaggagacccatcttcattcacatttttttttgaaaaatccaaaatcaaccaaatgattcaaacaactcaatgctatatcttcagttcgtttgttttggtcctgatgtgattgtaaaatgtctagtcctatccataggtgaatcaactcatcactgtcaaacttgtaatcttcagggaacaaagcacaatatataaaacattgttgcagatggaaagggagatagtcatagctaagctttaatgctggcataatatcattgtcaccagtttgtaattcccattctttactttctaggacacttgtccaatgattgaaatcaaggtgatttctcaacaatcgacctacagtttttgctgccaaaggggagccctttagttttttggctatcatttctccagtctgttgtaagatagcatgatggtttattaatttctcatcaccaaacacatatgcttggaacaattcccataactcttcaaattccagcccttccaattgtattggacgataagtcttttgtactatttctgcaactgctggaaaacgagtggtgactagaatcacatttccctttgtttgtgcgtttctgaggggtgctaatagccttttccaatcatcctcattactgcaattccacatatcatccaagacaagcaaaatcttctttgacttcaatcttcgctcaatcaagtcatctaggtcacccagttgctcattctcatctaggtcacccagttgctcattctcaactttaggtattgaatcagcaatctcttgtttcaatctgtacgcattgaaattgagagagatacatacccaaacattaacatcaaaaaggttctttactgctttgtaaatttgctgagtgagagctgtcttccctattcctcctggaccagtaattggaatgacggtcaggtccttgacacagcaatcaccatgagttatgtctttaataattctatccttctcacccttcctcccataaaattcaggctctatagtcgctgaagtggtcacaggacgaagcatagcaatgctgcttcgaatggtgcgatttgattccggcaactctagattaagaatggtagagactttggcacagactagcttcagctgctcagagatgtgcttcgttcttgtggacagatccaccctatcgaacttcagctttggtgttttcatagtgtcctccctctgtgatccccactgtttttcttttctaggcatgtgcgttgcagtagagctgtggtcgatatcagtagagccggtgtcgttgtcgtcttcatcggtacagtcgtcatcggcatcatgttcaccagctaaagagaggtcactgccggcaacagctttctcgtcacctccgcccgagcaacaagcagaaaggtacctcttcttaatgtttctggcggtgtggcgggtgttgaggaggaggccatggaggcagcctctggtgtgctcgtcggcggcctcgtcggtgccgtcgagctcgtcctggatgcggaagtagtccagctcgtccagcacgtcctcggcgtcgtaggcgaggccacgcagctgcaggagcagctgcttcagcgcggggctgcgggtctccctgccgcgggcgttgtcgagcatcacctgcgcgtagagcagctccagcttgacggcgccgacattggtgccgagctccgagcaggccagccacgcctcgacgagccctcccgacagcgggctcagcgccttgccgaccatccaccgcgccgcttcaacggccaccgactccatcgatcccaacgtgcgctgcagccggaatcgcgcgagctgcacgggcgtaggagcaaagcaagctgcagcaaactggtggaggagtagtggataagtggagtacacaagtgctagctgaacagctcgtcagttcttgctggcaatctcaacttgtttgttgttactactctgcagtggaggacccagcatggcagcatcaactagtccattggttgctacttgcaagtggaaaggtaatgtatctgggagatctctcagttccttcggtgaattacctggatatggaatttacctctcgtcactgcacaatcttgaaactaccgcctgaggacaccagttccagaatgcaatagcttgtcaggcttgccgacagaagtgtgtcgttccatgcatcatctaactgcaagtctgcaactgatactccctccgtcccaaaataagtgcagttttgcactattcacgttcaacgtttgatcgttcgtcttatttaaatttttttatgattagtatttttattgctattagatgataaaatatgaatagtactttatgtgtgactaaatattttcaattttttcacaaaattttcaaataagacggacggtcaaacgttgggcacggatatccatagttgcacttattttgggacggaggtagtagtttgattggacagctccatccatccagtagaactcttgtttgcacaatcaagaagaacatagcccgatagatccaacagacagttaaccaggctgcagtgtgctctgggtctctgtgcagaataatgttttctaggttgccattgttttctgcagctccagaatgccagtggtcttgatcaagcaggcatgtgcctgttaaaggctgtctaagcaggtgctccccaatgattgctggtgcaccatacggagtaggccttttgcaccagcagcatttggcttcatttgcaatgccttaatatttgagaggagctctgctcttgaccaatagcagctgccatttgcttgatccacagagccctttagggaggctcttatggtaatgatcccacacagtcttcgtataatctccaagaatcagatgtgcatcagtgcatgtccaagtcttcgaagctgatattttggttgccattttctccacctgtttccaaaaccttgatgggcacttctaacctgacaaatcctagttgtgtgccatgcgcccatgcttggcataatggcatatgctagaaatagaaccacacacacacgcacgcacacactcgaaaataggttttcaagaataaaacagtaagaagattgtcattagcttgcaactcactgtctctcctaaatcctagtcagtgcaacccattgcctgacttgtactaaatggttcatgaggattgcctgactcgtactaaatggttcctgaggatactaaaccaagtgtgaaaaagttataagccaaagtttgaaatattgtgaggatcagaagtctatatccttacatgctccagttgatcactaaggcactaaacactcaatagtaagagcatacactgtgtattaattgccgccttctatattctattttaccagtttattttttagaaaacgggtaaaaccgggcctctacatccaacgcggatgtatgcaaccaaatactttaccaattcacatcaaagaaaccttaaaatgcattctgtagtttaaaatgagaaattaaagccatgcagccaatcataactgcatctatataaagatattgggatcgatagacaatggccattgggttcagatagtgcctatttcagctaatatgtttacatgggagaacaatatgagagccattcggtttatcctagactgaattgcggatggcagaaagcagaatcatagtcacggtatggaaaccaaaggaattcgctcttgtacctcatgtattaactatttctctaagctaaaaatgtaatgaatcgtccaattgcagaaatgaaccatcgattttatgcattgaaaaaaaatcactgagacattctagctcctaggacatgttagcttgtggcacctaaaaattccccaaaaggaagagatcccaaaatccaatcccttgattcccttctgcatttgtagatgccaggtttacttgcgctgactactatcaaacatacacgtgaaagtaaatagcaaaatggacatcacaatcaaattcaataagcaataacacatcctccatcactggcgcatgaacagcaacgcggaaccaaacagaaaccgctgccataaatgggggagatcaacatacccttcaaaagcggagtggtctctgcgggcgctcgcagcaacagcctcgcccacacgttgctgccggcggcgccggagcgcggcttccacgaggccgtggaggcaccccggcccggccacccgccggagcgcggcgagacggaggcggaggcagaggcgggcgcccacctctccgcctcgccctcgccggaaggaagccagtaaggctggaggcccgtgaccagagagagattttctctcccgcgtgccaacgggccgaaactaagtggcccacgttgaaggactccaatcatccggcccagtatgtggggcccacaaaccgcccggttgtcagcatgggccaggaaccgccatgcgggccccaccctcctcgaaacccgcgtcgagtggggacacacggcgttggactggcccgcgggtgaaaaggccacgtcgagccaagccggcccacgagggcggcgacgacgcgttggcgttggtgcggcggggaggcaacacgccagctgtcccgtctccttccggccggcggcgaccgtgcatgtgactgacgctgcaatgcccgggctgtgtctgtgtgcaccgccacgccacctgtctctcgcatcaccgtcacgtcaaggggatgcatggctagtggggtccacatggaggtggcacagggaatatcggcctggtctactacgagtaatctcctccaatcatcgctatctgatctgattaagcattagcagatgaaaattgctatgcatattatcccattatttgatggggatttgattcatgtagaatttgatcaatggttataaatgttgtagagcatttggataatctatagttgcgtgtttatgttcgtacatgagcaagatttcgtattcatgcttgcataatggcattgcacatttgcgtgcatcggcgtatgctgcgttttacgggtgccatcgtttggcatatcggtggaataagtcaaacggcatatttacaaacgaaaagtaatttgtgaataaaatttttatatatgtattcttagcgatctaaaagcaaagactgaaaaatatacttcgatgaaaaaaaatcccaaatcaactcaaaatttaacgttgaaaattcaaattctgactgataagcatatgaatatgctaaacgatggggaccgtagtattgtagtattgttcttacatggtgtttccagtcgttagcggtcagaatccggttaaccttaccaactggaaccaggatgtctctcctctgtgcagcgttgaccgcatgttaattgcagcatgttcctgtgcctggtgccagagaatttccgcagacaaattcaatccatacaggtaacggtctagaccaattcgcaagtactactagtagtagtatagttctagcaaattattttccattttagaattgagattattatacagtacaggaaaatacatagttgagaccaaatcgtacgtgcagggcagattcggccataactttcacacaattggagtacagtacagccgtgcatgcaaatgaagtaggagtaagtcttgtccacatcgtactaatactaaaaatctagctgtacttccactactgggatttccctgctgcttcctttgatggcaagatggaaaccggccggtgcaccgttttccttccagatttgcacgtaccaccacccacttgatcgtcttcataagacagtttttactaataaattaatttttatttcttaataaaccgttttagtattactagaaaatatgggtaatcgatgaggctataacctaatacaaaatgtcttaatacaaaatgtcttaatatttttagcattgcaatgtgttatattttatagattagttttctattattttttctgttttataatatatatatatatatatatatatatatatatatatatatatatatatatatatatatatatatgtaatgctagaaaatattataatatgaaatagggggagtacgcggcagacggggaggagaaaaaaaaatcggtcactaatcagaagtataagacgaggagatcctgctacttcttccccatcaccaccaccaccaccatcgctttcttcctcctcgccttctgcttctgcatccatccatccatccattactcgccgaagacttcgcgcggggagagaggaggcaagcttggtcgcgggaacgcgggaagaaaggtccgagcttggaaggagaagaagaagtagccaagaacgcgagagcttggaaggcgagctgcggtggtgtagctagccaatgccggcggggaactggtagggagggggatggggggagggggcacgctcgtcgacggattccgccgcctcttccaccgccgcacggcgtccggctccaaccagtcgtccaacgccggcgaggaggccgcctcctccgacctcgaggtcgccgacgacccggatctcgtcgccctccgctccatccgcatccgcgtgcccaagcgcaagatgcctctccccgtcgagagccacaagaaggtgaggaggtgcctagtgtgaagtgtgctttgctttgcttcgttttcttttcagtttgggggtgaaatgaaagtttcaggctttctcgtgatccttgattcgtggccacgaggggtttttagattagatcagatcttcgtggcccttgaattactgcatactgtccaaatccataatttctttttttctatgatctgtgcaaagtgcaatacagctcaagtgcaggtaaagcttgcgtgttctatccaatctttcttctttcgatggttg

SEQ ID NO: 46185 - DNA, 3004 bp, Oryza sativa
tgaggtcaaaggtctgatgaacctggcaaaagcagagacagatttctgaccacagaaccttcatctcagtgcagaattttcaaagactgcatttctattgtacagtaacatttccctggaaagactcctttacatatgatcagagacaaatgaggctttggcaaatgtaaaacaatgaagttccacctttgaaagttgaaacccactagaaaggagacagataaagcattatctatgttgagcatatgtttggagtactaaggaggaacttagcatctgttgaggaatttagcatctgttgttgttagagaagaaaataatgagaaaacctgtgatcaaagggattcgaactcaagcaagcatgctgcttcctgtcagccgagctctccctgccaaccaagctaagtgccgttcttttctacataagtagtagacgaaactcagctggttttaactgcatagacaagcattttgctgtccttttgtcagtaaccatgaaatgcaacacacggtcacccttgagctggtgagacacagctatcagccacaaagcagatagtactttgcttacaggagatgattctggagtgctttctttttggtttcggcagctcaatgatcccaccgtgaaaggcgaggaagcaacagaaatttggtagctcctccaaagtggagattatcgtggaagctgagctgtttccaaatcccaatactacacctactaatcgtctcttatctgaaagataccactgatcatttctgaataacgaaaaaaatgagaatgtgtaaataggcaaagttctatgattaaggccacgattgtcggttatttgggcgttttccacatatgattgatggcatctaatgatcacatttctactgattatatctctgggtcggttcagtaatgaggaaatgagagggaaacggctccttcaagttgttttactgtcttgtcgtgcagtctttttcttgtgggaaacagttcaacaaccactgcagcttgttgggtacctgggttcatggattcttttaagaccttttctgtggtggtcttgtttggcagtgcttaccttaaagctcttgcaaactggcttctcagatgaactctgaatatttcgttgtctgtacaggtagtgtttcagtttaccctatgagctacaactaacgacataatgtcagtgggtgcttaaagagactagtctctaggtacttttaaggtaatgtcagacttccgactgaatgcatatctgaaaactatgttcttgattgagaacaaggggggcatggttaaccatttcttttttgtttcagaaaggccagattggtatagctgaaatttgtttttttgctcattcttttctcgatataagttgaacattgccttgttttacaaaattgctcggactattcagatttacatactattgatcgtcatctcatattattgatcatcaccatttgcttggcaggttgtcagaattaaagactgccaagatcttggaagaacactattggtggtggcaaaagtgaattgttcatcactccccacaaacaaataattagcatttttcatgttgacattttatcgacaacaaccaatttacaaagtgtgcaagtgtaaattaacctttggacacttgtctatgacacgatcttactcgtctcctcctttttatcaaaaaacaatgaaagaaatgaatctcaccacaagaagaagaaggagaaaaaaagcgaatcaaaaacagaagagctctcctatctaccatcagcatcatcaagatccccagccatggtgtcagggctctggcaagaagtcgcgcgcccgttccagcgtgttggtgagcttggtgaggttgagctccacattctgcttgtccaggtacaccgtcttgatggcgtcccagcctttcttgtgcacatcgtatggatgctggatgtagaaatggtctctcgggtagagctctctcagcgagctctcgtcgaaggagacattgtactccatgtagttgacatccatgtccttggctggatccttgaaggtgacacgggtgagccattcgagccccccgaatggcaccacctggatgagcacggcgcggctggggaggaacaccatgttggtgaggccggcgccatggacgcccatcatcacgtcggcggagttgacgaggcgcgcgaagttgggcatgtcggtgtggttgtccggctcggcgatgcgcacgtcgaacctggcgagcgcggcggcgtgcgccatggcgcgctcgttgaggaagcggcgcgagctcttgcgggagatgatgaggaggcgcggcttgtcgcgccgcggcgcgcccgtgcgcgacgcgacggcgcgctccaggcggaaggtgcggcggaggaggcgcttgaagtcggcgacggtgacgccgcccggggagcgcgccgggtcgatgcccatggcgcggtggaacgtggcgccgatgaagatccgcgggaagcagtgcacctcctggtcgttgtcgacgtcgatgacgtcgtaccgggagagctgccggaacagcggcgtgaacttgtcgagccaccaatccttgatcccgctgagcaagaactgcacctcgccgccgaagtggttggtgctggtgaagagcgggacgagcacgtcggtgtagtcatggtacaggttgccggcgaagccgccgctggagaagaggaacgccgggacggagtggttgcgcgtgcagagcggcggcacggcggtgtggttggcgccgccgaaggggacgagcgtgactcccgcacgtcgtccatggcgacggcgtcgtggaggcgcgcgtacgcttggttctccactccttgtcgagcgggttgatgtagatcttggagtggttgccgtcgacgcggatgtcgcccacggcggcgcaccgctccgaccgcttgctcgtgacgtagcacgtcggggcctggtcgggtcgaagtcctcctcccctatcggccccgtcatcttgtacctcgtgctgtcgta

SEQ ID NO: 46186 - DNA, 4098 bp, Oryza sativa
atcaagaacaaggaggaggaggaggaggaggaggaggaggaggaaaaagcgtacggaagggggtggagcgtaccgagccttgatgtaggtgaggacgcagagggagaggagcatggtgatgaccatggcggcgttgcccatccgccgcggctcgggcgcccccgcgccacatgatggtgcttcatcggcgccgggctctcgccgcgggcggcgcgcgccgcaggtggtggtttggtttggatctgaaggaagcaaaaacgatcgggcgtgagcagcagagagaggttagtagtattaaaggcggggtcggggtggcgtcgcgtcgagtggatgatggcgaggcgatggcaaccagaggttggtggcgtcgtgtggtgggtcggagctcgcaacggcgcaaccactcactacaagcacaagcagcagcagctgctgcacagtgcaaacggcaaagcagagcaggcagctacagctacaggggtggggacgagtagacaaagcagtggcccagctagcgcaccagtgcaccaccaacaacaacccgatcgccgatcgctcgccgtcgattggccgaggcagataagatcgcttattcacagatgtactgcagtgataaagggtgtatggtttcaaggctgaggtacaatgtttaacctctacccctaacacgttcataattttttttcttaaaaaatgtttggaggcagcgcaaacgcaacaacgctttgttgttgatgggtacgtggttcaacaaaaaaatcaaaccagttaagcttcgttcacttttcaattttttttttgggacgctccttccgtcaacccggtgtttttctttgcgtcgattatatgtgatgttggtgaagaaacggtcgcctgcctcgtgcttcatgacgagaggtaggttggttcattcacgcgttggcgttggcgttggcgttggctacagaatggtgatcacaacagattcacagatctaccaaacgtttgagcctaccaagtacacgtaccaagctgcagcgacacgtacagcagtgtggaataaatggcataaaaatgtacagcagatggtgcctgattaattcagagttgctcgcggcggcgccgggcagcgagaggaacactcgtgtctcaggcatgttcatcctcaaatctcaactgaatttttgtcaggatgctgcggtgtcaatgcacgcgcgctcacgtgtttttcccgtttcgcattggctttcaaacgccggaatccaacacaaccgggggctggattaaattaaagttgactccttctttcaaccatgatgttaatttgctaaattgatcataaatcatgtactagtaatcaggcatagagcttagcttgtacaaacctacaagcttaactgcatagtagtggacacatgaaacttgagggagaaaaggaacccatttatccacccaattagttgctcggtcattctcatcaacctgaacgcaagaacaaacctgtatatatgcaaccacttgaccaatcactcgacaagcaatgccaattcatgttctccaatccaatctcaccaaatcgagaaccaacattttccaacgacaaaataatacactgaacctatgcctgcatttggaattttggatcactcgttcagttcttgcaccgttttattaacctgtagcgatgtactaccaccatctgtttcagggattcagaaaaagaactgagagagacagcggagcttactgtcgtcgttgctacgatgaaaagggttgctttcaagtgtccatctctgtggcaggtgaatggcttctttatataagtcccaaatggatggaccatttgccttggatctttgctttcatctactctctgctctgcctctatttctccttttgttaattgacatgtccttgttaaatacttaactatgtagtcgcactgaaaataaaactgttgcttctgatgcaaatttgctagagctggctacagaatgggccttgcttgatgaattgaagcaaaagcaacattgctagcgacttggaggaattgggaatataagatgttgctcgatcagacagccatgaactcccagcaccaatgccctgggcagcatgtgttttgtgggggctatctcgtacaaattggccagcgatccagcgtaccaaaccgatttgtcgtgggattaacaatcagtcgatcacaaggctacaaaaaacggagttaatcaaatcgaagactgcgtctgcgttggtcgtttcataatcacgttcgacaactttccatgtgtgaataaacaaagtcaatcataaggggaaagcacctttatcataaaggttaaaaaatcatgatatatgattacacacagcaggttctcaattttaggtctgttcactttgatgtaaaaaaacattaccaaattttagcattaccaaaatttggcattaccaaaattttggcataggcaggattttttatatggttaccaaaatttgacagcaaactaaatgcagccactttttttacagctttatcaaaatttggtaatgttgaaaatggcatcaaagtaaacaggcccttagcaacttgccaatattttggtaggatttcttatataattaccaaaattcagcaacaaactaaatgtagccacttttatggtaactttaccaaaattggtaaggttgaaaatgacatcaaagtgaacaggccttttttttaaacaaatgttctcaaaatttatggattacatattgatgtgcctattgaggatgtgttagagatacgattacaaacaagtattccttccgtattttaatgtatgacgccgtttactttttgaccaacgtttagccatttgtcttattcaaaaaaatgtaattatcatttactccatccgtcccaaaatataacaacttttagccctcaagatttgtcccaaaatataacttctccactaacattctctttccaaccaatcacacccctccaccattcactttcccacctacctccattacttaaccaatcacaaccatttatcattcacttctacctactttcttaataaccatgtccaactctaaaaatacttatattttgagaccgagtaatattttattatgacttgatttatcatcaaatgttctttaagtataacataaatatttttatatttgcacaaaaattttgaataagacgaatgattaaacattggctaaaaagtaaacggtgtcgtacattaaaatacggagggaggatgtacttacatgtgatgatgatgtgtacgcgtatacatacaagtacattcttacttgcggcccatgttggttagacggtcgtaacgggattacgattttgtgaagcccaagaactagattgaggtcctacgtgcgctgggctttcctcttacttgcggcccatttatgttgggctgtcaatttatgggcctcattttctaaagtggctcaatgaggcctagcaaggtttatcacggcgggccatgaatttgggatccgggcctttccaatgcttgcaaaataaaggaataagatcactttgactccctcaactgaccaacgaatctaaatcgtatccctcaagcgcaataccagaaatcttatcccctgaacttgtaaaaccggtgtaattttactcccttggtggttttggatggcggtttcgctgacgtggtgcacacgtggcagtgttgacctgatctttgttccacgtggcatttgacgtggcgtttatgtggcattaaaataaaaaaatatatgcggggcccatttatcattcacacaaaaaaaaattgtgggacatgtcatcttctctctcactatccttcttcctcctctctcccttatctctctctctctctccccttgacaagagccgatggcaggcgggggctcggtggcggcatcagcgagtgggtgcccggagtggtggctgtggtgggcggtggaccttggagcaatagtttgcacgccccaacgcgcggggggggactggcctcgagcgctccggcgtcgacctggccatgatgcggaacagccactggagctcctcctcctccgacacgggccccctccccgaccacgtacgccgcgagaccg

SEQ ID NO: 46187 - DNA, 3419 bp, Oryza sativa
tccccacgcaggaagagaaagagggagagatagagaagggaggagggggaggaggaagaagagataggagagggtgacctatgggatccacatgtcagtgggtcccacaaattttttttgtgtgaatgacaaatgggtcccgcatatatttttttattttaatgtcacataagcgccacgtcaatgccacgtggaacaaagaccaagtcaacactgccacgtgtgcgccacatcagcgaaaccgccatccaaaaccatcaagggagtcaaattgcaccggttttgcaagttcgggggtcaatatttctggtattgcggttgaggtatacgatttagattcggtagtcagttgatggagtcaaagtgatcttattcccaaaataaaatcccttctttgcatgaatattgtgagtttcaccaatactatcactgaatattttttcagtttctacgaaatttgatctgttttgcacattaaaactcacagatggcactggtatcttgaataatgaaccagattagtacattgtgatcctgacagggcaacctgtcttggccacaactagcaatttgttgttacaagaggtcaaccagagattgacctcgttctcacactgacaagcacatccatttttacaacttattgcaaacaggtcaacaagacgttgacctcacccacgcattcggaagctaaaaaaactttttacaagcagcaagcaggtcaacaaaaagttgagctgcagatgctgaagaaatgaagatatctgaactttgtctgaaaaaaaggaaaaaactctgaacatttcagaattcagactgacggattggcgttcgtcagttggtgcaggaagggaagacccacaccggcggcggccacttccagagcaggtcgcgcacggcgccgcgtggcaccttgtagctcccgtcggcgaggtcgagcacgccgacgtcgggaaccacctcgtggcacctctcgtgcgaccatggcccgtcgtcggtgaagtagacgcagttgcccttcacctccgggcagcaatccgccgggacgcacagcgacgcgctcttgcccaagaacagcgcgcgcccggcgaggatgccggcgccggcgccgtccacccgcgcccactcgccatggccgccgccggcggcgttccactcgaagagctcggccttgacggtggtgtactcgacgcgttcttgccggggctcccacttggaccgcgcgtgcgccttgtccctgagccggtgcacctggagcaggtgtcccggcgagagctcgacgaggtatttgctgcaggggatcgacatggagcacgcgcggccggagcagcagcacggcggcgcgatctccctgggcggcggcggcgtcgtgcccgccgccgtgacgtccatgtcccatgcctcgacgcgacccacggagtccagcgtgtacaccgcttggtgcccgtcggcggcgggggcggaggcggcgcgcacggcgtcgacccagcatcgtgatggcatgtcgaggagagtccacttcgtgtcccctgctctggcaatggcgagacggtacagtggctggcagatgagcagcacggcgtagccgccccaagaccccggcggcgtcgtctgcctccgcggcggtgcaacgaggatggccttctcgtagagctcgtacctgagcctgtccggcgcgaacgactccggcgggacgagcacctcgtcgccgtcgttgtctccatcgccgaagcagcagcggaggtcgtagctcgcgacacggccgtcggcgtcgcggctggcgtcgacgaagggcagcgtggtgaccgagggtagctggacctgcgcgccggtgagcgggttcaggaggtggagctcggaggcggcgtcggcggtgacgagccacccgtcggacgagccaacacatagccgctcagacaccggcggcgccggctgcgggatggcgtacgccctgccatcggagaggctcaagaacctcgcctccaagaacctaccatccccaccgccgccgccgctcgggctctgcctgcgcgccgtcgggttgaacgggagcatgagccacggcggctgcgcggcgcgaaaccgtgcggtggcggaggccgcatcagccgactgccacgccgtgcacacgccggggaagcggaggcggtccggcacggggaggcggccgagcacggactcgaggaggtcccgcgggaggtcggcccacccaggccgcctcaccgcggcgccgactagcttgttcatcgccattgccagagcagagcaaagctcgatcgcatgacaaggaggagaagatcagaggaggaggaagaagaagatgagacggtttgcttgttgggattgcaagaaacgcgaggcgaggtcgcggcttaacaatggccatgtcgcgccgttccgacgtgcggcgcggcccgtgtatttgtgggatgccgcaggcgcggcggtcagagacggctactagttttgggtgcggtcgcagcatgggactgagagggagagaggcgggtggtgcgaacgggaaggcacgcgaacgcgcggcgtgacacggtgaaaatcccgtgggcgctggtggtaaaacgtcgaacaggtcgtcggcgcgggcagctgattttggacgggatgatgagcaatttggtcctccaactttcttactcgtctcactttggtcctaaaagggccaatttggttcatgaacttcttcgctttttgcccttttgtttcagatattttggtcgtccagatattttgtcgattgttaaatagatgaggcttatagaatgtagtgaaacttgacatttctaattattagtatgtaaattaaatgttaaggtgtagtatgtcaaaatattcttaatagattcattatgtggttgtagtggtggttttcgtccagtttccctaattaattgtgcgttgtatggtttggtttcctttttttttaaaaaaatgggatgtcttctttatataaaacattggcaacaaccaaaccgtttgaaaaaaaatggattcattaacggcctgtttggttggagggagttggtgatggggaatgggagtttatgatatctgggagtttaagtctgtagtttggttggaagacttgagaattcgagggggtttaggatggggaatgatggggaattaaaatgtcgaattcccaccaatctcttacctgggagaggcatgttaattcgtgagacttggagggaattcaatgtgaaaccaaacaagggatgaggactaaaaatgtaactcccatgaccaatcccaccattaactccctccttgaaactcccattcctcttcccttctcttgccaaactggccgtaagcactggagtagttatcttcaataatttttgttcacaaattattataaacattaatgatcgaatatttgttttgagactatgtag

SEQ ID NO: 46188 - DNA, 1246 bp, Oryza sativa
agtatatcaaagaaggaacaagaaccaagttgataaggtgacagggaaggagcaagtgcaccagaggagccaaattcagaatcagggggagagaagtggtgagcctatgcaagagcaagacaaggagtcacaacagctgcagcagtttgagtacccagtcccagattcctcctctagcctctctccaacaagttcctccctccttgagacaagtggtaacatttctcctacctttaaacaagtagagttacctcttgcacaacgtagagaaactagatctaatgctggaagacctcctatacgccttggttttgaacaccttagttctagacatgacattgcaaactatatctcatactctcatatttcacctgcatataaagcattcattgcatcattgcaaatagtgcctattccaaaggactggagatgtgcaaaacaagatccaagatggaaggatgcaatgaaggaggagttgcgtgcccttgaaaagaataagacatgggaacttgtgaaactaccaatggggaaaagagcagtgggatgtaaatgggtatttacagtgaagcaaacccctgaagggaaaagtggatagatataaagcaagattagttgcaaaaggttatagtcaaacatatggaattgactatgatgaaacatttgcacctgtggctaagatgagtacggtgaggattttgatatcatgtgcagttaactttggatggcctcttcatcagttagatgtcaagaatgcttttctacatggtgatttacaagaggaggtatatatggagattccccctggatttggaaatagccagactgttgggaaggtatgtaggctcaagaagtccttgtacggtttgaaacaatccccacgtgcatggtttgacaggtttaggcgtgcattgtgcaatatgggatattcacaatgtaatggagatcacacagttttctatagacataggggggcacacatcactatcttggctgtttatgttgatgatatagtgatcactagagatgatgtagaagagatcaaatgcttaaagcagcgattaggagaggcctttgaggtgaaggatcttggacctcttcgatactttcttgggaggaggttgctcgatcatcaaaggggatagttctctctcaaagaaagtatgtccttgatttgttaacagaaaccggaatgcttggatgtcgtacaactgctactcccattgataggaatcacccattgagtgca

SEQ ID NO: 46189 - DNA, 19900 bp, Oryza sativa
  unsure (1)..(19900): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagaggcaaggttgatttgcaaatcctttgtttgaaatcattttgaaatcactaagtgattcacttcttgttaagtttgggctgaaaagagactcgcgtctcaaatcgacttaagagatgcttttcaacaactcaattggtaatgtaccgacctcccgggtcagatcattacctctcggctcccagagtcatttcacttgattaatcggctcccaaagcctttctcattttctcggactcccagagtccagctgcccagcagcaaagcaatccgcttccactcgggaagcctagtctatgatgcccgcagacatcccgaaccacacagattcgtttctgaccactcaggtcatccatctgccacgtaggctgattctggttacgattcccacaccacaacaacttttcacaaagcacaggcaaacaaatctatgaaacgggaaccacctcacatccgcccatgaccgtgggcacggctgttcgaacagttagttaatcctctgcagaggggcacactttacccacaagatacgaacttattccgaacacccgtcggtatcggaggctcgcaacaaagcctttcccaagccgacccagggatacctcatgccacatagaaggatcaaatcatcacataaatataggtcattttagttttcacaaatcaaactccaaccatctcgatcggtaatctggcaagcttttcttccttgccttaccaggaacccggtttggctccaaccgaccccgccccggctttcccaactattggcatgcgaggtttccctgaaccgactagttacttagccagggtgtcccattccaccttgtggttgcactttgattatgttcgatgagtttcctacaggaatcggtccttatatgcgaatacgggacagtgccacgtaggcacaacccccgcatcgcgagttttcgcagctcattttattttcaaacccaccgacgccacatgtcgggttttcaaggcttctcaaacccatttcccaaattttcgacaatcaacggtgtatgtgggatatttggtatacacgctcagagagcacggataccgaggtaccacaagggtggagcgacaaggaattagggtagtacagcctacaggaattagtgcgactactaggtaggtccgtcggtttgacatgcaaaccgaggccaagcatgttataggagtgattctaataatgcaagttgcaaacaaaataatattgatttttcaattataggagcaattgatcaaagggtgacttgccttgctcaaggtcttcacgaagcttcacgaatcttcaagaaaacccgcgatcgacggaaatccggtaaccgcaactatacgcaaacaatcgaaaacctaaacaaagaccaaaagaaagatcctatttagactaattagtagtgccattaaatagatctcaattttatggaaatactggaagtaaaacggagtcaatcagagctacggattgagagatatgaattttggaagtttaattggaatttctgggcaaaggaagatatttgtggaacaaggggaaattgatttatgaaatttatagaaataatattctcaagaatattattgaccgtcactgacgtgcgggaccaaggaaatgatttacggaattttgggaataaggaattgatttatgaaaaagggaaaaggatttattaatccctttggataagaaaaggaaggagggatgagatttagacttcctttggcggctcgggtacggcccaagggataagcgcggcgtggtcgagccaatgggccgggcgcgggcgcgaggaggcggcccatggccgggcaaggcgcggcccaagcgggcggggcgcgcaggaagagagagggggatgggtccgggtggaccggatccatcgtgccgggtcccgggacgggcccacgagtcagcgactcggcacacggggaagggttcatgcggcgcggggcgctagggttttacggtcgcggctcacggcgcggcacgcgggtggaccaagaggtggagggcccatgcgcagcctaagggctctccgtggaccgcgcgcacagaagaaagggcggtgggggcggctgactaggtgcttgacccggtcaagcgggcccggggctgaggttgctgccacgtggtcggccacgcgggcaggggcgaaaggggaggaggaggaggaggcgcccgagatggacggcggacggcggccgagttcaccggagctcgtcgcgacgattcgagagagagggagtacatttgaacgataggacggacgagagggagtgagcccccggatcggattccccggagggaggccggcgacaacgaatcgcggcgacgcttgccggcggcggcaaaagagggaaacgacgacgatgcgacgagagctcgattcctagggacttgagcatctacgcgacctcctgagttcatttctagagtcggattgggtggagctacaccgaggaaggccgacgacgagcggctactaccgagtttgggcggcgacggcggcgagcctacggcgagcagcggcggcggtcggggcggcgccagcttactactggaaggctactcgcactactgcccagagctaaggagaggagagggagcgaggagggagaacgggagaggcactaccgagccgagacggacgctgtgacgagcggccgccgacgcgggagcgagttctccggcctcgggccggggaaggggaaggagacggcgcctggagtcccgcgtcagctcctcgcgcacacgccggattcaccagcacgcgcaatggaggagggaggcgaggacggcggtagcaaggcggcaagggcacggtggtggcgagggaatgaacgagagggagatgggcggcttggtttaatagatggcaatgtcgatttaaagagaaagaccgacattggcggtcaaggagagcgagctggcggtcatcgacgcgtgcagcaaaggcggcgacaggtgatgacgccggcggtggtcggggaaagggaaaaacaagggggaaaaagagaggctcgctccaagccgattcgggaaaggagtaggagggagagggagagctcggcctccgggttttggcaggacgcgcgtggaccggctcgggcatgcgcgcggggccgtgcggctgcgtggtgcagcgcggcagggcagcggggccggccggcgcaggcgcggcaggcgcggcagggccgacgcgacggcgaccgggcggtcggccacgcgcgagcgcgcgcgcgcggacgtgagggcgcggccggattcaaacagcgacgacgggaaatcgacgccggggagagggagttcgacgagggagagagagaaacagagagaaagaaagagagagagagagagagccgagagagaaggagaaacagagagagctcggctcggcttggcacgtgcaacgcacgtgcgaggctgagggaggagaaacggttgagggagggaggtgggctgagggggaatacggcccacaacacccgagggaggtaaaatagacttttgtagagaagactgattaggagtggattcaaattcaaatttgatattcgaactcaagggtttagggatgtatcaagggaaactcaaggagaagtcatggaaaatattcaaaaggaatacttgggtatttgttcttgggagcataaggtgaggtcaaggaaatgattcggatgaggatcgatcctctcgaaatcgagagaaggatttggcaacgagttcaaggaagggagagattgacttccggaattgggatttggatgagagggaggagtcgccaacgggattcaaaaaaggggatttgaatctaaatttgatacttgtacacaagggttcaaggagacgagtaaggaaacaaagtgggagtttgatactttcgggaatgggaacaattatttggagaggattcaagggaagggattgactttcggaatttgatttcggagactcgaatcggaagaggaatttttgaggtggaggattttgatttcgatgaggaggaacaacgggattaaattgagatccttggcacaacttagactctcacacaaagaactaaattttcgcatataagattttgtcgaattagtttttaacgtctcgcgaaaagcggagcgttacaaacaccaccacctttgccgccacctattcaattgtggccatatctaccaccacattcttatttttttttagataatgaaatagagtatcccggcctttgctcaaaaagctacagccaattattacaacctcacacttaaaatgagtgaagttcaaagaaacttaaaagacgaaaccaaccatcaagaaaaaacaaactaaagactgccaacccaagattaagagtacacaattattgaattctgtttgtgaacctccgtccaaaattgataaaaagttgcataacggttgtcttaagaatacggcatgtagcctttaaaagctcactatcttcctcacacttttgtagttgtgcctaagaccggagccaatgggttgccctgaaaattacctgcgtatatatatgaaatagatgaccaccccattcttctagcttgcttgaccaatcaaagaaatatcttatagaggaattacatgttaaaaaaaacatttgagagcctttggatgatatgattgcttcaaaggaattcgtaggacaggaaaatttcctctatattttggagtgtttctagcaaaaggtttagccaaaatttcaatggatttcctctctaaattatctcaataggaaatcaatgtaacatatatttttgaattaagttttcgttacttttcttatgagacaccaaacagttattttatacaaataatgtggttttgttcctgttgggtttaataagccgtgatatgccaaccttatatattcattttattgctatgctttctatattattgtgttttaaagaagctctcaacgcaatcatataatctgaactgttagttccagccaaaaagaaactaacagttcacaataaaaaaaaggaaaaagaaaagccaagccaaatatcacatccaaatcaatgtcatcggaaaagaagtcaaagagataaggtgttacatctaggcatattcagtttaggctgtgtttttgttcacaccaaaattgaaagtttggttgaaattggatcgatgtgatggaaaaattgaaagttcatgtgtgtagaaaagttttgatgtgataaaaaagttagaagtttgaagaattattttggaactaaacacggccttagtcacagcacatgggttgctatcattaccatttaccaatgaaagttaggtcctgtttagttccaaataaaaatttttcacctgtcacaattatgcatggagtattaaatatgaaaaaaaaattacacagtttacgtgtaaattgcgagatgaatctcttaagcctaatagcgtcatgatttgacaatgtgatgctacagtaaacatttgctaacgacgaattaattaggcttaataaatttgtagaatatgtaattttttttgttattagtctacgtttaatacttcaatgtgtgaccgtgtatccgatgtgacacgctaaaaaatttctcgtgaactaaacaggcccttaccaaacttgtcaaaggttgtgtgcttaacatcattgccacgcctgaaatactttcaccacaccttagcaagttcaagaaaatcttagcaaaaatttccaagttattgatgtatgagatttattttgttggaagataatcttgttataaccatatagagccaaactatctaagttagtcaccagaatatatttcagtgtgacaaaaagtaacaggcaactagacgaacccatagtgtaattcggatcaggtgcagttgcagtagtaactgcaacttagcaactgcatgcaacatcggccgtccatccattgtcaccagataccattcatatacaaattttaaccattcattagcaacagtttcatatttaaagtcatcgaagtaccttatatgcttaatataagtttatatactacttgcatctatcaaattacacgataaaatttagatgtttttagtggttgatagaaatgaaaccacacgggtcaacgctaaggacaagggaacggaggtagtatcacggcactgtgtaggtcagaaatatctgcttctcgcatacaagaaacaaaaggaaacgtccaagaataaatcggtgcggatagtgacactactgactaaagaaatcaaaaggaacaagggatttctcagtcttgttcaagaaatagacgctagtacagccagcaacaataatttccgaggcttcaatgtcgcagaaaccacaattaattatgcatgccgaggtaattaataatatactccttcgtatctaaattaacttgtatactaatctttattcgctttattttccttttgggtctctgatagagttggtacgggataaggttgtcctgtatatcctctcgaggtcttgattagcttgtacagtttgtcctcgagctctcgaccggctccggcaatggcgtccacggacactgagcagcaggaacacgcagtggcgctgctacaacccgaggtaattaattaatcgctgttcataatctccttactgctagccttatgccgatttccacgatgcagtttgtttaatttctcatcagtttccctgcaaaaaaatattgattgagccttgcctgaactagctactcctagttaatttgaagcagccgctcatggatacgttcagtgctaactaggctggggattttggttgctgcaggttgaagaagcatacaccactgatgggtctcttggcgtcgatggcaacccggcgctgaagcatcgcacaggcggatggatggcatgccgcccgattcttggtaataaacttcattagatatccctgcagctctattaattatttcctaaccttttttacttgccaattttttgatgattaatgtgtctctcactttgtgtgttcttgttccaaaaaagaaaaaaatgaaaaaaaaaataaatgaggaacttctttgttgatgtggttatctgagctatgacaacactgaggagagatgcttattctgcttgctttgtgattgtggataggcaccgagttctgctactgcctggcctactacggcatcacgttcaacctcgtcacctacctcaccgccgagctgcaccagagcaacgtcgccgccgccaacaacgtgtcgacgtggcaggccacctgcttcctcacgccgctggccggagccgtcgccgccgattcctactggggaaggtaccgcaccatggtcgtcagctgctgcatcggcgtcgctgttagtcccctccatttcattcgatccgggttgtgtttagttccaaattttttttttcaaacttctaactttccatcacattaaatttttcatacacacaatttttttcagtcacgtcgtcttcaatttcaaccaaaatctaaactttataccaatctaaacacagccttaattagaattagtcactgtgtccttcctgccgtgaatttatggctgatggcaagtaatcagtcactgtgtgggatgtggatttttatcccttgagagaacatttaattttatattaatattaatttatgttaatttatgttgtcatttaattttatattttatattaatttatgttgtccattttttttaatttttttatgactaattagttggcatggatgaaacgagggatatttcctggagggatgaaatcactttccccactgtgtgctgccatgaatgcaaatccaatcagcttcatggctgtacgtacctaatctgtggtgcagggcatgctcatggcggctctgtcggcgcttctgccgctgctgatcaaggacacgtcgtccatggcttcagctcaagtgatcatcctgtttcttggcctgtacatgatcgcatttggggtgggtggtctccggccgtgcctgatgtccttcggcgccgaccagttcgacgacggcgacacgtcggagcgcatcagcaagggctcctacttcaactggtacatcttcaccatgaactgcgcgtccgtgatatccaccaccgccatggtgtgggtgcaagaccactacgggtgggcattggggttggggattccggcgatggtcctcgccgtcgggctctcctgccttgtcgccgcgtctcgggcgtacaggtttcagacaacccgcggtagcccgctcaccagagtctgccaggtcgtcgtcgccgccgtccgcaagttcaacgtcgcgccgccggccgacatggcccttctctacgacctatcggaggatgcctcctccatgaagggagttcagaggatcgagcacaccgccgatctccggtcagttcatgtctctcgttgcatctggtgtttgtgatgctgtaggtgtaatgtaattggctaattcttgagatgcaactgctcgatcagattcttcgacaaggccgccgtcgtgacggcgtcggacgaggaggcggagggcgccgcgccgcgcaatccatggaggctttgcgtggtgacgcaggtggaggagctcaagattctcgtcaggatgctgcccctgtgggcgtgcgtcgccttctactacaccgcgacggcgcaggccaattcgacgttcgtcgagcagggcatggcgatggacacgcgcgtcggctccttccacgtcccgccggcatccctggccaccttccagatcatcaccacgatcgtgttgatcccgctggcgaccgcgcgttcgtgccggcgggaaggaggctgacggggagagagaagggcatctccgaccttctcaggatcggcggcggcctccccatggcccggctcgcccttgcccgggggggccttggtcaaaacaaggcgccccgcccggcgcacgccgggatggagccgacgagcatcctgtggcaggcgccgcagtacgtgctggtgggcgtcggcgagctgctcgcaccgtggggcagctggacttcttctacagccaggcgccgccggccatgaagacggtgtgcacggcgctcgggttcatctccgtcgcggcgggggagtacctgagctcgctcgtcgtgacggccgtgtcgtgggcgacggcgaccggcggccggccggggtggatccccgacgacctcaacgaggggcacctgatcgcttcttctggatgatggctgggctcggttgcctcaatcttgtggtgtttacgagctgtgccatgaggtacaaatccaggaaggcctgttgatacttctgggcttgtttggtaggctcgaaattccggcccatgcactctgacgggccattatgtatgggaataagtccatccgacctccctcatctcttgcacttggtcgaatcgcatccctcagccgcaaaaaactgggtaaaacgcctcctgaatctcccaaaaccggtgcaaatagactcctcgagtggtttggaaggtggtttcagctgacgtggcacattgaccgtgattgactagctgaatcagcaactaggacccacatgtcatcctaatattatcttcttcctctatgtcaacccgtggcagtgccgcctcctttgctatcgcatgcgcgcactcgctcaccgccatccccgagaggttcgcaccgagctctccttctacgagctggtggtcgtggccaccaccaggaaggggtttacgcgcagatgtgcacaatgttcctcacctctccctttctcgcgcggggagcggcggcggctgcgccgtcgctgttcgtgacggcctcgattggcgtggtcggagctacaatgccaccggcgccctcggggggctagggtgcaagtgcgccgatgcatgtgcctgagccagcgggaggacgacaagctcggtgaagaggcgctcggcagtggtgtccgattagttggcggcagcgacccagatgacggcggcgccaacatcacaaccacctccccaacgtgtcgaaacaaattttcggtaatatgaaaagggggtagcgtacgagacctaaaagtggatggatgcagatacagggatttagacaggttcaggccctctcaatgagaggtaataccctactcctgtttggggatttgaatccaccgggtgtttatttatctgacgatcaggttgtctcatgccccctagagggcctcctgcccaccttatataggatgggaggcaggattacaagataaaaaccttaaccaacaaggtatcagtttcctaaatctactttacaatattaccaaactaggactttaggccgttttgtaatatacaaggaaacgtaatacccaagtcatgaactgttacatattccataaatataagttatcccctataactagtcggataaccatgccgtgtgggtatggggtacccataatctccacagtagcccctgagaccttcacagtcgaaaagataatcttctctcgaactagattactccaaagccgagtgcttcaatcatctttgccatggtctcccgagtacttttaccaaatctgaagactgtggagggctgaaaaataaagtcaggtgcatcgactagatgcacctaataggtgtagcccccgactatgtggttaattgaacaaaccaagcatatagttaaggaaaaaataatccaaccaaccgagtggctttgataattatagtcaaccaagtgacttgatattaatatgtagcatatgcggtgtgaatccctgaataacatgatccgagtgatataccaaccgctttgtaaaatatgatgagtgtaacctaaagttggctatatcattgaaaattcacatagcaaaacaactataaagaagcttgtatgttgtgaataaagaaattttcaaagtattgggcatacgccatacgcacattgctttaacagatgtgcttaagtccctagaagacacatggttccaccacacctggaaatatatggcatatgtggtataaaatccgagtaaataaactcataaaggatttaccaaccgcctggaaaatgaccaaaatatataatcagcctaaaccataatattggtcaataaaagtgcacacttacgtggcaaaacgcaatgatattgtatccaatcaattgctttatgaacccaaacagcgccttgacttatataaaaaagtcagcggggagccatataaagcattactgtttggcaccttttaaattgcattgtaccaactcctaaaaagttgaataactgcggtataaaaggattttaaggtattgggcacataatcacgcgcacttttgcctaagcaaaaagatgcctaagtccctaaaaaacgtgacaggctacacctgaaaatatgggctgcagacatattaggcctaggccaaaaaatatgccttcgacaccctttaaaggatgacgcatgtaacatattcccgagtaataaatctttcgggttatatagaccaagtgcagctcatatgaatagcttctgatctgaatgattatcctttatgggatactccaaaatagatataataattgaattctgactggcgcaagtattcggttgataacccttacagggaataataaatagtccagtctttgagcgtagaaaatagacccatgatcatcaaattcatgttgcatgtatccggaacaagtccaaattgaagatataaccctcgcgcttgtgtcgatgagcccctaagcatgtagcttatccttctgttatagtcacaattgtccattgatggtagctgacgtagtcggcatggagacgaaatgaccaacatgaagataatatcatccatcaaagctgacgaagatgttggtggtggtaaaaacagtgacgccaattaaaggtgatgaagtcgcatagccgtggagacgaagaaaccagtcggcagcaatcaaatcagctagcagtgaagatgaagacgcccaacaacaccgatagagcagtcggtggcaacgaaagcaagtcgacgacgaagacgtagacacgcatcaacggtgatggcgaaatccaccaatcatgaagatgaagaaaatagtcggtaataatgatgaagacgctcatcagtgtttgcgtagtaggtcaaccgtgaatgtgaaataataagtcggcgaagacataatcatccattagcaacaacggagatgtcagggccgatgaagcagaggtgctggtgatgatgttagtgacaataatccatcaaactgttgacaagatatcaaagctcgagtagtttccttgatgcgagcgtgtgcataaagaaggctgatgcaacgcttcttgatttacgaagatgactgcagaacttagtgttatagatgttgtagatgcttcacttggaggaaagtagatgctgttgtccaactcattgaatcagtgtaataattggagtcgctgaaataaaatgtcggctctgaagcgaagacgaaaataataactcccagagttgacttgtcgattgattgattgcttcatcttgacataaaacttgtcgaattttgagtcttgtatttgtgtatcccctgactctttggttagttggaaagcaattgaacatagagtcgagaactgtagcttcttgtcatcgagtagtcattgcttgagtaaagatatgtgttgaggatgtccgagtaggaatcttgaaaattgtagaaccacttgtagtagtaaaatgacacggcatcatatttggtgacgcataccgagatgcccaagctcttgtagacgtcgtggctggtgaagtagcaaaacttgcgaagtagaggcaatagtgtttgctagtgccaaagataataaatatgaagtcgctccaccatggcgacaaagttgcatagccgtgatgacgtgaacaggagttggcggcaacagaagcaaaccggtggcgaagatgcgcagtcatgaagataaaaacaccagttggcggcggcataaccagtcggcaacggaagaagtagaatgatgatgaaaacgaagacgttttttaacagcgcaaaataggccagccatgaacgtgaagacatcatgggcagcgccgaaggcaaaccggcgatgacgatgacgccagtcaatgatgatgaagacgcgcagccgtggaggtgaacaagccagtcggcgtcagacaagtcggccaacaatgaaaacaataacgtccatcagtagtggtagcaatataaaccagcagtagaggcgacggcactagtcaacagcagaagagacgaccggcagtgaagacgataaggccaatcaacattggcagaatcatgcagccatggaagtgaagaaaccagtcggcagcagacgtagacagcttgcattgaagatgatgacgccgattagcggtgacggcgacgaggccagccgtgaagatgataacaccagttggcgtcatacgaggcggccggtcggtgaagatatagacgtccaacaacggcggcataataggccagccgtgcaggcggagacaccagtcggcggcagacgaggcggccggtcggtgaagacgtagacacccaacaacggcggcataataggccagccgtgcaggcggagacaccagtcggcggcagatggccggtcggtgaagacgtagacgcccaacaacggcagcataataggccagccgtgcaggcggagacaccagccgacggcagacgaggcggccggtcggtgaagacgtagacgcccaacaacgacggcataataggccagccgtgcaggcggagacaccagtcggtggtagacgaggcggccggtcggtgaagacgtagacgcccaacaacggcggcataataggccagccgtgcagacggagacaccagtcgacggcagacgaggcggccggtcggtgaagacgtagacgcccaacaacggcggcataataggccagccgtgcaggcggagacaccagtcggcggcagacgaggcggccggtcggtgaagacgtagacgcccaacaatggcggcataataggccagccgtgtaggcgaagacaccagtcggcggcggcgaaggcaagccggtcagtgaagacgtagacacccaacagacggcggcataataggccagccgtgcaggcggagacaccagtcggcggcggcgaaggcaagccgatggtgatgttctgactgatccattcctgaagcgtaggagataagcttaaagccatgaattccttttatgcatatctggatctggatcccacagaacaaacagataggatgagtagtatctgatgtaaatataatactcgagaaaaattcaagcattttaaaatatttataaatatgtatttctcctctcgtcaattttgatttcctcgagtagatgactcattacgtttaaacactctgcccgactagtcatagccaccaagcaccgggagtcggcctaggcacttcccaaacatgcatatgagtaacatgagttcgtcattaatggaacaaagtttcacggatcagaatttactactcgggtacttttgcaattattaagagcagaaaataaattatcttatctctatgcttttgatttattccgaataatacttagcaccttgcgttattcggtccatccaacaagccctcgggtgctaggaatcggcccaaaggcaactatccattggcaaaccaaacggaaagcataggaagatggaaatccataactcgataggcacttttgtactcagattatgtcacgagcaatcaagataaatattatgaaagttatttaaaaaatatgatataacatctgtagcccctgactcactagtcaacgacgaaccagttgatgtagtgaggcagaggaaaagaaaaatatcatataaggaaaaatgatgacttagctttgtaatatctctcttaatgacggcagaggtggctgatgtgggaacaaagtcgcctattaatggcaatgaaaacaccagtcggcggcgaaagaaggcggtcgatggtgaaagcgaagatgcccaccaacggcggcataataggccagccgtataggcgaggacaccagtcggcggcgacggaggcaggccgacagtgaagtcgtagatgcccaacaacgacggtataataggccagccgtgcaggcggaaacaccaatcggcaacagcagtgccacagcattacatgtaaacaacaggaaataccaagagattaatctgatatttagagatcaatctaataaacaacaataagttggaagggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattcacatggaaacaaataaaataaatctgattaatatcagcaaattaaatgtataaatctcagcgattgaatgcatgtatggctggattaattaatccatgcatggcggttgaatcgacacatcctgtacatctccagcgatctcgtcatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgcggatcgatctgacgcgtggactatacagccgcatggatgtagatcgatcgaggtggtcggccggattgaattagaccaagcgacgtcgacggagatcatgcgccggcggctggttgctgccggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaaactcgacgcacccctccctggcgcgccaactgtcgaaacaaattttcggcaatatgaaaagggggtagcgcacgagagctaaaagtggatggatgcagagacagggatctagacaggttcagaccctctcaatgagaggtaataccctactcctgtttggggatttgaatccaccgggtgtttattgatctgacaatcagattgtctcatgccccctagagggcctcctgcccaccttatataggatgagaggcaggattacaagataaaaattttaaccaacacggtatcaatttcctaaatctactttacaatattaccaaactaggactttacgccattctgtaatatacaaggaaatgtaatacccaagtcatgatctgttacatattccatatatataagttatcccctataactagtcggataataatgccgtgtgggtatggggtacccataatctccacacaaccagatcgccggccctcccgtccaagaagatttttcaggccaagaatcgtttccaaggtcctagatctcgtagctccaatccacaccgatggcagagcgaccaattctcatagtgattgcggtgttctgtagttgtgtatgtctaaccaagtaattggcctatctctttctttcttaggtgcgtgtccgcctctgcgcgtgcatggacgatctacttctcgcgcgtgtcactgccggccgacgagatcctcctcccgtgcaaagccggccggtgagatcctcccccatgtgcgccgcttcgctgacatgccaggagcgtcgcttctgcttccacgatgaagacgacaacacgccatgaccgccgcttccgctgctagttgcgaggggagagagaggaagatatgaaagaggaatggggaaggacagcagaggcggcgcgtggaagcgggcgcgcatgcgcacgcgatgccgacgttgcaggtggccaatctgctgttaccgtgggacgggctgtcgccggcggctcctggtgagggggggaggggggagaggtgaggaagaaagataagattaggatgacatgcgggtcctacttgctaattcaactagtcaactacccacgtcagctcaaaaccaccttccaaaccacttgaggagtctatttgcaacggttttcggagatgtgggaggtgttatatccgattttgcagttgagggatgcaattcgaccaagggcaagaaatgagggagccaaaatagacttattccttatgtatgtgggttatgggaattgattacgggcctctcaaacaaggcatctgagcatcggcataggtactaggccagctcggtacaaagaaaggcattttattagaccatcaacaaagttattagtctaaactgtacagcatttgagtaaatattattttttgagaactgcagttaagtaattagagaggaaaaaatagcaggattgttgtaataaatggaatcgtttcgcttattcgcggaataagcaaaacatcttatttacaaacgaaaagaaatatgtgaataaaatttttatatgcgtattcttagtgatctaaaagcaaaagtaaaggctgaaaaataaacttcgatgaaaaaaaccttaaaatcagcttcaaatttaaagttaaaaattcaaattttagctgataagtataaatataagcgaaaagatgagaccctaatatcttcgctctgttcgtattgagcaggaaattaatttggctacagcgttaccatagtgactacaagtctacaagtcatactaccttcctctcgtataacttgtaattctagtttgtttagcaaatattaaggtttaagaagaaagactataatgtgtcccttattaaatactccttccgtttcataatgtaagtcattctagcatttctcacatttatattgatgttaataaatctagatagaatacattgtgaaacggaggaagtagtgtatactatataagagtggaaaggtaatcgagggtaaaatagaaagaaatttaaatgagaagtgattaatgagactattagtactctattgtgataattattttgggacaaattcaaattctagaaatacaattattatgggacggaggtagtacattttatcaaaccgaggagaagaagagacatgactcaaatttcaaactgacgcaacactattctctaattcaaatttcagtatccgctactactggtggcgtccacttcaaaactgatactttccggcgagtcgctgagcaaacaccgcacctcgtcgagctcgacgacgtcctgcgtccatggatgctggtgcagcttccgcagtccgcccagcctctcggcgacctccttcatcgccggcctgtcgccgccgcacatctgcaggcactccagagccagcagcgtgatctcctccagcaactcaccgctcgcctcgctcttcacctgctcatccagtatcaaatcggctctgttctccctcatggcggccaagaacctcgccgacaagctccgcccctcatccggcccgtcgaggcagagcggcttcttgccggtgagcagctcgagcaggacaacgccgaagctgtacacgtcgctcttctccgtgagctggcatgtctgcatgtattctgggtcgaggtaaccgcacgtcccctgcaccatggtaaaaaaagacacgaatattaggaaatgacctaatattaaaaaaattaagtaattatttattcttttcatatcatttgatttattgttaaatatactttcatgtacacatatggttttacatatttcacaaaattttttgaataagacgaacggtcaaacatatgctaaaaagtcaacggtgtcaaatattttgaaacggagggagtaattagaaagggtgaggctttaaactcaggtcgtctaacccactaccttgtggagctagccggaaaacctctgggcatttctcacctgcaccatggtcatcatttgggcttcgtcagtgggagccaagatggaggcgccgaagtcggacaccttggccatgatgctctcgtcgaggaggatgttggaggacttgacatcgccatggaggatcggcggcgacgcgaaggagtgcaggtacgcgagtgactccgccgactcgtgggcgatccggagacgggaagcgaaggagatggcgccggcagatccgccatggatgagctggtacaaggtgccattggggacgtactcgtagaccaacatggggacgtcgacctcgaggcagcagccgagtagcttgacga

SEQ ID NO: 46190 - DNA, 822 bp, Oryza sativa
ttcctgcagccctgtatcttggcaggcttgtatgaacatatgcaggagtgattgtaactgtaaaggttttcagtacctaaaaggggaagggacatgctttccaaaatcattccttttcaatggaagggcatacccatcacactttgtgtcaccacgcaatatgtatcttaagatccctataagcatgaatatttcaggtatgccagtatcccaatccaatgtgcttgattcaagaaaacatagccttaattgtgatcagatggatgaaaaaactagggaactatttcccgatgtgcacaagacaagtcagggagaaacaagatggttttacttgtatgggtttgcgggtgcgatttttattcttgaagttttctttattggatttgcatggttctttgtttcaagatgggatctggatgcattagaaatacaagcagtcgagcaaggttacaaggtgatggcaagtaatttcagaagatataattataaagagttggctaaggcaactagaaagtttaaatgtgagcttggaagaggaggctcaggtattgtctacaagggaaccttggatgatggtcgagtagttgctgttaagatgctggaaaatgtaaggcaatgtgaggaagaattccaagctgagttgcgcataattgggaaaattaaccatatgaatctggtaaggatatggggattttgctcagagaactcacacagggaatggcttggggggggttttttaccgagtatatcgagaatgggtcattagctaacatactgtttaatgaaaacattttgctagagtggagacagcgatttaatatt

SEQ ID NO: 46191 - DNA, 2232 bp, Oryza sativa
agcctatctccaccatgagtgtctagagtgggtcatccattgtgacgtgaagccagagaatatcctgttggacggaaattttgagcctaagatcgcggactttgggttggcgaagctcctaaacagaggcgggtccaatcaaaacgtgtctcgagtgcgagggaccataggttacattgctccagagtggatcagcagcctgcaaattactgcaaaagttgatgtgtatagctatggagttgtgctgcttgagctggtgtcaggaaagcgagttctggatttggctacaagtgctaatgaggaggtgcatgtagtgctcaggaggcttgtaaagatgtttgccaataacttgagtggaaatgaaccatcttggattgcggagtttgtggattgcaggctaagtggccagttcaactacacgcaagtaagaacaatgatcacactggctgtcgcgtgcttggatgaagaacgaagcaaaaggccaacaatggaatctatagtgcagctgctccttttggttgatgaatcttgtagcagtaatgttctatgtcctgagatgccaacaaggtggacaactggacacgccaaggcaaatgcaagtttttgtattcatagtttgtagttctatctcattgtatggaaattcggaaactcttgtacttcaaactctaggcattcatttattcagatgtgctgcatattccttcacaaattataataaagtatgctattcaagaatatctgttgtgatgtacgcattgtctagtatatttaccatctttttgcctcatgagttccagcaaagtcataggttcacagatagtgctgaaatggggctcctctcctatctttacaatacagcagttgcaattcaatcatggaaaaatcacagaatgaatattattggataccaacaggtattaaaggactttctagttgatgatattgctcagtttgagaatggaaaatatgtttgattgacattgttattaggtcgacttcgactaagtactactatattaattagctaaatatataaacttgacttcgactaagtactactatattaatttgctaaatatataaacttgttagtatttgatactagtttgatgcttacctgtgcataatggattttgtttagttacagtatgccggtgacaattttgaatatccatacatgtgactcgttgacctagcggcgttctccaggcgtttctttataaggtaaggtgtgctcgtgttcagctccatacaagtctacgggaaaaaatggccttttttttttcaagaaatgagatagcgtggcttcacaaaagagaaagcgaattaacatcaagaacaggaagcgaattaacatcaagaagaggaggcgaattagcatcaagtgcacttggcgaggagcatcctgtaagtacatacactctttacaagctactgagtcctctaatcctctgagagtgtctcacggtctcacggcgtcgtcggctgcaccacctccttcttcccagccggctcctgcacaggcacagcaggagcaggagcagggtcgaccggcacacccgagcgcgagcgccgccgctgacaccagcgccatccggaatccattctaatccttccatttcaaaggtaatgctccgccgcccgccgggtgtttgtcagattgtcacgcttattcagttgttctgagcctgagcattgagcacatcaggtttagcctgtcttggatggcgatacaagtggcggtttcttgtattaatcaccaacgccccccaagaaagatttggagtcgattatcttcattcctagctcatcttttttcttttatttatttattaattattttgtggggatcctagctcaggttcttgatttggccacatgcttgccaggatccaggataggacactggcgctggtgataggctgatagctattttctgcacattttataaatgttgatgtttcttcaaacattagatatgtgctgaaatgatcaatggatgctgcaaaatgaaatggtgatctgattctagttagcttgcatagttcaaattgacctttttttctaaaatttattgtggtgtaggattttctttaaagttttatatggttcagttcagcattctaatggtatttgcacgaatcgaatatatgcagtatgttgatcttgttacatagcttgaaaaaagtatcatatgcaaggagttacactactacatccatgaaaatg

SEQ ID NO: 46192 - DNA, 1390 bp, Oryza sativa
ttcagaaagcgtcttgaagaaatgcggtggtatgcctgtagctatcaatagtatagctgggcttttggcttgtaggcctgttaagagcttagaagaaatgcagaacttacaaaactctcttggatctgagatggattctttctcaaccatggagaaaataaagcagatactactattaagttacaatgatttaccctaccatttgaagacatgcttcttgtattttagtatcttcccagaggactacaagattaaaaggaaaaatgttgtccggcaatgggtggcagagggatttgtatcagacaagcggggacaatctgcggagcaagttgctgagagctattttgcagagtttatcaataggagtatagtccaacctttagatataagtgacagcggaaaggttaagacttgcaggatccatgatataatgttggaggtcattgtagagatgtctgttgaacaaaattttatttcacttatgggggatcaacatacaatgatttcctatgacaaggttcgacgtctttccttacatggccatggtgcatataatctatcaactagcttggaattatcacatatccgatccctaagctcctttggggatatgccaagagctttgcgctttgaccgtgcaagattgctcagagtgttagatctagaaagctgtgaatttctgaggaatcgtcaacatcatcatatttgtgcattgttccatctaaagtacctcagtctaagaagagctcacaacatagataggctcccaagaaaaataaagaaattgcagagcttggaaactctagatttaaggggtaaaggtatagataagttacctgctagtttcattgaactggagaatttggtccatttccgttcaggttctacctacttgccgcatggctttgggagaatgaaaagcatactaacattgggattgatagagatctcagatgacacatcttggaggatacaagaaattggctgcttgatgcaactggagaagctctgcatatggtcacgcgatggcatgaacaaggagaactgggagtccctactcaccgtcattgagaacttaagcaggcgcctcctgtcactctcaattgaaacggacaggagaacttgttctttgccacttgatttctcatcctccccacctcttctcctgcgaagcctcctgttatatggaagtttggaagcattgccaagttggatggcatcgctggataaccttgtgaaattaactcttggtggtactaaattagaggaggatgatatacagattctccagaagctcccacgattgttttctcttagactgtggtttgcatttgccgtagagaagtttgttgttgcgccctgagggtttcccaatcttcagttacttgcg

SEQ ID NO: 46193 - DNA, 1921 bp, Oryza sativa
agctccgatttctggactaattatgattggatgatcgaaaatgatgtacctctgagttgaatgatcaattgagctctctgaaaataaggatactgttgtttttgctttggaaaactctatgaatcatactgctcaatctatgtatggaactggagtatgtcttttcatggggttgtggattagaatgctggacattttttgaaagcattttcctggtggcctgcccggaatccaggcaactacggtggctgctactctcggctactgggcacccaaactgtctgccgctcaatgaagtctccttccatacttggctatgcaagtatcggaagaccatatcggaaaaacagcggcgaggtttcgacactatcgtcactctaggagcatggtgaatatggaaggagcggatttcccgtgtgtttcgaacatcaccagcggaactagactgatgttgccaaggcaatgacggagaaagcaagctttggagattggcgagggcagctgtccctcatctaaagtctaggtctaggtagcatcatgtcgctgggagaataggattgttttcctcccttttttttttcttcttttaccccgtctcagcccttcctccttttctttcttcctgtgactatcttacatttgttttacttctcttcatataaagatgcacaagttttttgcgtattcccgaaaaaaaaagacatttctccctctgaagattaaacattttctatggttggctacaggattcagtgtacagttcagttgataaggagaaaatggggagattctacttcaggcgtgtttgtgtgctagatatgaaaatgcaaaactttaaattggtgcaaacctagtggcttctctaaattattatatttgacttgcacactatcctttctccaagtacaaatgtaaatttcctcaaaaaaactgtagtaattaccaatttaccagtaatgcgctgtaacctttctcaaatagacaacatcttataattcataccataaatctctaaaatatggaaaatatattgatatatattatgtgaaaaacaccattactagatttgaatatttttgaaatgtgcaattagaaagcataatgaccaaatatgtactttagaacgtattgatatatcctagaagacaagtaaaaaccacataaatgaagttttaattaattatacctcaataaaaataaagtatccctctgtctcaaaaaagaatgtattttagtttttggttttgtatttttagttgtggggtccattatacctcttattatcactttatctttttcttcttagtttagccatctagatcttgtttggcacagctcgagattagaatatcttagagttgggtattttgaacttcataaatcaatggatctggatatgtgattatgctgataacattagataaatcattttattcttattttatttgatattgaaaattttaaaccactatatttaacacataaactttaaatctatagtagatctgaaatttgaagctatggagttatgccaaacatgacctttgtactacctcctcctcatttttttttattaatgaagggtatagcatttttttaggaatgctaccagactccattcggacaggatgaaaccttagaggtgtcacctgatacctcgacggtatcctgttcgtacgggatgatacctcagagatatcgtctgatatagatctcttcctgaaccaaacatgaatctttcaattcatttggctctcacgctccctttttttctttttctttttttgctatggctacttccattttttttatgtaatgagcctatcctctaccctctcttttatgtttacatttcaatataccgcaacccatataatactagataaatattaagaggataaaaatctatcatgggcaacaa

SEQ ID NO: 46194 - DNA, 911 bp, Oryza sativa
acatatcttggatttactgttcatatttagcggtaatcaattcatgttctgcacagtcttttacacttttcctcatatttttttccattatatacaatcaatttaattttacagtgaaactgaatatgtgaacagtttttcagctttattccagtgtttatgaattaatatttttcatcatcttctaatatttgataggcacagctggttctgtcatttggctgttcagaagcctggaggctgggccatttgatatcctgaagttttgagtaagaatggagaatgggctgtccgatgaagttcttaaagcagttttccctctactggatggtcaagacctagtcttttgcatgcttgtatgtcgtcaatggcgagaaattgcaaaggatgactacttctggaaatgcatatgtgcgaggaagtggccttccatttgcaagcaacctccttcagatgcaaactaccagaagctctatttaaccttctccaaaccacggacgccacagcaccttcctgtaccaaagctcacattcgaggatcttgtgttttacattgacatgtggcttgacggatcactcatcttctctcaagctgtttcaggctgcatccttcgaggaggtctgcagaatacaccttgtggcattccggatgtacttgtagcacatttgactgctcctgactgcattctgatgatggaggttgaacccaagctggaaataactatggggccatccatcactgtgtctgttcttgcccaccgaaaggatacaaagaagatggcttgcgtcattaataagtcaacttttgattacatcgacagcaacgcagcacgggcattggcatatgaatatctccagttttcaccaagatacccttttatatcagacatccgagcatggatgtctttgctt

SEQ ID NO: 46195 - DNA, 1721 bp, Oryza sativa
tacattatagctaagatgagtgagatccatagtaattctttaagacaagtgaaactatattatttataactaatttgtgtaagaaatattagttctccctttatttgttgaggcaagtgatgatcaaacaatcgatacttagggcccctttgaatcacaggaatgaaaaaacggaggaataggaatgacataggaatgaccgtttgattggactaaaggaaaaacacaggaatttgaagagagataaagactcaaaggatttcttccatgaggttctacctcttattaaaattccttcaaaacttatatggaaagatacattctataggaatttcatagaattccataggattcattcctttgattcaaagagcttcgtgggaaaaattcctataggaatgaaatcctctaaaattcctatgaatttcctttgaatcaaaaggaggccttaacaaccgtaataccttttctatcagttgatcacatttgctgagaataataattcaaacaaagcaactcctttgtcaacaggtctagggatcacaatcaacataccggacggtacaggtcttgggatgccaagcggtatttactgtactggccagaataattttaaattcaaatatgaaatttaactttaaatttgagtatacgaatttatattctcttgcgacttctttttttttagaaattcaggggtgagtgtgtgtctgcgtttgttcttgcaacttgtgtaggtatatttgtatagataaatgagaactcggagaggcacattcaatggggaaaaaacagaaatatagaaaactatatatggcccacagaatatcacacggcaaaaatccccaaaaaaaaaaactaaaacaaaagtttggcccagaaccaacagacaattggaatagcctatccgccttttcctggccataatgcacgaagatatattcattagtttcaccagtaatagaaggaactggaggtacaaaatgagtatagttacatagtatagttacacaaaattacttctatacagatgcaatatctcctcggttcatggcatctatctatcactccagtccagtctgtttttttttagataatgaccagtccagtctgttgaaaaggaagaaaaatatttgacaaacgtcacatctaatcagaagaacatctgcaatataaaaccattagcattttgctgtaaagcaatattatcatctatgcgtgaatctttacattaaacggccggcatagcatgctcgagggtatttttgctgcagctggggccactgcacgaagaactgatcagctattcgtagcttgtacaacagtaaaccgcttaatgaaagcttcttcactcttgcaatgctttcgatgtagaaaatggaggaccatcccaaaccaagcacctgcagaaatacaacaatccaaaactcagtagagatataaagcattatgctgacttggaagtgagacaaataatcaaatatgaagattggatgtttggatttaggcaagatggccctagacactgttttataacaaatacttcccctgtttcataatgtaagactttctagtattgcccatattcatttagatgttaatgaatctagacatatgtatgtgtttagattcattaacatctatatgtatgtgggcaatactagaaaatcttacattgtgaaacggagggggtaataaaaggtaccacaagtcttatactg

SEQ ID NO: 46196 - DNA, 2349 bp, Oryza sativa
gatacaacattggatggtgctttcactagaattgcatgaggagcacaacattcccattgttagtcaatagataccctatacaatgtacatgctaattgacaaacaatctcaaatcttcaagtatttcacatgtctccagtctgattttatgaactttctattgcatgacaaggaaatggataatatacattacatactgactcttaacctaggtgtgtaggacatgtgaaataacaaatgtgattgcacacgcactttatttatttctctattgaattacaatgaaggaagtgtataagctaattgataaaaaaaatcacagatattcaagtatttcgcatgtcccaaatctctgtttttttaatctttcaagtgaatgacaagcaaagaaatggatatatacacattgaatctgatcttaagcatgcagaatatgtgaaaataacaaatgtaattgcaaataagtcctcatggctacaacacatatttcaggaggaagaaattctactgcacaaataggccataggccataggttattcaatctccaagatgaactcaccagacccaaggacgatgagagaccgcattccagcagctgaagctgagagtttcgaaggcatgtgaccgctgtgatacatcacatatgcgaagcggacaagaagcaaagacacaagtactggaaaggcgcaacacacggccatggagacatccggccccatctctgtcagggctgacgagataagatatcacgcaggattttgctgttggatattcagcgttaaaaaaactgtgccatacaaataaaaaataggcatcaacatgctcttaaaaaaacagtagcacaaatagttcattctgggagatgtcttgagtagtttgaatgaattatataacaattgaagaaaaatacaatttcatgtgtaacaagcagttcattctagagatgtctcaagtagtttgaaaaccttttatctttatgtattatcattggtaaggtatgtagattggaagggagatgcggcatcaactctgaacttgaaagatatttataataaaatcgagcaagcttaactaaattttcattgccataagcagaaaatgattcagtggctaactggtactctatttggaacattcaacaaatatgccctcctcacttcatctctattttcaggagcataattggtctattgatattcgttagtatgttggatctgcaaatagatttagagaatgaagtctagaaataaaccaaagaatagcatgacataatcagggcctgtttggtagggctccaactcctagatcttagctcctaactccaactccaatgggagcttgctcctataggatctagaggtgggctgaaagtgtttggctagtttgatcagctctagaaatctttgaagagtgaaggaagcaaagatggacaattttatccttcggttttctgaactgaaaaggttgcaagttttctttgctggtagctactttaaacacagacactcatttaccatatggctagtaccaattagttctttactgtactttattctataacaacatgctacattcattaaatcaattttctgaactttgtgcaatccactgaaaatatttctgaacaaattctctcctcatcactactctatagttctatatgaaattccacatacacacacataggagaagttttcagatctaaatattttctatttgttctacgcacagtagcaacaaatcaaccaatatattcaatcattcgaatagagagtagagcagatttaaaggcaaaaggtggggaaaattttagggtttgggaaaaagagtaccttgccactagcgccccctgtcagccgtcctgcgtcgttgttagccgctgtgcttgacctcaaccgccgtgcgccacattcagccactacgcggcagccctccgccgccgagccaccctcactgtagggcgtagccagcaggcgagcaggaggcgggaagcgaactagccaagcagatcggcctcccgcggctctgggctcctcgccggctagcgaagcagatcggcggccggcccctcgccagtcgcgggatcgcagctcgcgcactctccgtcgccgccgtaccgcccgtcgcccgccgcaatcgcacgctcacacccgcagccagccgtccccactcccgtgtcctgtacgcagcagcccaccaaatgagttagtgggccaaatgattagattggcctctaaatgggcctttaaacatgcaggttcccttctgccatcactcctcttcatcttcctcgagcttctaaggcctgttttttttttaaaaaaaaactttatgcatttattaaatat

SEQ ID NO: 46197 - DNA, 1746 bp, Oryza sativa
ccacaacaattcgccctaaatcatgttctaattagggatggcatcagatcggaaattagggatgaaagaacacagagatatagaccaagaaatacctctcagagtttctctcgacgtgcgtctcagagacgctctcagcttgtgtgctgtgccggtgcgccgccgccacgcctctgcgacgctgcgccgccgccgcgccgccgcgggcgctgtcccgccgcgcctctgcaccgccggaagagaggggaaaggaggggacaggacggtggagagggcgaccggagaggagggacgtgctgccgcagtgccgctgccgcctgctggggaggggcgcacgcgtacaacgctgttgccgtgttgagctagcggctagccgctaggggcattggcgccggcggctgggagtgaggagaggagcgatgcggtgggtagggttagggttttcctgggcctaatgggccatatgacattttgtgctggtgttcagggttggcactacatttaaaagtctaatatgcacccctcgaagccccgcgggtgaattacctcccccgcccaattgcaggccccggccccgactccttgggtcagaaaatccacccacccccacctccgtagcggcagggtcccccgcgggggaaattgccatccctaggcgatagtgcttcacttattcttccaatccgatgaccaagacgatgaagctgacggtgatgacggtgagggcgaggttgactatagaagataccattgaaccgcaaactcaacagggacctctcacaaatataggttgaagcaaacccgataaataaaagaagattccatctaaccttgaaaaggatttgtccgagaaaaggaagggcatcaaattgatataatctatgctttttcctcgagggtctgcctgcgagtatccgagtatgatatttcctttatacccttgccaggagcggagctagaacaaaatgaagggggttccactcgcttgctttactctggtttgaataaaatttagcttgatacgggtgcttaagtttaaactgacaaggtatatatatatggtgaaaatagataaactataggtaaaattttttttgaaaccgggttcttagctccgccctgacccttgcaaacaaattatccttctaatttttggctcaacgggaataccatttatcttttttttttggttcatacgataatatatatacaagtgaaattcccatttgggtaaatgctaaaacctttcccttgtcaaagataacagcagcagatcacacgcatatacaacatgagaaactctgacaaacatatgaaagaaggaactataacatatacccaaaaaagttttctcaatcatttgagccattgagtgataaaaatacataggtaacatgtgttttcgaccatgaatcaagctcattaataggcggcagagtacattatgtttaaccatgcaaagaaaggtacttcgttgaaacatatttcggtgtaaatttagtgtggtacgggcatatccaagcacgaatttaagttcagcagtgatatgccgtaatttacacacatgttttgggctacaaacaagcgcgagtcttttcttaatcaaatggcagtcgtcctgccgcttcattacattacattacattcctaaacttgctacagaaaacaaaatagctttctcacacgaatccttaataacaaagataaattattttagcacacgatgtagcttattataatttgagc

SEQ ID NO: 46198 - DNA, 2429 bp, Oryza sativa
  unsure (1)..(2429): unsure at all n locations
tacgccaagacaagacgccggatatcgacttcagagataggcacgactagtcccttacggtgtctcaggatactgtcaggagagacgaaagcgctatctctgatctcgctaggcacaggttcgaggaggaaggctaccctgttgtcgactacgagtcagatcgtcagactgccatgtcgacaatagttagattggctaccccaaatattgtaatggtgtgattatcatgaataagagcaataccggcttcggccaacaggatatagggttattatatgacaattcaggggcccgaacctgtataaaaatctctgtctccatctcttttacgtcagtctcgcgtatatcctagtaccaacgatccccatgacatgcaaataccgtagtcgagacatcaaacgtcgacagtggcacgccaggtagagggattttggtgcttcaggattttgacaagatgggtttaagagatgaattctccgacaacaagctactcgacaacttcgctgttgggtgatctgaacctaccagaatacgtatcccgacaagatcggaaccatcgtcgtcaacaaattcgatttatcaagatcgctcaagcttcaacacgtcaatgccgtggatcacatcaattttgaggttgtcaatcaacagtgcagacaaccttcgagattgatcagtaccaatacacgcgccacatcaactggtggagggctcgattaaccgcgtccaagccgaacacggcatcgatctccaccaacaaaacaagcgcgtcgtggagcggaaatcaaagcgtcggattgatctgcttattggtgtaaatgctagtcggactcggggagtttccacgtctgcactactatccaatctctaggcagcaatctgattcggggctaaagacaaacaggtcaattaaatgaccagattacatggtacgtgcacgggggacagtaccatgcacgaaaaagcatattaaggagttgttgttcctcaccaagaaggcaaaggtatttagtagattgaatctactaatttcgtagatacatctagcatgtatctacaaaggtacgcaatattttatatgcaatttatcgtacctattcagatcatacagcattgtcagatctataatttattatgtttacctagagcatgttttttatacaatatttattatgcgagtgtttccggtgttaggccgacaacggtctaatactggggctcgctctattctcttttgtatgaatcatgcttgtttacggtttacataatgcctaatatttacatctgctcgttacatcctgataatactagaagatccatgcagttttctgagtacatactcgatattatctgctatatgtcttgtcttctagaaaatatttttcaggaacaattgagcactcgactaggttgtggtcaagtacaccgcattatcgagaacgatctcgacaaatgcagagtcgtcacgcccaacccaccaacgaagaccgacgacctatctcatagcacccgccatggctggactactcgagaaaaggttgttaacagataattcctcgcaagcgctgtcggcttgatcacccgacatgcatgcgaacggacatccggatatgctacaagttgggtgtgtgagtcatgctggccacatgagacgcacatgtaataaaccaactctagcacctccattggtgttcgagagataactctacacgttcactggtcctcgagccagtacatagcaatctctcgcactgcaacctccatgtgttcgagagataactctacacgttcgctggttctcgaaccagtacgtagcaatctctcgcaccgcaacctccattggtgttcgagagataactctacacgttcgctggttctcgaaccagtacgtagcaatctctcgcaccgcaaacttctattggtgttcgagagataattctactcgctccctggtcctcaaaccagtacgtagcaatctctcgcaccgcaacttccatggttcttgaaccagtacgtagcaatctctcgcatcgcaaacttccattggtgtcacgccctgaagttcccctcccttgctctaaattcataaaataaatcgtccgaagaaattgtttaatttaacctagagttgaatccttaattaataaatgcaaataatcatcggaatcggcatgtggaatttttcttggattctacatgtcaaaatatgctaacaggatttttagtggaattttcagagccttggaaataattttaaccaattaaaataagcaaagtgcaatattaaatccctgggaaaatcctttttcctttttatctttcctttttccccctcttttcctcctttgggccgccggcccatctctcccgccccctcccgaagtccaggtcgcctccccctttctccctcgggtgctgacaggnnggggccc

SEQ ID NO: 46199 - DNA, 3171 bp, Oryza sativa
ttcccgcgcctccggttgccgtcgccggcgaccgtgcatgcgcgccaccgccctcaccataaccggtcggccggtttgaggccgagccgagccgaccggacgtctcctcctccccatgagccgccgctcggtggggcccgcttgccagccgcccctctctctccttgagtcactgacccgcgggtcccgcgtgtcggcgccacccctccttgtgctgacgtcagccctgggatgaattattgcgcaataaattgattaaggctttttctttattagtaaaaacacagataatcttctaaaaatcataactaattcatccgagctccaattaagtccattcaagtctcagtaaatcaagaaaaatgtatagaatccattaaaaatggttttgtttcctgttttagtagtcttatagcatgttttgcttgtgtgctttgtttgtagcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcactgttttacaatatcatgtgggatgggtcctattactcagctatatgttgtttcccttacgccattgatagcttgggtattaaaatgactagatgttggtttaggagatgcttagccatgcttagttcaactaatgcacaaaaggggatcacactaaagcatagactttgattattggcaatagctttggattagtgccaccgcaatggtgttggtgaattaaagtacactacatggtgggctgtgggtgcatggttttgctagtcgtgcccatggcgattaaggaccggttcgcgggatgccctggaagaacttatcgtacttaccacaagccagcgtgggcaacggctgggcttgtagtgtagcttttctctagccgacatacccaggcgagggtgggcgtgatggagttgggtcggccggggtgtccggttgatcggcttccggattcaccgcggcacgaaaggggggctgcccgttacctgctggggacggggacgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttataggcggtcgaccagattcaccgtgattagtctcacccctagtttagcttaatgaactagtgtagttcaggtggttggttgggcctgttgcaacgtggcgtagcgttggacagtgactggttaatattgcttaattactataactgtttttactgttttcaactactggttttaaatgcccgctttatgcaaatgaaccccgtagcctcctttggttatatcctgcatcatacctcctcttccggtatgacttgctgagtacagtgggtagtactcagtcttgctcttttcccccacaccagagttgaagttcttctcagttggagatgtcttgaagaggttagtttcgtcgctgccgtcaagggttgcctgtggaatggaatcgcccgctgcaggagtcaagtcttcaggcttagctcgcttttatctttttccgctgcatttgtattctttcatatttttgtaagacgtggatctgtatgtcaacaattgtcatttgtgtaccctggctagtcctggacaagggtttaatacacattcagcttagaaattctggttcgtgaatttctgggcgtgacaagttggtatcagagccgaccttgaccgtaggacaagccaactggaaaacctaagagccctctgaaccccttttcatatgcacatgccttcttcacttggatttgtttcgggaaactttggggtttgatcttttgattttgggagaaaatcttggtcgcctatttaatcggatcttttgactagggacagtccagggttttagcaaaactttatttggaatttatttggcagtcagtcgggaattgttaggtggtatgcattaagttgtgtctagattcgatgggatgtagtctttatgtgcatcattattatcatgcatttatttcatgcattaagttattgtttagtcagttgcattagtgtcttttgtctgggttcatgaaaaatgttccatgcataaaaatcatcatgcttggctagttggttgggccatttgttgcattgtttaaatttggatttgagcatgcattgattcctatcccttgtctaccttagaagtcagacctgttcttcgatcgcaagcgccgctccgagcttcagagtcaccgcccttagctttatcgtcttcttagtctgtttgcgtgctagtttttgtgtttaggtttgttgcttgtgggttagtcggcggtcgatatcatgtgtgagtggtatgacagccttaagtaggaattgcgtgcctctttttcagtgttttaatcaagattaagataattgcacttaattttataagaaagattagtttccgagccatttgttttcttcctttctcttatttctacctatcctcatccagatggtgaagacaaggaatgatccccgtgactccaacgacgccagtggcagcgaagagcagacagatgaagctcataccagtggtgcacctggtagcagttcatctccaccgcccgagaacccaacagtccctcagatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgtctggtgggataactacgtggtgacccgtccagatgcaacgaaggttacttgggtagagtttgtcaaaactttaggaaggcacagattcctgaagggattatggcacaacagaagagagag

SEQ ID NO: 46200 - DNA, 1064 bp, Oryza sativa
cagacaaaccctataggtgcccgcacgaggctgataagagaagtctaaacgttatctctaaactcaccgagaacggtcacatgagctcgataacagttactccaaggtctccgcgcggttgagaatatgaattcgttcatttgcattgaagtcgggggctactgtcagggttatggataccacatacctaatagtagttgactaaatctcggcaggactcaccacataccatgtcctatacggaaacaacctacggatataggaggagttccggacaaggaaagacaaccagagttctacatggaaacgacaaaggactaatcggattgtatccatattggtttccctagttctacttggacaaggggacacctatgggtataaatacaaggcccctaggaggagaggggacacaatcgacacccaccatagaagacacggacaatacacacccaccacaatatatgggcaacatagacgccacaaagccacaagccaatataagccaacatacgccaagacaagacgccggatatcgacttcagagataggcacggctagtcccctacggtgtctcaggatactgtcagaagagacgaaagcgctatctctgatctcgccgggcacgggttcgaggaggaaggctaccctgttgtcgactacgagtcagatcgtcagaccgccatgtcgacaacagttagataggctaccccaaatattatactggtgtgattatcatgaataagagcaataccggcttcggccaacagaatgtagggttattacctgacaattcaggggcccgaacctgtataaaaatccttgtctccatctcttttaccttagtctcgcgtatatcctagtaccaacgatccccatgccatgcaaataccgtagtcgagacatcaaacgtcgacagtatgcatttccatgtattagctaaaacattgcgtacgtatgagggagatcatagccacgctggtatagtagtaggtaagttggaagaggatcacgaattgactttaggttctgttgctttgttgcacgatgagggctgcaggaat

SEQ ID NO: 46201 - DNA, 1544 bp, Oryza sativa
tcagcctctcctatccccagctccccttctctcccctctctggctctccctctggtctgccgagtgccgacaatgcacatcgcacgagcggcgcgcagggtgcacaagcacggggagggcacaggcgtggtggccggcgagctgcgcggcggtcagcgtggtgcacaggcgcggcggccggtgaaggcacaggcgcggcagcggcaattcacgggccggcttcacgcactaagagtcaattatgtacaattatgctatttttgatggtgtgtgaattatgtacaatatttgttcttgtcgaatcgatgattgtcttgtattttttgtgctgatgggatggagattttatccaatgtggggccccggtcggggtgcggagccccggaggggtcggggacgggacctgatttggccccgcatctccattcggggccgggggcggggggtgaagtcggggttaggacggggccgttccaacccaacccagccccacccgctccgttaccattcctttcctatacacaatgtaactattattttagttttagttcatccatgcttcttgcagctccatttatgcttatgtattttcgacaccccctgtcctctgaaaatcaggtatcttttctatgcaaatataacaagttagaaagtttcacaaccatataatcatataagagttctgaagtataaatgatggatggccttagaagaatgagggcagctccagcacaggattccgttacgataggaagtcactggataactaaacaagattttatacgtcttttttcggactgagcaccatgttgtccatgtgattgcccccactcgctgccttcgcacagaaacctcaccagtggcgccttccctagctaggagcctgctcggtatcgcgtgcctttgagtgcgatacctcgccagtggcagcactccgagcagaactgcaccggcggcgctttccccagccaggagcctgctcggtattgtagctatgctcgctgactccttcccttgtggaccacatcaataataggaaaaggatgtagtgtgtcgaggggagaaaggaggaagaaaataggagtcaaaggtaaatggctcacctactggccaagcgggtgacagcccgagctccctcctcacagcatgatacctgatacctggtacttggtaacctggtatctatgggtatcagctggtacctaggtaccaacccttataccacagggtatcagtatcatggatgatacatgaggtatcatggatgttacccgaggaatcatcatgcctgataccatggggtatcatggatgatacctgaggtatcaggcttgatacctgatatcaattgaggatgaaacggatggcatacttgtagacaacgtagacgagcagcgaagagctagcgaggaacacaatgcgacaacctcgagacctacaggaaacaccttgcgacctccactttgtcaactccaagatcaccctccacggtggggaatgactgcctccactttgtcgccgatgccccaagcctcatccttctc

SEQ ID NO: 46202 - DNA, 3034 bp, Oryza sativa
tgctaccctggttgccttcctctctgctgacctcaccaattccggcgggcccatgatgtcaccagccttcacactctcactgatgccctccaatctggtgtaggaaggggaagaagatggagggcgcaattggcattggggacgtcatcgattggttctctggcaaccggagatgggatcgcaggaagagagagaggaggaggatggtgaccttggggcagaggagtcgagggaggaggatggtgaatgtggggcggagtcatcgaggaagggagggataaggtggatggcgactgtctgacgaagacgagggagaaaacggatctgagaaaacagaaaatggttgggttgtatatttatcccgtagccgcacgggacgccgttctatagtttttctgtagaagaatagtatgttgcgtagctgccatccaattattttttttgtaccatgccaaattttaggtatgcataatgattttaagaaagtcaagatcacgaaattaatttcatactccttgtgtaggttctggctgtttgtgctgaaaccatgatcaaatggaaaagttatggaaagaagtgaattgtaaactgaaattttgaactttaactcctttctaagatgataaatccagagccctgaaggtatcatctaactctggtgaaaattccatactcttctatctccatctttatcccattcaaatctgcaatgcctggccctattcattttaataaatatgtatctgagtttagaaatagctacagggtgaattcatatgttgaatttctttcttgggataacaaattagtttatgccatcttgtgggaaatattttcccctctgaaaactcgtttatgccaacatcaaattatagaagtgtttgtccatgatgagtcataaaatttctcaaagagttatattttccccgttgcaacgcacaggtacctgactagtttgacagatttttctcttgatgacaaaccaaatccaaaaaaaaaaaatccatttgtatctttcatcattcccacacaagccaaaatccaccaacaccaccttaagaagttgaagttgaaacattctcttccaccctccccaaatcgataaatcctctttccccactaaatttcacctcgaagtcatggttaagaaaaaaacatacttgcattcaacccaccttagactggttgaaccggacgattttgagctgaaacagacaactttgatactaatggaacatgattggaccattataaggcctagatgtttcttcttttttttgagaaatgtagtacaaacgcagacgctcacaacgcgcatacactcacccctatgaaagcacacatgtacaccttacccctatgagcacatccggaagactcgggcgcctcgctgttgacaggtgcattgcttaccactgaaagaataattagctgtaaacgtgagcacccgtgccaaatctaagacttggacccgggtgggttggttccaccacaagaaacctaactagtttagctacgctgtgggatcgagatgtcgactagaggtggggtgaataggaaatataaaaataaattacacctaatcaaaactaacctaatttgctaagctttgtgaaggataagtctaactaagcaactaagttaaggtgtgcaatcatagggtgataagggctcaaatatgtctctatgaaagtaaattgcacaaaagtaaatgagatgagaatgaatttttcacccgaggcttgaaaactcactggtttgcttaatcctcgttgaggcaagcccaacttcaccgctcaaaaccacgaaaccaccgtaagccccctccgtcaaggggtgggcaacgtgggtgccgggccacgaagtggactacccaagcctcgatcactagggtagttcttccttccttccaaaggtggtgaactccaaaccactcacaaaccggcactaggccttctctataatctccttggagaggtcaccgggcaacacctccacaagccttctaggaggcagcaatctccaagagtaacaagcaatgacccagctcggagatgatcaagtgtcacgccagctctacaatgaagcaatgcacttgaattttggctcaattaactctcaaacacaccaaatggatgaacacaagagagtgtgaaagtagttgcaaaaagtatatgcaaatgaagcaagaaccaagagaggccccttactactggtgggggtgtatttatacccccaaactacaaaaactagccgttggggtcgaaatgcccaacctctgttgcctaccggtccgaccgtcattgggtggccggttagaccggccaacagtgtaacggctagttttctagccattacaatgcattaaatgcactggtaacgggtagtctggtttgatcggagtaggccggcctgtcaaaccagccgcagctctggcggctctgtatcgccagttgaggggccgtccaactggctcacaacccactgatcagatggagcctagcccagtcagaccgacactggtcagaccggtgcactccctgcggtcgaatcggccaaggtagacaagctgcaagagtataagaaatcgtaccaagtttcaatgcatatgacctaatgtggcattttgatcatctttttgcttaggtaattacccctattgatggtatggcaaagctatacataaatatagcaaaattcgatcaattaaattaaaaccgttagttttaccgtcttcattccttttgctttgcgccatcgattttaatactcggtgatcatccacggcatacacatcatgtggtcctatctcaaaatgtataactcaacataatagttagtccacaattagcttgttattaattaccaaaatcaactagggggcctagatgcttcatacgctcacttcgctaaggaccaattgtttctgatggcaccatttggtttcttccgaagatcagatacgcattcaatccgcctttacatcagctaaactaaacggttttgaaacgaatcattcattgaaccaccaccg

SEQ ID NO: 46203 - DNA, 7541 bp, Oryza sativa
attcctgcagccctgatgccgtggaggagggctgatctgcggtgggagaaagctcaacaagggtagagcgagggagggagggaggagtatagttggccataaggcccgagcccaatggcccggcccaaggcacaggattttggcccggtctaggcacggcatggcccgatcactgtcgggcccgtgccggcacaacccggctgttgggccgtgcctaggcctatgcctcggcacggtgggctggcccagcatggcacgaaattcagggatgtgaaatatacttattttcaaccatatgtaagacagggcacaaagaatagggaggacaattagacgtatcatatatatatatatatatatatatatatatatatatatatatatatatatgagggaggggaaatagacttatttcaataaaagcacgatgggccgtccgtgccttcggatcagcccggcacggcctgatccttattgggccatgcctgggccacaagtggagcacgtgggccagcacggcacagcccgccgtgtaggtcgggccgtgccggcccaacaaattttggctcgggcacgaccgggcctaggctgtgccgtgccgggcggcccatatggccaactatagggaggagtaggccggggaaggagggaggggctcgccgctcgccggttgtttctgctcctcgacaagcttatccaaagaggaaggaagaagaagagatagatggtcttactagtgggaccccatgttaacgtggcgttcaacagtaccaaaactagtctaatacctctttagggggtgaaatatccggtattgatagttaagaggtgtagtataaccggttttgtagttagggggtgtattttggacaatcataagagttcaggggggtaaaatggacttttccctttttatgcaaaaccaccttagagggttatataaatggtattgaaaagtttagggggggttgaacgtctgcttctcaagttcagcgtgctagacggatttccatatctaaagtttagtgtgggtatttggactttttttcctataaataacaatatctaaacttacattgttggggtttgttgtgtaccttccattaactataagcatctcgcgcacataatattcacgtactatggagcctaggggtttctcgaaacacttcaaaagaaaaataacaacgctaattagaatcaaattggtgtatatatgcatgaatttaaggtgtttatgtgttatgtcattacatgccagcctgttttaacttgcagcttttgtttttatcctatattgcccatcctttagacatgtacattctgtgtgcactgctcgaacaaagtaattgacatgttttacttacaaattttttatagtaagaaggtagagtggacgaatttacttacaaattcaaaattgtaaggaactctacaggtatctacataaaagtttggcatgtcacaatatgatcaagtattctgtcggatatatgttcgtaggtgggctatgtaacctccgtggactctctcggcctggttgggattttgacggaggtcgtcagcgaaaactgatttgcagtgtttggaaaaagatattccctcagctttacatgaatctcaacacagtatgatgttccaatattgtatatcagtatgtcacacaatattgtagtatatcagtatatcagtcttagtttggaatgtaaggggccttaataacagtggaaaaaggtccctcatagcgaatgttgtgtcttcctcccgtgcctccctctcttctgttgtcaagaatccaagctggcggttttagaccagcagctagttgctcaaacttgtggtgcatctcttgatggtttcgattttgtttttccagcgatggttcgaggggtggtgttttcacggcttggagaagtgatcgctttatggtctcttgcacccacaagggtcattggtcgctcaccctaagcatcaccaacctagaaggaggtggctgctggttattaacaaatgtctacgggccacaagacgctgctaacaagatccttttcttggatgaactgctcctggtcggccaacaattggtgactgggccgtggtgtgtcgtgggagatttcaacctgctgtcggctgattcggacaagaacaacagcaatgttaacaaaagattgattggcagatttcggaacatgatggactcgcttgaggttcaggaggtttatctctttgggaggcgatactcttggagcagtgagcaggaaaacccgacactcactaagattgataaagtgttggtgaatgctggctgggaggatttgtttcgtgatgctcacttgcaagctcttagttcttcggcctcatatcactctccgcttctgttggcctgcgacattatgatgcatcggccgcgaagatttaagtttgaatctttctagtctcggctggagttttacttaggttttgatgatttgttaaggaaacttgggagtcggtgcaaacaggttctgatgccatttgcactcttcatctgcggttgtgcgctactgcagctgccctcaggaaatggggggaacgtcgaatcagcaagctacgtctccagttggtggtggcctatgaaattatcttccagctcgacaaggcgcaagatgataggctgctcatgggcgaggagagggcattgcgggctactctgaaggggcgttgccttgccctggcatcgctcgagcggattcggctaaggaaacgctcacgcctattattcttgaggtatagcgggacatccgcccaattccatcaactaaaaattaatgcacgcaggtgtaagaaggcgatcgcctcgctttttcactagggtttctaggctacaactgaggaggacatgcttgaagtcacccatgatttcttcttcggcatcatgggctcgcctactcagaggtcagcagcaatcgacttcgcgcaggccggcatgcatgcttttgacctgttggaacttgaaacagacatctcagaggaggctagacagatcaattttgctatgccgagtgagaaagctctaggacccgatggttttagcggggttttttcaagagatgttgggaggtgatcaaggatgatgtggttgccgccatgaaacttacttggagagtgaatgcacgtcatctccacctcttgaacatggcctccattgtgctgctgccaaagaaggaagagccgactcattttggggagtatagaccgatcagccttatccatagctttgtcaaaaactcaaaatcctcacgaagatcatggcctctaggctatctgctagaatggatgagatcatcaggcaatctcagacggcatttatccggaaaagaagaatccatgagaactttctttatgtccaaggagcagtcaagcttttgcaccgtaccaaaaagccagctatgttgttgaagattgacattgccaaagcgtttgatatagtctgctgggatttccttcttgagctgatgcaatttctgggtttcggcaaccattggcaggactgtgtcgcatctctcttggctaccgtgtccatggtcgtttccatcaatggaagggtgatcctctttcgccactcctgttttgtcctggtgatggacactttcgcggcattgtgcaacactgttgttaccaagaacaccctctctcctctagccagcgcccagattccgctacgggcgtccttgtatgcggatgatgctattatcatcctccatccctccaggcaggatgtcgaagtgatccaattcattcttaagctcatgggcgaggcaacgggcctcatttccaacctcgccaagaactcctttacgccaatcaattgttccgagactaaaatcttggaggtaatagaggtgcttggatgtctggttaaggacctccccatcacctatctagggctccccatgtctactcgtaagctgtcaaaggcccagctgctgcttatgttggataggatggcgaagaatctagcaggctggaaatcatgcctgctctcaccggacgctcggctcgctctgatcaaacatgttctgatggctatcccactctatcttttatcggttttggaattacaggtgtgggcggttaaggcaatagagaaaaaatgttgcggcttttttgtggaaagaggatgaggatgcgtcgcggggggggatgcagccttgttgcttaggaaaaactcttcttgccaattgagaatggcggtctgggcattgtcaatcttggcagaatgggcattgcaatgtgaacacgttggctttggttgcagtgttcccaaccggagtggctgtgggcgtccttcgcgccggctcaagacaagaaagccgagcatttccttgctgcgggttgcaagatggtgttgggggacgggaacaacatcttcttctggacagacaactagctcccggatggaggttctattctgaactgggcgccaattttatgttcttacgtcaaaatcaggggaaggacagttcactcggcactgcaagaggatgcctggaacggcgacatcagggggggttatcgctccaagctatgatggaatatctccaagtctaggacctgatcaccgctgtcaccctgaaccctgctcagtcagacgtattctgttggaagcctgctacggatggtgttttctcggtgaaaacggcctactccctcctctgcgccgggaagacgtggtcggcggtcggcagattgatcttgaagtcccgcgcactgacccgctgcaaattcttcatgttcctcgccatgcgatgggcttgcttgacgacggacaacctccagcggcggggctggcatctcgcctcgttctgtcacctctgcgggaatgatgcggaaccctgcgcccacatcttccactcctgtgattacacgaagtcggtatgggcgcaggtcagaagttgccttggcatttcctgtgattctccttctagcgacatgctgagttggtggtgcgtggcacgtaaatcggttcacaagacggattggaagacattcgatgcgggagttatcctggtggtgtggttaatttggaaggaacgtaatgcgtgggtgtttgatggaaaggccacttcagcgatgcatctgtgtgcgaccatcgctgatgagtgggaagcatggaaggccacgggtttgttgtgcgccattgattgtggttagatagactagtcattttaggctctccctacggcggttggttggttgttgcctctaccgttcttggtagatggtattttgtaaaaacttctcttcttcttaatatacatctcggccggtttttgctggtccggcttaaaaaatatttgtagcatatatctgcatatcactgtactccaaatattgtgtgacgctattttacaacactgacttatttaacatatcagaaaacgtggtgtttagtgatatttgcaacacttaaaatttatagcattttttttcattcacagggatatgaagcaaccagtgcagtactttcccagtttctaacaatttatactggataagcaacagaacacgcgttgggcctcctgctatgccaacggggcgaaaatcattgaatgatgtttagggaagacctttgctaagattgtcagcatattagttgtgacgaggaagggacatgaagcacatgaacaaccacctagagccagacaatactgcatggaacgagggaaaaaaatgttcatgtgtggcattctctcaaatgacacgaggttggttgctttgttaaaatgtcagaaaattcactattcaatttgccaatactaataccatcattgaggattgatccctaatgacggttggagggtattaccgacctttccaaccatcataaccgtcatactcaaagctataaaagaagctcctctaattccatttcacacacacttcaagcaaagctctctcatattctctcaagtttaggaataaattctctttctgttatctttccacttagcttagatgtattagtatgagaatgagtagcttactacttgtgtgtcactctaccctttgatttattgacttagactatgattattacaactaacaaataaattattagtacggttctctctactatgatcttcccacgggattaaataaatacgatacccttggaatactctcgggtgaaatgctacaatggtatatccgtgcgcttgcggatgaactctgtaaccataatataccaagagtatttatgcgtcattgctgggaattatatttctagtaatatcgttaagaaataccaacaagcatttctggcgccattaccggggaagatttataatagagattaccaatactaatactttatttttacctctgtataatcactgtcctttgcaggctaaccttggttgttttcacttttgttgtggaaacagggtagtgcatgactagtttcaacttgcgaacgatcaagtttttagagagcgtctcggcgcgactgctcctgttcttctacgacaacgctgcttcctctacttctgcttcaccatggcttctactggagagaacgggaacgaaggagacaacatgaacgggggcaatacgaatgcctcaacatcttctgggtataagattttaactttacttgattttcttctttttatttatgtgttcacaatattatccataggattacaatcctatgtgaatatcgattatgtttatgcttatgttatcaaaagcatgctcatgtttatgtttagcatgtttatgtttagcatcttcactagatcgcttcttattgtgtatgtcatgtttattatcttaatattttggattaaaatatgtcgaattatgaccatattttcaacatatgcagggtcattaagttttttatcctagaattttcatgactatttgcaccataacgcgtgccgaatatttttaggcacatcattaccattactttggacttttaaataaaacattatccttctcgaattcccaatcccagctacataatccctccatcctaaaaaaacgaatttaggtttacatgtgacacattatagtaaacgaatctgaacagagatatgttcagattcgtagtactaggatatgtcacatttagtaataggttgattttttatgggatggaaggagtatatcagtgtactccaaatattgtgtgacggtattttacaacactgacttatttagcatatcacaaaacacgatttttagtgacatttgtaacacttaaaatttatagtagcattttttttcattcacagggatatgaagcaaccagtgtagtactttcccaatttctactaacaacttatactggataagcaacagaacgcacgttgggcctctgctatttcaaccgggaggtctgcggatgttgagactagagcgaaaatcaaaatcgtttaacaaggtttagggaagacctttagtcgtttaacaaggtttagggaagacctttggtgaaattgtcagcatattagttgtgacgaggaaaggacatggagcagggctgcaggaat

SEQ ID NO: 46204 - DNA, 882 bp, Oryza sativa
attcctgcagccccttgaggatctttcatgatctcctgaaaatatcaacacgagtcgtcacaaatgcacactagaaaatttttcatcattgaacattttcgacaagaacattataaaaaacggataagcgaaaaaatcatccgagtttaaatttatttatttaccatgaggatcggacagatgaaaggagcagggatacaaacttctggtgatgccggtggaaagtacgggcaagaagagggcttcctcatcagtggcctgacgactctccacacatcgttcaagagatcgggccgtttctcccttgccatttcagcgcatctaacaccaaggacagccagctgtttggcctccttgtaaggccagtctccagcagatttatcgatcagcctgtgcaggttatcactctccaattccgctgcaactttcttggacagattcaacggtgccatcccggtcaatagccgtaggatgatcacaccaaatgaatacacatcggagagtgttgtgagctccccggtggtgatgaactcagggtccatgtacgacagcctctccatcaggttgggtgggcaggtcccgggctgcaagaacaggctcgataggccgacgttgcagagcctgcttctgtagctggcgtcgtcgtcgatgaggatgttgcaaggcctgagatcgccatggatcaaagcagcagtaggaggattcttgttgttcgagtggaggaagagcagcgcgcagcagatctccccgatgatctgcgtgcggttttgccatggtagaggtgttgaattgttcgcgcaaacgatgtggtcctcgaggtttcttccgtttggtaaccattcgtacactagggcggagattttcgagcatactccgataaat

SEQ ID NO: 46205 - DNA, 1451 bp, Oryza sativa
actgagtattcggttaaaaataaaaaattatagtgtgaatcacatcatcaccccactctctttccccttattctctcccttactcctctctttccctttcaacatcgtcgtcatctaaggcggctcttgttgtacacaagatggttgggacgggggcagcagcggcaacatcttagacaatggtgtagtcagaggcggctgcaacaatagtgcggccaccaacggggtggactagtcggtttgtggctaatctaggctgggaagggagagggagagggagagcaaggtcatcagaggagcaggaggcgctgcagtggcggaggagaaggaacaacgaccccgcgggcccttgtgatcaagtggtagacatgatgaggagggagatggtggtgtggtggcgaggacgacatgttggaggggaagctgtggtggctggagtcgctaaggtcggagccagaggggctgccaagggcattggtggcagataacgaaaaggtggtcgttgctgcttgtttgcttgagcgggcggcccagaagcaagtcgtcggcagtggcggaatcgttgtctagcggcgcgaggagtgcatcggatgaggtgtggtacttgcacttgagggtggagttatggtggttcttgatggcattgttggtgcggatgacgaggagcctaacgatggtggcccacttgtttgccgaagcaagcgtgggcgaggaggatggtatcatcctcctcgggcatgatggggtggtgctctacccacagtgacaactggttgcacaccagaggcgccacgacttgctggacctccccgggatggacttctaatgagcgaccagtcgcgcgccttctgcttcaccacctgccgctgcagcacctcgtccttccttgggttccatcatgatgatgaaagggagagaaagaaggaagggagtgaagaagggaaagagagggtcatgatgtgggtcccaccgaactcactgacatgtgggtcccatctaactttaagtgccacgtcagtcgaaaacgtcatccaaacagtcttgggatcttatttgcactgattgggagttgaggtatgcgttatatctggtattgcggtttaggatgaatttcagacttgacgacatagtgacagatataacatgtctgcaataagttcactttaggttccttatagacttcaaattgtatccttgaactgcaatactagatgtaacatgtctctcaacttataatatcggagtacccgagatcccagagtagcattatgtctaattttggctgatatgatgagttgactgcagtcaactcgacaagtcattgtgggacctacatggaccctacatgtcaatcacatgaaaaatataaaaagaagaatagaaaatccatgaaatgccattgacaaacaccctaatcgaagaaatgccatcgacgaacgcgacttccagga

SEQ ID NO: 46206 - DNA, 2697 bp, Oryza sativa
  unsure (1)..(2697): unsure at all n locations
aagagcatcagaagcacgggagcaaaaatttgaagaaatcattgcacaagtcggaattgttgaagagaagcgtccttcacttgatgtctccactcgttggaattccacctatttgatgctttcctcatccttattattcaggagggcttttgattcattggatcggtttgatcctaactttaaagatgctccacaatttttcgattgggagaatgcagaagttctttgcaaacatctcaaggtcttctatgatgcaactgttgtggtttccgggacatcatatcccactgttactcgctactttcatgaattttggaaagtgaaggtgatgattctaaatgagtccaacaatgaggatgatcttgttgctagcttggtttctaaaatggatacaaaatttcagaaatattgggatctacagttcctgcagatttgggttcctgttatttttgatcccagatttaagttgaaattccttgagtttaggctgaaagcaggttttggagataaggcaactggtccaaatggatatctccctagaattaagaggacagtccgtacttggtttgctgaatattcttcacaaatttgtggtccaagcacaaccaattctcaagaagcatcaactagtggggtgaatgttggtggcagccaatttgctgactagaggcaatatcttcatgatcaaagcaagagtaaagtaaagactgagttaactagatatctcgaagatattcctcaagaaaatgatttccctgatgatgattttgacatactctagtggtggagggtgaactcttgcaaatatccaatatcatcacgcatggcacttgatttgcttgctgtccctgcatcctcagttgcatcagagtctgcattttctactggataaagaatcattagcgactataggagtaggttggctagtggaactgtggaggcattggtttgccttcaagattggatgcgagccgatggtatgaagcctactttagttgtgcattgctacttatattatgggccatgaacttatttatgttgaacttttgtattctgatgttttaggttttggtgatccatattcaattcaaactgatacggctgagggcgatgatgttaatatgcaactattgggtattcaaattacttgattttatatttctgtatgtctaattgaatatgggtactatgatgatctaataataatttacaatttattctacatttgcttcttaaatgagttgctagatctggaaaaagagttgtgtacacatgctgcattaccccctcaccatggtcataaaactgtaactgaaaattgtttctgttccttaaatagtactacataattttatcttcatttctaggtagtttggacctctctttttgtgggggtcagattcacttctattctgttagatagcttttaaattcaatccaagatgttctggcactggcaatgtagattatgttccaacttttaacccctttttgttgtcactgggcaggacattaaatcatttgacatctcaggcaaattaccatgtgagttctatgcaatctgggttctgagaaattttgctagttctggagcagtggtaagtggagcttgctttgtttcccagctcatatcagtgtttcccacacatgtcagattacatccaaaatttgtacgatgtattggaaatttagttgagcctgggatttctggacttcttttctgccgttgagcctgaaattcatatttgattttgcctggtgaattctgcatgagtgacaggaatagatgcaaggattaggcggctttgttgctgtcaggatatgcatgtcttttgagtccctttttttttcccctttatgctgttgttaagctatgaatattttggaaggggatttttttagaacaatttgattaaggatcggtggatttttatgccaaattgtagactctgcttttcgctgcagtcactgtctttcagaagatttcagggcccaagatggttactaatatttactgattttctgtttcatctgaagattcacctctgcaagcctgcatttttgcttatactgaagaactctgaatcttcatgcttgcataccatatatcgcaattttttttcctttcatcttggtttaattagcagatgtaattgttgccacagttgaagagaaggcagtaatttttcttgcattgacagtgacaactaatgctggatactaaggcagtaatttctcgtacgaattgaagcccatacgagagtgattacacatgattttacacgcataaacaccacacacacatttgcgggacccgcctgcaagccgccgggcaaatgcgggcgtgcggacgcgggcgcagcctgcccgctccagccgtgcgggcaatgcggacgcggcgcgggctgtccgcaaccgcgccgtctgcacccctaccgtctgcctccgtgtccgcttccgcgccgaggaaatcgagctgccattgcggcgtggcgcggcagcggcatgcgtggggagcgagcttcttgagcttccccgcagctgcggcggcggcggcggcaaggaatcgagagacggagaaggcgatggcgatgctgacgccgcctcgggcggcgaggggaggaggaggaaggangagagcggcttccattgctcgccgccggtagactgcgcggaatgcagcaggggtagtggata

SEQ ID NO: 46207 - DNA, 5359 bp, Oryza sativa
cattgaatcttgtattcaagttaggatttggttgaggagttgataggcctctaaactattaatcaaacaaaaaaaaagaaccaaaagttgacatatttagaaataccataagaatatggtacaatttgaaaacgtcggtgtgcaacaatattattttcatttacatttccataatttttaacatttttatcagtaaacatttccatattgctcgatcaataaaaataaaaaatgaactatttccatgagcctttttactatagggatatcggtggcttgtttgtcaactttagaaaagaggatcgggagtttagataagaaattgatgatgagatcaccatgagaatttaaattttagtcccaatcttttatttggtaaagatggtaggaatcgataagaagtttagttgggagattagatcttaaataaaaacagatgtttgagatttgtttaggcaaagtaaaaaaatgaatttcctctaaattaccactccctaccaagtagttcctctaccaagtttcaattcctcatcctcatcctactcaaactttcttgtctcccaaacaaacataatatttttatttaaaaagtagactaaacataatagcctcactcttctatgctcccaagcatcagctaataatatctctactcgtacagttttgcttgttttgaattttttttcgaaccttcttggtacgacgacactatttcggtcactccgttgttcatggatcgttctgcgttgcctagtctctcctaaaaactacacccaaacaaacggtccctaaaaactacacccaaacaaacggaccctagaagattaacgtggaggaggtggatcctcggccgtagagaagcacttacgggtgggcgttagggcgcatcttgaccgtccaagtagaatctaacgtctgggattgctggccagttgttcgggttttcctgtctctgattgattcctgaaatacattggagatcaagcacgagataatccgctacgaacagcatcaagcggcggccgttgagctgagaaaatatactgaaaagttttttcatggttgtttcgtgcataatgcctaactgagggcttgtttagttcacaaaatgaaaattttagagcagtcatatcagatgtttgaccggatgtcagaaggagtttttaacatgaatgaaaaaactaacaactagattgaaaaactgtagcacttataactaatcatagactaattagattcaaaagattcatctcgcaatttccctcttaactgtacaattattttttttaatctatatttaatactttatgcatatgtctatatatttgatgagatgtttttaggaaaaacttgtggggaaccaataaatgacacggcaagtaatcacttgtactcctcgatgatacgaattaccagtactcctcgatgcttaactgataaatgacacggcaagtaatcacttgtactgaacataagaaaatagacaactcggtgccgctagagtaatactggcatcagcagagacattccatgggcttaatttaattttcttttgtccggaactagtgacagtgcattaggagttcattcaggaaaagacaaaacacatactgcagtatcatacctagatgcatccaacttccaattctctgagccagcaaagatagggcatgttctaattcaaaactgcaaacaaactatagccgactcaaccaaagatagggcatgttctaattcaaaactgcaaacaaactgtagccgactcaaccaccaaacatatgagaggcagtaagggttgaagatccatggatctgttcaggcgatggtaacatcaactcttccggccacttggtccagatcacgccttccctgggaggtgatgagtcttccgctgacatagattagcacacgatcatcattataacagaagatacgccaagaagtaaagcatgaagcacttgtaaattaccccttggggtcgacatcgatgatgcccatcttctgcagctgctgaaggatgttgcgtgagatagcgccgctgctcttgcagaagtgcgggggacgtgagccattcctctggcggccaccatagatcttctggaagccacctacaccaataccctgcctcaggtagatcttccttgcaatcgaggctacagaaaacaagcaacaaagtcacaatcatattaacagtgttatgctcagatccctcgttgtgattccttaaaagaaagtgagacggccaggcattcatgttgacaaaggaacatgaatgctgtaaaagaaaagggtactcaccagccctcgtgtagtaccagtccggatcataaggagggagctccttgaacctcgcagtcttcacgatgtcaacccactcagggagctccatctataagagaattttaattgtcaaaacttagaacaaagaacatacacaaaggccaattgatgtaaatggtttcctatcgtagttgtaatttgacggtaacataattacaaagctttatttcttttatagcatcaagagtgccaactaaagtccacagcacagtgcaacaaagaatatatttaacatgaaactaaacagaatagataatcacggaatttgtgaccagcgtgaatattccacaacaagcggtacgcaaggacttcatgcagcagtagtcaaatatcatcacattacatttcttatgacttaacgtgaaacatttttatgcatgcttaaccaacaataaaccacatcttgacaataaagagtatttagctcaacacaaaagaacaagtaaaacacaggacgacctggtaaaaagatattcgaaggttgcctaacaacaggagctcctggctggctacaaacaactgtccaaattagagtcgagatctcaatcacataacctaatcacgaaaaatcaacatactgcaacgccgcatcaacatcaacgtaaacgaaatgaaggacacaactacactaagcaacggcgcatccaacatcaacgtaacgaacagatcggatgcttgtccctaagctaagccgcagcagcaaaaggaaaccgtgattgcatccgcacaaggctcaacaacaccgaatctccataggggcgggggcgaccacatcccatccatgatctaccaagaactcggatctgcgtggaaagcgcaaggtaagggcctggatggttggttggtcggttgcttaccttgccggagcgcttgaggtgggcggagtaggccttgacgaactcatgagggttcacgtccttcaccgtcctcgccgtcgaatccgccatcctgccgccgccgccgccgccgccgccgtgggggggaggagaggagagaggagggagtgagggtgcggctgcttggggggctagggttttggggaggagcggatgggagcggatttatacagcggcgggtttggttgcggggcgtcggatggtagatggacggctgatatggcctgagcgcgtgggtctagggtccgcggatggtttggtttgggctggaggtggtgtacgtgggctgagttgggctcctcatgactcgtttggggattaccaataggaataagttcactggaagtccctcaacttaacagcgagattttgtttaggtctctaaactacaaaaaccagaaatgtgtaccctaaacttatagaaacaatgcattcatggtcctagtcagcaaaaaaatttaaaaaaaacgtggggcccacatgtcagccgccctctgctcttttcctctgcttctcttctctttaatctcttctctcttatcttcttcggtgaggggaggccggcggcaggcagcaggtggcgggtggcgagcggagcgacggtgggcaagcccggcgacaggcgccgggagcggagcgacggcggcatgcgagagcggcagcggtcggcgggtgctgggcggagcggtttgggagggagagggaggcggctggcgagcccgttcgagctcacccggcctgagcgcgagctcgccccgccgtaaattggtgtgctggtggaggtgtgccaccggtggacggcatgcgtgaacgacgacgaggaaagggggagagcaacggccgacgacagagaagacaggcgagcgcgacactgggctgatcaccctcgccgaccaggcccctcgctccgcagcactcgctcgccgccgtatgcccactgatgctccgcgctaccgcgctcgtggaggaggtcgagcagcacgatgacgccgccggcggtgaagaactggagcatgacgagcgccgccactctcgcccaccgcccatgtccagcttcgctcgcccgtcactccgctgccgctctcgctcgccactccgcctgccactctcgctcgccgctctccgcgccgcccgccaccctacccgccgctcccgtcgtcccggccgcctctctccccctctcccgcttcttccatgcacgctgccgcgcctgcatctgtctgcctgctccgcgccgcccgcctgcgcgctcgcttgccgcccgccaccggcctcccctcaccaaagaagagaatagagaagagagaaaagagaatataaggagaggaaaagaggatagggcggctgacatgtgggcctcacttatttttttttattttttttctgactaggatgccacatcagcgaaaccacctatatatactgccataggaccttaagtgtacggtttctgtaagtttaggggtacacatttctggttttatagttaagggacctaaaaaaaatctcgttgttagttgagggatctttggggaacttattccccaaacttattccccaatacgtccactttagggcccctcaatttatcgccgagtctaaaattcgtctgtgaacccgtaataccaacatgacacgtctctcaactcctaaaaccagtgcaaataagatcccaaggtggtttggacagcgtttttagctgatgtggcacttaaagtcacataaaatcgtgggacccacatgctagtgagtgttcggttaaaaataaaaatttatagtgtgaatcacatcatcaccccctctcgtccccttattctctccattactcctctctttccctttcaacatcgtcgtcatctaaggtggctcttgttgtacacaagatggttggggcggggcagcagtggcaacatcttagacagtggtgtagttggaggcggctgcaacagtagtgcggccaccaacggggtggattggtcagtttgtggctgatctaggctaggaagagggagggtgagcgagagcgaggtcgttagaggagcaggaggcgctgcagtggtggaggaggaggaataatgaccccgcgggcccttgtgatcgagtggtagacgtgatgaggaggg

SEQ ID NO: 46208 - DNA, 890 bp, Oryza sativa
attcctgcagcccttgaacatttgaacacctgcatgaagtattaaatatagactaaaaaataactaattatacatattacgactaatttgcgagacgaatcttttaagcataattgctccatgatttgacaatatggtgctacagtaaatatgtgctaatgacggattaattaggcttaataaattcgtctcacgtttactgacggattctgtaattggtttttttattaaatgcccaaacaccccatacaacactctatataatacccaatgcgacgtgccaaaactttagacacctggatctaaacaccactctgttccttctcctctataaatggcaccggggtggtttgtcggcaccaaaggcagaaaagaaagccaatggcgtcttcaggcctcgcagttgcagcaacagcctcgtcagcctggctctgctgccccaatcatcacatccataccagcagcagcagatctcgcaagcatcttcttctccatggcctgtacgggtctgcacctgcacgtactaggtatagtagctgcaactttattcacaatgtgatgtcacgttattatatatgtttcgtcgtcaatggcggcgaaccttgcaggggacgacggccgccggtgtggactgcggcggcggccaccgcagcagcgccggcggacacggcggcgtcggcgcggcgggagcaggtggagatcgcccggtcgctgaacgcgtgggtggaggagaacatgctcccgctgctcacccccgtcgactccgcgtggcagccgcacgacttccttccctgctcggccgcgggcggcggcgaggcgctggcggcgttcacggagggcgtggccgagctgcgcgcgggcgccgccggcgtgccggacgaggtgctggt

SEQ ID NO: 46209 - DNA, 861 bp, Oryza sativa
attcctgcagcccatctcaatcgggccactttaaagcccatcaccgatgactcatatcggtgtcgggcttttgttgatggccgtgagagataacttttacttaggtcatttttctatataacttttttttgaacagttttgtcaacgggggatacccgtagaccggatatagagggtactagggtacgctggtacaatgatctacgtaatacgacatctagcagacagaaaacaaagattatactggttcaggccccttgatgggtaatagccctaatccagttgatatgggattatatgatggaaaccacagattacaaagggaatagcggaactcgatgataccgacgagatcgtaatcgatcaggttcgcttagatctcccggcgacttggctcctgtagacttcaactccataggctgtggtcgatgtgttggctatgagattcgatgccttaggtcctcctggggggtcccttttatatcgcaggtcaactggtctccaagtaggactcggagacatcggacccggcatgatacaatgatgacccagttctgtccgagtaggactccttccatctgtaaactccgcgatgaatttccttaacgtatgccgaaaacgtccgtatacgcgcaagtataccatatcgatatgtgacgtatatcgaagggtagagggtataccttacccataaccctgacagtagcccccgacttctgcttaaatgaactcgtgtaaccgatcatgacttctgatgtcgaggttgttgtcattctcggtgtgaggaccgagagacgaggagtaatcgacaacgccaagcgaagctcaacagtcacgagtgaatttaaattgaagtccgaa

SEQ ID NO: 46210 - DNA, 1556 bp, Oryza sativa
gttatttttgttttcatctcctttactcttccgtctggatcggcttgctttgttgtgttctcaggagagaagagcagtttgccttagtcgtttccatgctgagcagacctcgagagtgcgcttgctgaccaagatcgtcgcatccaatattggaggacgaacgttgaggtagcggaacttgagaggactatgctggaagtgaagaaggaccaggccgtggaaacactccgaggtcgcgaggtgtggttcaactcgtacctgaagagttgctgcacgtccatgacaagagtctgtagagagctccgagtaccccatggggatctcgaggaatcggcggccggatacatctcgtggctgaacagtgcctgcgccaagctcgaaggcatcggcaagcgtatcgacgaggccctgaagcaggagtgccgtcaatcgagccgatatgccggggggcatgtattggcttgcatacgagatcatcgtctgcagctgcacctcgagttcctccacgaagggttttctcgttctcggagaaatcctacggagatagatcacttggcgaagtcgatggtgccgctggcggagaaggtcttccagtccatggaatggtgttggcctccctggtagtctccgtatcttgtgacaaatgtcttagggaaaagtgtaatataattttggatttttacggaattgtaagaagtactttgtgaaatagaaaagaaatctatctaactaagctttcttactctatacgtagtgtgtaagagtgtcttctcacttcgcgacttcgatcagtcgtttgagttatacactctcgctagcccccagccttgtcatcggagaattcttcttggaagataaggctcttggacctttgacctgccttggttgaacaagccctgatcctagcccccagccatgaagtttgaaaattaatttccgattacacggcttggttaatacgcacggcgagaactcttacacgaccagatcttacatggtctttcgtctctacaggatccgacaaggccttatccgctctgggcgtccccagccgatgttcccttaggttccttggaggccttgtcaagacggcgtaaagggacatgaggataggttttaacgctaggtgtcatctgggtaagggatcatcaggaaggaacacttttattgtaatctgtacctgaaaataggctttattggagctgtaagatgtcttacaagtatggatactattgacatatacatagaatttacgtaattgatcaatgttccaggaatttgccaactcgcccccatagccgtttgcaatcttgaatgcgcctggccgcaagacttgtgtgatcgtgtacagtccttcccatttgggtgagagcttgtttcgccctgcttggctttgaacccgtcggaggacgtagtcgccgatcgaaagcgtgcgtgctcggatgcgcttctcgtggtaagggcgaagggcctgttggtagctggttgctcgaacggcaactcgttcgtgatgttcctcgagtagattcacatcgtcgtttcggggctgcaggaat

SEQ ID NO: 46211 - DNA, 1676 bp, Oryza sativa
cgagtagtctttcgtactcggctatgttattggtcgccctgaagttgaggtgaattgcatgcttgaattgttctcccgaaggtgatgtcaagatgaatcctgcccctgctccttggctgttgagcgcgccgtcgaatgccattgtccacgtttcgctgtcgattttgttgtctgacctgttatcagtcatagtccaatcggctacaaagtcggcgagtacctgggacttgatggctgttcgtggcacaaagtgcacatcaaattggcttagctcgagtacccattttgcaatgcagccgacaacgtctttgtttttcacgacttcaccgagagggaaggaggatacaactgtgaccctgtgggcttggaagtagtggcgtagctttcttgatgtcatgattactgcgtagagcagtttttggatctgtggatatcttgtctttgcatcgtggagagcttcactgacgtagtagactggtcgttgcaccttctctctctcgacaacaatgacggtgctaacggaatatggcgtggcggcaatatagagaaataattcttcattaggttggggagcaacaagtacagggggatttgataggtagcgcttgagtgcaatgaatgcctcttcggcttcctgtgtccatacaaatttgtcttgcttcttcagtagagcgaagaaaggttgtcctcgctctcccatcctagcgacgaacctgcttagtgccgccatgcatccggttagcttatgtacttccttgagtcttgtaggtgacttcatgttctcgattgccttgatcttctcgggatttgcttctattcctctgccagagacgaggaaaccgagcagcttgcccgatggtactccgaacgtgcacttctatggattgagcatgaggcgatatcgtcggaggttgtcgaacgtttcccgcagatcgtcaatcaatgagtcgcttgtattggtcttgacaacaatgtcatcgacgtaggcctcgacattgtttccgagttggtcgctaagtgcgccctggaccgtgcgctggaaagtgtttcctgcggttattagtccgaacggcatcttaacgtagcagaataccccaaacggcgtgatgaatgctgtcttctcctcatcctctttcgccatgctgatttggtggtagccggagtaagcgtcgagaaagctcaacaacttacaaccggctgttgagtccaccagttggtctattcgaggaagagggaagtgatccttgggacacgccttgttgaggtcggtgaaaccgacacacattctccatttcccgttggccttccacaccatgactgggttggctagccattctggatggagtacctctccgatgaaaccaactttgagaagcttgtcgagctcttctcgtatggcttgttttcgatctggtgcaaatctctgcagtttttgctttactggcttggcgtcgggtcgcaccatgagtttgtgctcaatcacctccctgggtacccccggcatgtcggacggctaccaagcgaacacgtcagcattgtcgcggaggaaggtgatgagcgcgagttcctatttctcgcctagtgatgccccgatcttgacggtcttgtcggggttggcaccggagagtggaacaatcttgattgcgccgtccggtttcgacgtcttgtttcttttg

SEQ ID NO: 46212 - DNA, 2273 bp, Oryza sativa
attcctgcagccctgggcgtgtgctcgaccatgtcgaggctccgcttgtcgcattgtattgccagcttaacattcccttgaatagtgattattcccttcggtcctggcatcttgagcacttgatacgcgtagtgagatgcggccatgaacctcgcgagtgcagttctcccaatgatggcattgtatgttgtatcgaattcagcgacatcaaaggtgatctgctccgttcggaagttatttgcttggctgaatgtcacacgcaacgtaattttgcccaatggtttggacgatgactgaggagtgattccatggaagggttgaccggtgggtgtcaactcgcttcgtgggatccccatcgcgtccaaggtgctggcgaagagaaggttgattgagctgtcgccatcgatcagaactcgcgcgaacttgatattccgaatagttggttcgaccacgatcggatatcgctctgggatgacagcggtcttggggcggtcctcttctgagaattctatcttctgttcagactacttcatcttgggcgcagctccctgtcatgttgaacaaacttcacattccactttcttgtattctcgctttgaggagtatgccgtggaacctccgaagatgtgcgagacatggagatcggagtctgggtatgctgagtccgattcctgagtagccgcctcagcgtccttctcgaccacacgtactcgcttgcctttttccaatgccatgtgttttgcgagcgactttttgaagacgaggcaatcttctagagagtgtctgtccgacttgtgtatagggcaccatgttttcttcgtgtcgctgccttgtgggtctaggcgcttgggagggtccgcgtattctgttgcgagaacttccgcttgagctttccttttcctactcttgcgatttttcttcttgcttgactcaggtgcgtccttggctggtttcttctctcctccggtcttcggtttgtcgttcttgcgtctcagtgcgtcgtccgcatgagcacatcaatcgacaattttgaataatctccgagtagtcatgacgcacctcgttgccaactcctgggtagtatagcgatctctgaaaccggacttgaacgtgcggattacagaagcgtcggtgatttcggggattgtatttctgcactcatcaaagcgtcgaacataatccctcaaggattcacccgagttctgtgtcaacgcatgtaggtcgtcttcgatcgtgtggcgcttgtaagttccctggaagttggcgacgaactgctgccacaggtttgcccacgaagaaaccaagtagggtgggagatgcatcagccatgaacgtgcagagcctttcaatgcagttggcaaataatttgccaacgcgttgttgtccgcttgggcagcgtagagtaccgtggagtaaacctgaaggaattcttctgggtcggtactcccatcgtacttctctattgctctaggtcggaatctctcaggccatcggacatcacgcagcgaacgactgaaagctctacacccagcgctgggggcggtgggttgtcagcgatcgtacgtccttcgtggatgtctatctgatgatgaggatgaggaagatgacgacgatgacgatgggtcacttggttccgctgtacgattacgagggtgtcggccgggttctcgagaatcctatcgtcgtctcccgttgttgtcccgacgccgatctccatcgtcgtcgtcattatggcgacgtcctcgaccagtatcgcccagcacccgccgttcgcgatcgtcgtgatcgtggcggttgtggcggttatcacggtctcggtcttcgctcgaacggcctcctcgttcttcgttatcgtgacgtcgtgaagagacgcgatgtcgggaacagttctcgctgtctcgtgcgcgtcacgcctctcggcggccattcaagtgatcgcggagatcgccggtgccgcgaggtgaaggggtggctcgatgaggcgattcccgctgttcagggttttcgccattagcaccgccagttggtggctgttccgggtgcgctacagcagcggcctctttgaacgcgttgctgaggttggtcactgattcccgtagccgttctgtccaccgtgcgagatcgtcgttcagaacgggatcgtagggggtttccctcagtattgcgttgacggccctgatgtgctgggccggtgtagtcacttgattttccgcttccgcattaacgcgcactgacgtgctggtcccgtcaatagccaatacctcgcgtggcgt

SEQ ID NO: 46213 - DNA, 1812 bp, Oryza sativa
attcctgcagcccgccaatacctcgcgtggcgtactcgttgacgatgagccatagtcttcgagcaggtgcaggactgacggttcgtggggatcgatgtcgattacctcaacgaatcgatctgagatcagcgttgctccttgttccttgtcctcatccctgagggggatacgtgactgttggaccttaggaggtgacgtcttcatggcactgagaaataccttgcagcttgagaggtcgtgattctttgtcttgtgaataggacaatagacatcacgagttggagaagtacgctgaattccacgctctttgcaggcacgaatttcagcgtggacgttgagaaaaacctagcaggcttgcaaggtgtgttttctggttttttggataggacaccaggaccttgtcacctcggaagtcatcctcgtcggctcgtgattcttgtcggaaagacaagatttggccgcactaggatccttctcgggctcggatgtcgtcgacgttccgttctccgcttcggcgggaggatccttcgacatggagtcgtcctgggttgtagccactgcgttctcgcttccgatcattgatggaccagtcgagatcagcaccatggtgtaaaccggtaagacgatttcgccgacttgagtcaataccagcattgttgaagcaggaactccttggttgaggttggtgttgacgctgttgtcgacgaagctggatgacatagtagtagaaccttgagcaccaagttcccctacctggcacgccactgtcgacgggcgatacccgtagaccggatatagagggtactagggtatgctggtacgaggatctacgtaatacaacatcaagcagacagaaaacaaagattatactggttcaggccccttgatgggtaatagccctaatacagttgatatgggattatatgatggaaaccacagattacaaagggaatagcggaactcgatgataccgacgagatcctaatcgaacaggttcgcttagatctcccggcgacttggctcttgtagacttcaactccgtaggctgtgattgatgtgttggctatgagattcgatgccttaggtcctcctgggtgggtcccttttatatcgcaggtcaactggtctccaaataggactcggagacatcggacccggcacgatacaaggacaacccagttctgtccgagtaggactccttccatctgtaaactccgcaatgaatttccttaacgtatgccgaaaacgtccgtatacgcgcaagtataccatatcgatatgtgacgtatattgaagggtagaggatataccttacccataaccctgacaagtttgagtttgaatttgaaaatatgacaacttcaaacaattttttaaatactaaatgatttcaaatgaaaaaactatcaacaacaaagttgtataacataccaatatttacaacttttatttttattttggtatttttctatataacattgttttgaatagtttgaatttgaatttgaaaatatgacaacttcaaaacaatattttcaaatacgaaatgatttgaactaaaaaagtcatcaacaacaaagttgtataactcatgaagatctgtaacttttattttggtcatttttctatataacgtttttttgaacagttcgaatttgaatttgaaaatatgacaacttcaaataacattttcatatactaaatgatttcaactaaaaaagtcatcaacaacaaagttgtataactcatcaaggtctataagttttattttttgtcatttttctatataatgttttcttgaacagtttgaat

SEQ ID NO: 46214 - DNA, 1393 bp, Oryza sativa
attcctgcagccctaattattattaatatgttggtctgctgcttgaatatatatatatactccaggtggcaaggacagaggatttctcgagtattgggaaacatggccgctacttcgatctcgtcgacttcagcgtcatcgaggggttcaaagtcccggcggacatgaccatctgcagtttcaaggtagtaaaataataataattatattccattatcctaagaaaaaaaatccttcttaaatcacgggaagatattttctttctttgtattaattggtcagcattacttggacacttgactctagtttattttgatggttcagggaaaaagaaacgctaatgatcgagcatggggtaaatgaatgaattgcatgacctgacatctgatattttgaactagccattgtcactgttgtagcgagtattgtcctggaaaccaaccaaccattgcattaggcagtggcggagttagaaattactgaagaatatagttaaaataggactcaaattaatagagtgttgattttgtaaaaaaattatatgatgatttaacaaaatttaaacatgattttagagggctcaatttttagctgccctatgtctgcatccgcttatgtcgttaggcatcctagcttgtgaaatttatactaatttatactagctgaatgataatgctttgctaagaataaaaataaatatattgtaatattaactaaataaataaataaataaatattctatgaaatatgttacctatcattttattgtaggaatattcatcttattttattttttatgttgttacccatttagattcaattattttcaatattaaaaagtagggtacctttgacagaggtgactgatttactaccactgtcaccacttttcttaaaggatcgagtacagaaatatgctagtttaggatacttctgccctaatataatgagagtatttgccaaatgtatatgctttacacatgtagactaacaaccctgcctgactgtttatcagcctgtcattgtaatgtttcctactccagtactgatagattcaacttgtcacaggagaggctcacagaggaatttggaacccctgtgcaatgtcaacgcctgtggtggtggactagacggcagaacaacacataccgtgttgacaggccattgacaaccgaagaggagaaaatacctgtaagtaaacattgtgatcacctgactggctcttcatactgttttgttctatgcagtaaaaatgaggcattatatactaagaatatagtatataatgactcattttctagtggttgaaaacttcacatgaattttgccctccatcattttccatgtcatttccctaaaagttgtgctgaagagagcagataaagttctcaca

SEQ ID NO: 46215 - DNA, 1099 bp, Oryza sativa
attcctgcagccctttctctcatgatcaactctacgttgcactctctaggggtgtctcgagggggacaaccagaattttggccaagccaaggatagacattgaccccactggaaaaagcacaaagaacattgtatatcgagatgttttattctgaacaggtatgagattctttatattcatgtcaacatgactttctactttcctgaaattgaaggttcactcatctaatgatttaattgtgcacctgtcacttgctattaatgttttaaaacttgctcctgtcacttaatggtatttcaattaattttgccaaatattacattttgattgagtaattaatattatatctgcagattgtctaaggttgattagagaataccatgttcagattcttctgaaggcccagttctttatattattcattggactattgagcttggttgtttctggaggaccaggttgcatggatggtgagtatcatattgtttacaccaagtgttcattgatatggaggaaaacctgatgtactgatgcacaagagtatttcaaataatcttgccaaatattattttctgattgagtacttaatattatttgtacaggtagaatgtggttgcattgagagtaccatgttcagattcttctgctggccctgttctttatttttttttttcactggactattgaacctggttgtttctggaggactacggagcatggctggagtatcatattgtttacaccaagtgttcgatgatatctggaggatcatattgtttacaccaaatgttcgatgatatctggaggataacctgatgtggattatgagcttggctttgtcttgacaaataatagatgagttgctgcttgtaagagaggtctcgatgatctgctaattgccactgtttagttacatggggtgaaataattttgtgcaaacatgactgatgtatatgaaaatacgtctctgattgggatcttgtaaacttatttgatttgggaaggactgcaacacttgaaatttttattggaaggacaattcagaaacataattgggaacatttgctatattattttatgatcttatcgggctgcagg

SEQ ID NO: 46216 - DNA, 1432 bp, Oryza sativa
attcctgcagcccaatgcatgttctatcggaacacaataaatgcatacaaggcacaattaaagatactactactatatcgatcatatttagagcaagtttaatagtatagccactattggctctaaattatttatagtcaatttaatagctagtttatacaatattacctataaacatacactacacaattaatatctggctccacctgtcatacacacatacatcttggaggctgttttgcagctgactataaaaccgtagtccgttgctcttatatatatctcttattttatcttctcgaaatgtgtttgtagagtatgctattgtacctgctcctcttattgatcatatctcacgacctgtttagctatcaacggtttgacggttaatttaggtgtacgtccaaccatcattaatatattcgggtagtaactataaaaaatgagccatgcacggatggcagccagatacacataacatggggcggatagtagacggatggttaatttgccccaaaagtacgtaagagtagttatattgctggtcgatattctctagcttgtcacatggatgctactgcaatagtacagccaagctactagatttcagtatttgtacatacaccctattagaatcaatatctttgctagctgggccagttatgagtgggcaggaaaccgaatcgaaccgtacttttcttgttcttgcttcttggtgttcggtttctgtttcattttgttgtcggtctattttacgatttttaattgcccgaaatagatgggcccactccaattctattgttacatgaaagactaagtcccgctactgtctctactactttatcccccctccttcccttcgggagaatttactatttgtcactctaccaaaataccagtgttcagatgccactctcctaaattttattcccaaataccactcgggcccacatgtcaatctcatctaacaccgggtcctgcaccacttttgtttgaatgccacttttgttttctagctagctatcaattatatatcctataacatgataaagaactgatgtttcatcattttgtacccgtgggcacggttttaagccacaatccatgtccgatgaaaaataaatacatgtgtgaaatcaaaagagaggccaatgtaatgcaggccggtgcccgagtgatgaaatgtgaagatagaaggtgactatataatgcaatggttgcactgtcaatactgttgggccgacggcgaggctctagtatagggtggtgctgggggcaacaaagccaccgaggccgagtttagttccaaattatttattcaaacttctaacttgtctattacatcaaaactttcctacacacataaactttcaacttttccgtcgtatcatttcaatttcaatcaaacttctaattttagggctgcaggaat

SEQ ID NO: 46217 - DNA, 910 bp, Oryza sativa
attcctgcagccccattccgtattccttgtcgagatccaccaaccgttctcgagtgatcgagaaggcgcagaatctgcgacggagctttgtcgacatttgtcgtactcgccttagtcgatcttggtatagaaccatagagacatggagccttcgtcaatgtcgaatagaatccatgtgtcccagcaaatcttttggaaatgaaagaatgcgaggcacctgaatcaaagagaactgttgctggatatgagttcactggaaacgtgcccaacacaacctttggtgctacctgtgcttcctctgcagacacatgattggcgcgggcctggatgaacctgggtccagtgcgattcagcttcggacacttgctagcaaagtggtcgtgcttgccacagttgaagcagggtcctggctttcctacagcccccttcttgggctgttctgactgagctgacacagctggcgaatctgactgagctggtgccattagtgggggtggagtcgagttgtggttgtgctgcttactgttgttgtgactgccaccgttgtaatcgttgttgaagttactcgggtgatagggacggtgctgacagacgatcagggtggaaggcccacctagctgtcccgtcatgaagcgaggcttctgtttgttcccctgaggaaagctgatctgagctgcctttctttttcggtccattttgttgcgttgctcttcctggcggatagccttgtccacaagcttctcaaagtcctcatagactctggagattagctggttggtcaattcatcatcgagcccaaacaaaaacttctcctgcttctcagcatcggtgcgcacgtccttaggagcgtagcgcgcgaggcggttgaactcgtgcaggtactctgtaaccgttctggggctgcaggaat

SEQ ID NO: 46218 - DNA, 2145 bp, Oryza sativa
accaccaaggctccatcgcgctaatcccgcggtggctcccctaatcacgataacgccgccgccgcgcctttgaacgttgttgcgccatccgtcatcatccgcacttccgccgccgtcgtcaccgcaatcagtatcctggtggtccagggtttccaccagtgccgctgccccgtctcgccctggttgtgcatcctcccaccagcgtcgcagctccgccatcgccctgcaatcggtgcctcagtggtccagggctccgctggcgacgccaccccgtcgagccacggtggtcaagccttccgccgacactgagcctccatctttgtcgctgctctgtgagtcctccagtgttgccaccgttggaagaggatagactcagcagctaggcctcccagccgtgcgcctccctctcttatgttggtgatacctgattcaactcaaatcgactcttttcaatccccttttttcctctttgtgaattttccccattagttctctagctgaattttcttattcaagcttaatggtatgcatctccttttagttatgttattcggttcttctttacctttgtggataattgcaggctatatattacgtgattggtgctgcagtttcatacatactaacattatagttgtcatgttgaatatcttgcagattatcttacatagagcaaattcaaccatgcctggtctcttatcttttttattcaggcgaaaaataacagttcctttcttactgaaatggaaaatacatgaaaccctacactgcaattttctgcaatgacagggtaaatagccatatcaagcccgtttgttgctgttgggctgcctgcctcttatttttcttctttatttctgtgatcatcaacaattactagattgtcgtcccttatggtctttcatttgattcactgcacggttgatgagttcactcatttgctgccaattgttgttgactaatttctttttcacattttcttttatctaaatatatttattctgtacttctattgggccatatatagtctgatttagtgtttgtcatttcaggtgaccttgcttcttagccaattggagcacaaaagaaaaatccaataaacaggaaaacatgatttagtcttggacatcatttctgaaggcttttgcacttaagaaacgcgaatagacaagaataaggtatgcagtaaacatgatacttctgtgtggctcactacttcactggtcctactactttagagctatatatttttgtgtgactgtagatgggttccattaatggatggctgtgagaactaacatttcaattttgtatatatggtagagcttcctcaggtggttggtagcagaacaagatagtataagttttcaggtggataaagctaaagcaaggctaagaattaaacatgtgtaatggaagtatcagggatggctgtgagaactaacatttcaattttgtatatatggtagtataagttttcaggtggataaagctaaagcaaggctaagaattaaacatgtgtaatggaagtatcaggaattcagaatggtagttggcgcatatggagcagatttgataaccgaaaattgtgtaccctgtgaagaatccattgctggttttaagttttaacttcataccgttatcatttcaaggaaagaaggtcttgcaatcgatcttcagaagagctgagaaaggtacagcttaaaaccattatttgttctatagtgaagttgatgtgtgtatactaaataacatcgtcagaatgagcaaacgctataaacaaaaatcaaccttcaaatataatatgtataagctttaaatgttaatggtcacttatgcaaaatgcactaggtaatgttgttcttcattttcaggagcgatttgtaaattaggttaatggaacaaaatattccacgttttgcccaatttctataaatttgagtacctgaattcactcacaccaaatggattgccacatcttttaaaggacaaagttattgtcttgtcatattgctgcgcaatctcgacctgcacaacgggttgtgcaatggaactaggcttatgattagagcatttcagaattattccattagtgctgagattgtcggtggtgcacatgctgggaagagggtcttcataccacgg

SEQ ID NO: 46219 - DNA, 1197 bp, Oryza sativa
ttgtcaccacaccaagttgctacactagcgctgttctcttcttttgtgtacaagtgggatttctactttcttcgcacgtgcggtgcgaaaccccattactccgtttcttcgtaccacatgaattcgtagtctttaaaactccaatgtccaagtgtagaggtaaagcggttggactaatcgatcgtcgcttgctagcaacagagcatatccaaccagaatcgaccagtcgtcgacacgtgtgaatgcacgaggttgctatggctttacgtatatcactttattttacattagttctgatattaagtttgcactataaacaatatatactagcaagttttaacttagctcagtttggattacgattggatgagaagtgaatgtactttgggaaattgaaaggcgaagggttgtgattgtttagagagagaatttcagtggagaagttattatatttcgcgataaattcctaagtctaaaaattgttatattttggaacaaaagaaataagttatattacccaatctacttgcactcattgatatcacacgactaatactacaggcttataacatatcatggcattctctggcgctcagctcctttcatatggattaaagcaaataccaaacacttgtaaaatttttctttggcttgcctttcgaggaagactgaacacaaatgatagtagggtaaagaaatgctgggcatctgatccacattgtgctatctgccctaccattgaaacaacatatcatatcatattgcgctgccggctagcttctgaggtttggaagaaactcaacatctctgaacaggcaactcaaagcacagacgttcttcacttcgttgagcaagtcctgacaattacgcccccgcatctcaaacctggatggccaatatgctttggcgcctgcgcacacaacttatgaaaagcatgcaaccatagaacattccagcagcaagatcttaccacggcaaatgtgacacatcaaatcagagaatatctatacttatggggaaatcgcatcaagccacaatgtcggcctccaatatgcagatggatagacttactagcgtagctagcttttctacttcttccatgcttcttcctattcttctgtatttcttcttcttcttccttcttattttctcttcttcttctcttcctccctctccgtctggagtatacatgtacga

SEQ ID NO: 46220 - DNA, 1970 bp, Oryza sativa
tgccagcaaacgttcccagcacatctggacacttctggccatgtaatacttatacaatattaagtcatgaattcaaatttaaaaggtttaagaaccaagtgttatgatcaaagttgtggagaatcccggatcctaaggtttttatgttctaaggtttcacacaacagagcatatcttaaagacttgaacactaatattgtttataaataatgaagagttaaattagtaatctccatataaaaataaataattcaaaaactttataggcactatgcacgaaaaagtatgtatgcgcagacatgtaatcagtatatacttatattctctggaatttaaacaggagtgtactttatcaaaccttaggaccataatggttatgtgcgctacaagttataataccaaaggatttctgcactttggctattaaatatggggttaactaaaatctactctaaattttaaagttgaaactataatgcctggttaccagtcaaaaattctattttttttgtttgaacatttgtctaacaaattttcccctgatttgctcaacattccatttgttcttcacagtttcctacctaactgagaatctgagatcacaacagccctcatgttgttactttcaaaaggaaaattctcatttaagaaattaggtaccaaacagctgttgttggtaagcagggtcaggaatccggctgctgctgctgctgaagatactcatggatggaagaaaagaggacaagattagggatgagagtgagattgggaaggaccaagtttgtcatcggagacctaatatattccctctatcaaaccagcttcttatggcttctgcttcataggtgaatccatcagatgccatttgaggatctttcatgatctcctgaaatatcaacaagagagtaacatatcacacatgcaccattaaaattttgatcactgaacatttcaaggaaaacagaaaaggatattcacaagttgtaggcactacatggaaaagaccttgggagcatatatccagaattgaagctacaaaaatgatgattacagatttatttaccaggctgattggacaaatgaaagcagaagggacacaactatctcctgttgctgattgcaagtatggccaggtggctgcaagaggcttcctcgtcaggggctcaacaactttccacactttggttaagagatcaggccgtttcttcctcgtcatttcagtgcagctaaggccaatgagtgctaactgtttggcttgaatgtacggccagtcccctgcagatttatctatcagcaagtgcaagctatcactctccaatgcctctgcaactttctctgatagagttaaggggggcatttcggtcaagagccgtaggatgataacacccagtgagtagacatcagagagtgttgtgagctctccggtggtgttgaactcagggtccatgtacggcagccttgccgtcaggtttggtgggaaggtcccaagctgcagaaacaggttggacataccaaagttgcagatcttgcttctgtagttggcatcaatgaggatgttgcaaggcctgagatcaccatggaccaaagcagtagacttgttcgaatgaaggaaaagcagagcacaacaaatctccccaatgatctgtgtgcggttgtaccaagagagaggtgcagaattatttgtgcaaataatgcggtcttcaagatttccattaggtagccattcatatactagagcggagacctccgagcatactcctatgaatgtgataatatttggatgtctccattggcgaagaatagagacctgcaataatctcatattactaatggaatcaaccaacacagagtatcacaagtggaccaggttacctcttgttgaaataacttttgggaactggacagcttgattaacaccttcatattgtgtatcatgcctttatatgtgtgcccatattcagtatcaccaa

SEQ ID NO: 46221 - DNA, 1427 bp, Oryza sativa
atgggtgcttagctgtggtggcgggtgtgggggcaggttatgttatgtgttttgtgcctaattaattcagagtacagtgaactctgcaacattaaaagtgttaaaattttcacttagcatcaaactggagcaaaataaagttgcatctacgcaagccagacacacacccctggtccgcgttcttaaacctaacataaacagtggaaagggattccgactgagctgaaatggttagaatgcccattggtgcaagttctaatattttcatccatcctcataagcaaatcccctaaacaagagcgcaagtcctggttggatgcactgtaccgtgtgaccatgggtcaatgcagttattatttttaaggccacaatgacacaacatatcatagtccattgcaccaatggagattcactgcaataatgcccgtgcagcctgctgcacacaccccatacccccaccaaaaaaagaaaagagaactaaatgagagtaaaaaatggcagaaatatgacttagatcttatgtataaatcgccaaaatatttttcattggacaatttgtgaaactatctcagtatcagacctttaacatgaaagtcaaaaacctttacacttggaactcgtagcctaaccataaagatactgttagggatgatcaaaagtcaaagaaagcatataaggaagaacaatatgtaaaaagtttactgaaaaatgtcacctacagcagggaagatagcaaagcagaacagctaccttatgatcacaaacatgctggagaaaagatgcaacagaagaatatattcgccagttttgtggcaggcttttctggtagcaaataatgtccccagttgtaatctgtagaaagaaaataatacatggatggggagtgcaaaagagactaagagaggataggttaaaagaaacaaaccccactatctgaaaaggttaaatgaatgtcaatagcttcacacatcactgatggatcaaattttatctcctgcttatcaaagtgagaaaccagtacaaatgagataaatctgtttatttcagagtcagggaacctatttgcatcggtacaaaacctgacctcatacaattctattggttcgcttgcacaaaaaccagctagacttcttagttttggaagaatatctgaaggcctcgatgaaactttcacatacagcgagccaacatacttaattcctcgttcagaagaggagcaaaatttagtatcatcaactgataaataagacaaaataagttgtaacaaaaaagtgctgactgtagctgtgctttttctgggtcaaaaagctttagaaacaccagcgcatcatcttcgttgatctctgagtggttgggaatgagggtggagcacctacaacatgccaatattttgagacttcaacagaatgataaatcgatggatgaaa

SEQ ID NO: 46222 - DNA, 1055 bp, Oryza sativa
attcctgcagccctgcaacttcaagatggggaggaagatgagacaatctggaagtgggcaccaaatggaaaatacactccctgctcggcctacagcatgttcttcatggcaaacacggtggcgcgatgtggtactctgatttggcaaacaagagcgctgtcaaaggtgaaattctttatgtggttggccgaaaaagggcgatgcctcacggcggataatctaagtaagcgtggctggccgcaccagcaggtttgccaactttgcttggtgggtgatgaagattgtgaacacctatttgtgtcttgcacctacacgaccagggtgtggagaatgatcaagggctggattggggttggcttcctgctgccatctgagtcaggcttggacttgggcgaatggtggttagcgatgcggcaaaattttcggaacaactacagggacgccattgacagccttgtgctgcttgtttgttggatggtttggaaggaaagaaatgcgcgtgtgtttcagaaccagcggcgctcagccggtttcctgtttggttcaatcaaagaggaagtggcgatttggaaggaagctggggttttcagaaatataggagagtagtctcttagtgtaatctttggcttttgggaagttgctccggtgacaatttccattacttcgacagcttcttgttgaagtaataactttgtatatttgtatatattcttcaatcttaagtaaatttggttggcctttcttggctggcccggcaaaaaaaaaaaaagaaagtctgacctcgtacaattctatcatttcgcttaaacagaaaccagctagacttcttagttttggaagaatttctgaaggcctcgatgcaactttcacggacagcaatccaacatacctaatttctcattcaaagaaacaaattttagtcagccttatcaactgataaataagacaaaaaaatgcagcaaagaagttgaccttagctgtgctttccctgggtcataatgctttagaaacaccagtgcatcatccatgttgctccatgttggtagggaattagt

SEQ ID NO: 46223 - DNA, 1433 bp, Oryza sativa
cagcactaaacaaaatgcatctgcaatctaagtaagcaggattcataattcaaaattatggtgcagaatgaagccaataatggaagggaaaaaatcatgtgaaacctctagaaaaatgaggtaatggatctatttgtagtttataatacttcagtctgaccgatcagacatgcacaggcttgaagggaacccttcattctctaatttcttactcagcacataactgtttaggttcaaatgaaagagcattttttactgcatgggacaaaacagtattaagaaccaacagaaaataaggtgatcacaatgttttactgacaggtagattctcctcttcggttgtcaacggcctgtcaacacggtatgtgttgttctgacgtctagcccaccaccacaggcgttgacattgcagaggggttccaaatttctccgtgagcttctcctgtaaaaagttgaacctatcagaactctatatgaaatatgaaacataagaacgacaagctgcacaataaacaatcatacagggttgtcagcttacatgtgtaaagttatacatctcgcaaataaccacgctgtccttattagagcaaacctaaaatagcatatttaaaagagacaatagttgggagctggctgtattgtaccaattgtcttttttggagtgtatagattttttttagataatggaataaagaaccccgcgtctacagcttgcaatgcacacagccatgagtggcgtatataggataagttcacaaggaaaccaaatgcaatggttggttacatggtttccaggataaatactcgtcatgacaatgactacgaactttctaagttgtgcattggttcccataagatataaaatgtcaagtcaagcgatccatttccttaatgctcattatcatttttttttcttctgaatctgttcaaaaaacatttttttccctgactctgttccaaaaaaaaaactgaacaatcaaaacaaattagtccttattttcctatataggatataggatgccaggatggtgccaaatccatcccagaccatttattcttgacataattttccgaatagtcatcttctaatgtttgtcagattcctctatacattccacaacaatatgtgaaaggactaagagtacaactactacagtagtaagcaactcattagaagaagcagcacacccatcttatgggattcactaccttgaatcggaggatggtcatggtaggcgggacgttgaatccctcgattgcgctgaagtcgatgagatcgaagtagtggccatcttccccaatacgcgagcggaaatcctcttcccttaccacctaatcagaccaacaaacccaacaagtggtcaagaatccgaatccccaatggattttgcgctggtgcggagaatccaatctgcgcgagaagaaggggtcgc

SEQ ID NO: 46224 - DNA, 875 bp, Oryza sativa
ttcctgcagcccgtggcaaatagttaaataactccatattggaaggacaatgggcggcggacaggaacgatggaggattcgtcagagatgtggtgggctggtggttacggagcaaggagtagagatgtgatgaggcagagggagtagagaaggtttctgcttttatatttttcatgagatagacatgtagggtccacgtaggtcccacactaacttgccgagttgactgcagtcaactcatcatatcaaccaaaattagacacaatgctactctgggatctcgggtactccgatattacaaattgagaaacatgttatatctagtattgcagttgaaggatacaatttgaagtcttgaagtcaagataagggaccttatgtgaacttattgcagacatgttatatctgtcactatgtcgtcaagtctgaaattcatccctgaaccgcaataccagatatgacgtgtcccctcaactcccaatcagtgcaaataagatcccaaggctgtttggatgacgtttttttgctgacgtggcacttaaagttggatgggaccaacatgtcagtgagttcggtgggacccacatcatcaccacctctttcccctcttcactccctttttctctccctttcatcatcgtcatggagcccaaagaaggacgaggcgttgcagcggcaagtggcgaagcacgggggcatgtgactggtcgctcatcagcaagtccatcccggggaggtccggcaagtcgtggcacatccggtggtgcaaccagctgtcaccatgggtagagcaccaccccttcacgcccgaggaggatgacaccatcctccacacccacgcctgcttcaacaaacaagtgggccaccatcgtcaa

SEQ ID NO: 46225 - DNA, 1288 bp, Oryza sativa
  unsure (1)..(1288): unsure at all n locations
ttcctgcagcccaattgagttgctgtctgattgccacaccacagtgccatcgtagtccttgagaaccatggcaccgtccttctgcagggtaacaacagagcgcctacatgcacagggcgtccgcggttcgcggtccagacaacagtcttgttttttgagttggtataccatattgagaaggcaaaagcattgctgtagatggtgaggaagccgcaggagaaagtgccatcagctgactgtaggacatcattctggtaatcatcaacagatagagaggattttagtggtatcttgtcacgagacatgacaattgggagcagagcaaggaatgatagagcagggaggatggagaagaagggtgccatgggtggattgaaaggatgaccaaaggagcagtatgtccaatttcttctcatacctccttgcttcattcttatattcaatagaaggttggtgtcctatgcctcgtgatgtccacaggcagtgactgtttgcatgtgttcaggacatctgatatattatatatatatatggtcattttgcttgcttgtaatgatctgatttgagcctaccaataatcatattaatagcatgtgataatggtgacagcactaatgaaaatgctactgccagctggctaggaacttgcttcgaaaagcacaggaaaaaaatacaaaaatattaattgatgcacctagttgaagtcagaaaagtacgctttaatgttcaactatgtgtatattatcttttagcttctaggcgtattgttgtgatcaatgcaaattttagaccatggaaggcaacatctagctggattgatgtgaacagtgggcagaagaccaagggaagtgtcacttattggaagaaacagtcaaatctgcaaacagtgagccaaaaaccaagggaagtgtcaattcttggaagaaacggttaaatcaatttgatgggcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaat

SEQ ID NO: 46226 - DNA, 844 bp, Oryza sativa
attcctgcagcccacaggcccattcctgcaggtagtaggtattttagttcaaataaatatataccagtacaactacctgcaaaactatcatatcaaacaaaatattctccataagcaacagcaacatcatcctgaaatgttaacatacagggtgtgtttagttcacgctaaaattggaagtttgattgaaattggaacgatgtgacggaaaagttagaagtttgtgtgtgtaggaaagttttgatgtgatggaaaagttggaagattgaagaaaaagttgggaactaaaccaggccacagtatggttttcaatagcacaatacgagcaattaaatctataagcatacatgtagaatttccatgaaaatcataaggtttgcactgataaaaaaaagaaatgtgatactgtgataaaagatcggacatgagtagatcatttgatcacgatgcaggcatagtgaccagtgccatgaattcacccagctatatgacatctggaacgaatagtagcatacatgcaagggattagctatggtccctacctgctcaaccaaacagatcaagtcatacacccacccagcgctctcagacacaccagaagaaaccacactaaaagtgggatctggatcaatttgcgcaaggaaagccttctacaggacaggcatgtacctagcaggtaggggaggagaactgataagtagtacctcgtggcagggatgaccgctggatctagccagccaggtgagagcaggctgggaaactcccaggccgctgcacagggacgtctaagcagggagaggctctcagcttcttctccttcctcaccttggctgcctgcctggtt

SEQ ID NO: 46227 - DNA, 5135 bp, Oryza sativa
attcctgcagccctgacttaaattggtggacccactattctagaccattagattagatctatttagaaaagtcccagcttcatcgaaattatttaccagaaaaattcaaaaattaatgtacacaccggatataaaccttccgtattgttctcttaaaaaaaccaaacacacgtgcgtacgtacaaagattaaaaaaaaatcaaaaaaccatatgtatgccgtaagaacaatacagtctttcgaatatagtgtagtacgtattgtgtatgcctttctctgtcttttatttatcaacgaacagcaagtacatacttaagacttatctatctatccacggtctttaaaataggatttcctatattataaaataaaatttattactctacaaatatgcacggttaaactagattaatataaagtaccaaatcaactgtatttaaatgtttatcttttaaattatttctcaaatatatatctaacttataatcctttgtctttctttaattaaataaaatactaatcacttataatagttatatggaactgctaaattcattacgacacatggtgccgacatataatacgtaatgtgataattatttttcaaataatttagctaacatataataactaatgtcatgatcatttttaaattaatttcacatgacaaaaatgatcaacttggtgtcaaattcgcttgacaaatatataacactaattcaaatctacatgtagaaaaagtgaaacaacattgtggtttacaatcagatttgattttattttaatttatgtgatattaagattctattttttttaaaaaaaatagaactatttgatgggaatttccaggcaatgaccttgctatattacgaccccttaatccatcaggagaattacggtcatatatggtttttctttgcgaaattggtttggtaacaaatgaaaaatcatttgcatcaaactattcatcatatattttttatagtttagaaattctaatatatcaaacataattgataatgtatgtcatacaccccactgaagtaactataaatgcactccaacaaattagttactttaaataattttggaaaatatattcttagaataagtaaagatgtcgcatgtaattatgaacaatacatgaatgaaaacaaaccgaagctaaactatatatcttattcaaaatataaagaacaatatggtactcctagatgtcacggttgtatgtctgtttagtttttttttatcaacattgctcatctgaaaagagaatattgtatctacacaataaaaaaaataagcattactgattaataccatgcataattttgtctacacaaaactttgaaaaaattcactagggaaatattttcatcacctacattccctctttttctcccataaagggcaccaagcatgctgtgctaccacaagtgtagcaagggtcatacatatggttgagttgaagccaccccagcaaaggccgctattgacaatactgcataactttgtacttactgatgcaataatatatgagggtgctaatagtgaactagacattaaaattacgcttcatgctggcattgcggggcacgactatgtcgactcaggacctatgtttaaaggcagtggagaaataaagcctcgacggatacggtcagcttcaaccattaaaggggacattcatatctgattttaacggtcatcaaaattaaaaaaaatcttataagttataagaaaaaaaatatgatcatcggtttacttaaattatttagaaaaaaaatagaaaaataaagtccccaaaacctcgtcctccccggcacatgcacaaaacattgctggtccccttcaaccttggctcatgctctccgctctccattcctcccccttcctatgaataatactgaaaagaccttatttttcatatatacataacatttctaatctaattgttgatctgttaaataattaaaccaacaattctttatccataatgcctataattttaatctaaaataagacttgtataaaataaaatagaaaagtagaaaaaaaaagtcaatagggattgaatcaaatcaattaaagagaatatagtaataaatttctaaaaaatagaaatgccataaccatccatctaacgtggtattatgagtttctcatatattattgcatatataagacatactaaggtagtcggacatagtagtacttagttggttaaaaagttatatatgtgctactatcaactttaaatttaggactcatggtgcctaggtattttttttaaaagaacaccataaatcacatatataaaagggaaaggacgcgtacaatatatatatctcctatgtatttattgtctcattctttcaagaaaataaagaagatcattgataattgcttatagtaatgaattaaatattatatagttcaaaccttacaaatatcttgtaaaaaaatatctaagcaatagcgatgaagaaaatttataaagaaatactccctccatcccaaattatatcaactataatcaaactcggtagcttttaactaataatcatactaactatatctaagtattatgcatgttacatcactagatttatattttgaagtacttttatgtaatgctaattttatatttgttgggatagaatggaataaagtactggtcaaaatatattattaaaacctatgtaaaaaaaatataggtcttgtaatttgagacagaaggagtcttttttttcaagcatatcaggtatcgtccgtttgatactccatcatccgattgatattcccagtgtaacctactttacatgcccgcgcgaatgcgcgggctacctttctagttattataaaagaatccacagagttttgattggcagttccgatgtaatccaaaagtcacctgcggactcacacgatactcgacatccccatcactcaatgaccgagacgaacatatacccgtcgacaaaattccaccgaaatttcacggaaccatctaaaaatcctgcgaatccaccacccaccgtctccgctccacgcgtggcacccggcgaaacaagagcaccagaacccacgattctgtcccatcttttcccctattttctccccccctccggcacctctacacctgtccaccccaccgcgaccccatcaaactccgcgatttcccacgcaacaccagcacacacaatgacacacacaactatacgtgtcaccacggccccgtttgccgccatcgtccgccgaggtcgcccgccgcgccgcttgaccgcgagaaaccccaacccccacggcgccctcgcacatcccgcgaatcccacgggaaaaaacccgcggttttcccccaccaccaccacgtcgatgcgtacgcatcgcgtacgtgccgtcccggcatgaaagctcgtcttttgctgggtcccttcccgcgctgtgtgtgtggaggacgcgcgcgtgtaatctgaggggagccacacgcgttaggtgggccgcttttgccggggcagagggcagcccaagagccaaccctccacggacccggagccccaacgtgtcaacgtgtcacgcgacgcgcgggaggtcaaacgaaagagacacgagtcgtcgtctcgacgtccacgccaatttccggcgctggccaatcgcggcgcggcacgcacccacccacgtcttccccaccatgcttttctaatccccaccaaaaatattaaacaaaaccgcagcaactttagattgaaaaaaacgttgattattcagacatcgaagactagttgttgttgtggagtagtagtaatactagtaaaagattattactaattgctcattcagagtacccgcaatggtaaaataatatgctatctatagaactacatctcagcaatagactagattaatagtaaaccacttcaatgatatgtctacatgggtatctatagctctctaatccattgtctctttttctctatagactatttccaggttaatagatagttttgctctctctcttcatttaatctcttctaagtaggaaaatatgctgacatggatctcttgtatagagcctataaataaccattgtgagtgcccttaacacaacttcgcttcgtcgaaccgaagtccaaccaaacaatttcaacttcatctaaaaaattaaagctagctaaaatactctcacaaaattaactagagagatgtacttaggtttaaacctacaatagaaagttataaatccacttaatacatagagaatatacaaaaaatataaagaatgatggttctcgtacaaaagctaacttaatacgtgctctaaaaccaatatattaatatataagtgagagagaaggatatgagatgataaattgaagctaaccttattgtaaatatattatatatacgttaactttaaaatatgctaatagctaacagtgagctgtactattaaactcgcttcttaaacagattcacaactttatttgaaacccaaatattagtaaaattaaatttagatgtctgagtctctaccgaacgagctccaagtccaacggagacacacacgttgcagtaagggtgggccccacgggcgtccggaccgtgcgtcgcgtgcgtcgccgtcgaacacggcacagcgacgcgcgtgtccaatggacggtcgccactgcattattccgggtgcgaatgcgattagattaggatttgatctcgcgattagattgggcgtgtactcgtggtagtagcattactactagtacgtggcgacgacgaatgacagcgatatatttttctttttctcttttgcgttggtggtagcttcgtcacgtgtccgggcctgggtgggtggtcgccgtttggtgtggacgcgaaggacacgtgtcgcgtggcggtgcgcggcggggaggcgggactcgtggacggcccggatgcggccgaacccaccacctgtcgcggcatcgacgactgatcgcgacgcgaggcgtcctttatattgcggccccgctttcgtctccgcctctctcattctctctctcgttgctcctgagatcgtctcgtctcgtggtggtggtggtggccattgccggagcttccaaggtgtttgatgtcgatggcggaggtgtgctgtgattctg

SEQ ID NO: 46228 - DNA, 5372 bp, Oryza sativa
  unsure (1)..(5372): unsure at all n locations
cacgtggcgnacgcgtgcaggaagcggatgcacgagctcgtcgcggaggagatgggcgccgggtcaccggcggcggcggcgcgcgagccggcgtcttggacggagacgatggagcggagcttcgcgaggatggacgccgaggtgatcgccggctgccgagccgagagcggcagctgccggtgcgaggggcagaagtgcgaccacgtggggtccaccgcggtggtggccgtcgtggaggagagccgcgtcgtcgtcgccaactgcggcgactcccgcgccgtgctctgccgcggcggcgcgcccgtgcagctatcctccgaccacaagcccgaccgccccgacgagctggagcggatcgaggcggccggcggccgcgtcatcttctgggagggcgcccgtgtcctcggcgtcctcgccatgtcgcgctccatcggcgacgcctacctgaagccctacgtcaccgccgtgccggaggtgacggtgaccggcaggtcggacttcgacgagtgcctcatcctcgccagcgacggcctctgggacgtcgtcagcaacgaggccgcgtgcgaggtggcgcagtcgtgcctccgccgcggcaggcagcggtggtgcgccgaggcggcggcggtgctgaccaagctggccctcgctcgccgcagctccgacaacatctctgtcgtcgtcgtcgatctccggcgaggcaacgccttgtagagagagtgtcacccagctgatgctgtagcatcagtactagtattgcagatattagctaagctaatggttctactaatctttttttttcatttcccttgtgttaaaaatcattttttttctcttctaattttctccctgaattaaccaagttcagtggagcacatagatcaggtgatggggttgtgcaactgctagttggtgtaaccagaatttcatctggataccaactgaaatgaaatgaatattaagcaagattatttgagaaggaagtttaaaccatgggatttttgttaggcaaatcacctttttacttattgaattactgtttctgctgtggttcagactgtaccacttggggcctgttccctttggtgctattttcaaccttaccaaattttggtaaagttgccaaaaaaaatggctatatttagtttgctgtcaaattttggtaactatataagtaatcctgcgaaaacttgccatcctatagttgccaaaacttgccatcctaattaattactctgcatcttgcaatcatgcaatcttgatgatatgattgcacgatattttcctctgccgtcccggactcaaattcaattaaaataacatctctgaattgattggggatacaaaggacaaaataaaattccagggttcatcagagaagcaccaagggaacattatcctcaattttcaattatactactgtaatttctcatgtttatgtcagtgacaagattcagaacattccaaacgaaatttaacacatcagatatttttttctgtgcgcgattcgtctggaaggagaacatctactatagtatctaatacatcttcttcatcagtcagaaaatctcaaatcacacaccaacacttgcgcggtccagctaaccctgctctgtggctgcctgcctcctgtcccagcaagaagcaagattctctcatttttctctcacgagagatctgccaatgcacagctcaacgattctcagcaatctctcaactcccttttctaaagcgaaattagtactatcaagcatcaacataggctgatgtgattagaccagaaagggattacaaaattggccactccaaacatgctaacatgctgctaaccctgatttatggacgggtttgttgctccagcagacaaagaaaatcttttgcttagccactaataaagagagtttagagagtagggtagagattgcaagcaacattggtgaatgaagtgatttggtgaggctacgagggagatgtggtggcagacatgggggttagtcgccggaggtgtggcgtgtcgacacgtacgcagtatgtcgagaagatcgggcaggattgtgcaatctgcgggcagatcacagatccggttcaatcttcaccgtgtttattactctctctgtttctacatagttgataccgttgattttttacacatgtttaaccgttcgtcttattcaaattatttgtgaaatatgtaaaactatatgtatatatataagtatatttaacaatgaatcaaatgatagaaaaaaattaataattacttaaattttttgaataaggcgaatgttcaaacatatttaaaaaaattaacggcgtcaaatatttagaaacggatggagtaatttggtaaattttattatagcacatggtgagtggtgacttcgcacgaaaccatttttagggaacacactataaaaatatggttatttatcaggagacaattgattaaattaatggtaggggtaccacttttttacatgacttcactagattgctcattctttctctttatcttcctatcttcttcgttatctcttcccctctctccctcatttctctttctccagcgagtttgtctacatgtggctggctagcggcactgctttccctccaccttgcaacctcacgcactgatcctactcggatcctctcctcctcactgatgcctctcctgtcctcgagcggttggttgatcgatcgatcagcacggttcttcgccagccatgacggcggcggcgatggcgccctcacctccgaagccggtgtccccgaggcagatcagcctgggggacctcagggcggtgtccatgctcggccgaagcgtcaagggcgtcgtattccacgttgtgcccaccatggcgggggaggtggaaggggttgtttcctcatccatggcactcaaggcgatctcgcgggagacggagcaacacaagaagatggggagcggcggcgaggacaggcaccggcggatctggttcgagtgggatgtgctcatgtcgctgagccacccgctgctcccttcactccgcggtgtcctcgccaccgatgtcgttgtcgggttggtcatcgaccgctacggcggaagagacctcaactcgctctgacgccgccagaccaagaagatggcttcaggccaagctggtggcggctaagaaccgccacgccacaacggtggccgagataccgccgctcaagtctaccgtcgagctgacgaatgacgccatcgtcgcgaggatggaggcggggaagaagcgggcggtggtggaggtgctccaccggcgcattgaccgcgagcgtgacgacccgcggcggctgcggtcagaggtcgcactggagcagatggtgctcgtccggcaccaggtcgctcacgcgctgcagttggccgagcgcgccgtggcggcggagacccacgggttggctttggcgtgatcagcggtcgccactaccgagcaggccgcgcgtgctctagtcagcgacgtcgatgttgatgtcgacgcggcccaccacaatgtcgtggcggtcccaacgcggaggccggaggagttgcgcgggggcgtggagggcgaggagagaacggccgagtttcacgtcgaggagattgtggccgccataaggttggccgaggcgcacgccaggaagcaggaagctgctgagcaatggcacggccgtgaccttgaagtcgtgatgttctgcaacaaaatttgcatattaatttttgtggctaaatcctgctcaatttgaatatgcgagcaaataaaagaagatcagaattcctgctgaatctgcaaagagcaaatcacaaaaatgttctacataaaatatgtagagtgagagcaatttttcaaaaaaaaagaaatacaaatccagctcactatgcggtgagcaaatcaaaaaaatgctcaaaaaaaatgcaaacttagagcagataggggaaaataatcgcaaatccccctcaatctgcagcgtgcgaataacgaaatattctcaaatctgcggagcaaatcaaaaaattataacgtgtaaaatcacaaatcctcctcaatctgaatattttgtaaaatcacaaatcccactcaatccgcaaaataatattttgtaaaatcacaaatcctagtcaatctgcagccaaaaatgatcttcaaaaatcgaatgcagccaaaaatgatctgagtcttcagcaaaataatattttgtaaaatcacaaatcctagtcaatctgcagccaaaaatgatcttcaaaaatcgaatattaattgtgtctgagcccagttaattcaaaaatcgaaaaattatatgtcaatctgcagccaaaaatgatcttcaaaaatcgaataatattttgtaaaatcacaaatcctagtcaatctgcagccaaaaatgatcttcaaaaatctgcagccaaaaatgatcttcaaaaatcgaaaaattatgtgtctgagcccaggttcgaactggggacctttagtgtgtgagactaacgtgataaccaactacaccacccagaccatgtgactgaaagtaaaagattattgtaattttgtaagaaaagttttgttgttctgtaagtaacaaatctatacaaagtttggtttgcacaaaatctacaaagtttcatactttttactattagtggcacgtcccaatcccaacacgagaaaatcattttctatgaaaaaagaagtcaattttactccctccaactatttgtcatgcccttaaccacctaaacaattctctctcattttacaccatgagctagtaaaaataattcatctcattgtcctacaacaattctctttctttttttctatttctacgtagtgacttcatcaatgttaagatatgccagctcagtctttggagatgcttacaggggtagaatgtgcgtgtacgcgttcatagaggtgagtatgcgtgtggtgtatggacgtttgcgttgtactgtgtttcaaaaaacaagaatatatcatgtgcacataggtttacgtgcacatttcacgcagagtaagcagcatgtcaaaaagattgggcaggattgctatccgtgagcaaaccttaaatcatgctcaatatgaatatgaaagagaattagaaaaaaaaaaacgaaatcctgctcaatctgcggagagcaaatcacaaaaatgctcaacacaagaaaatgcaaatggagagcaaataaaaaaatcgcaaatccttctcaatctgcatcgaacaaataaaaaaaacatccaacaaaattagcaagataccaaaaaattaacatccaacaaaactctaaaaataaaaatttagcaagtcaccagaaaattaaggcaaaatttgctacaggacactcacagattgtggcatttgctgtggacacccaaaaatcgtgt

SEQ ID NO: 46229 - DNA, 3414 bp, Oryza sativa
ccagggagccatggctactctgcctcctcctccttctctcacatctggtgcagccggacctggtcggcttatacaaatggcccatgggcagcattgtcttttatgaaagtttctctcaccgtttcagccagcaataataaaataatcggaggagtgtccgccagcaaattccaacattttttcggtgtccaagagcaaatacatgatctttgggtgtctcacagcaaagaccacaatctttaaatgtcctgtagcaaatttttccaaaaattaacatccatcaaaactaaaaaaaaaacatccaacaaaatttaaaaaaaagataaaaaaattgcaagtcacaaaaaaaacatccaacaaaacttaaaataaaataaaaaattacaatccaacgaaacttaaaattaaaaaaatgtccaacaaaactaaaaaaagttaacaagtcacaaaaaaattaacatccaacaaaacttaaaaactaaattaacatccaacaaaacttaaaataaaatatgcgtccaacaaaacttaaaaagttaaaataaataaaaactaaattaacatccaacaaaacttaaaataaaatatgcgtccaacaaaacttaaaaagttaaaataaaaataatttgtctgagcccaggttcgaactggggacctttagtgtgtgagactaacgtgataaccaactacaccacccagacattgtgattgaagaaaaaaatattgatgtaatattgtaattacaaagaataatctaccaactgtaaagaacggagagaatactggagctcatataatttctgttgttctgtaagaaacaaatctgtaaaaaattttattggctcaaaatgcatacaaattttcagactttgattactcgtgagtcgtgacacgtccaacacgagaaaatcgttttcgctgatcagtcctgtccagggcccaaaagtgctgaaccagctgattcgcccatagaggcccacaacgcccactaccaaatcagaaaaatacactactctgcttcataaatggactaatatcttctgattattaggactgctcagaaataatcccagcatgcaattttctgcatcagcttttcacctttggtaatcttgtctatagaggcagataaagttccctctgatctttatgaactgttttgtatgccattcaatgaggttcaacttttcaaccgaagtactccacttcctacactaattcatatacgcacaaatataaattcaaacatctactacttggtaacatttgactaataattatggggaaatatcctgggaaaaccatcaaataagtgaaaacctatgaaaaacatacctaaaaaatctctaaattaataaaagtattagtagagatatgtataggcatgaaatactttcatgtcaaatctcaagtccaaactcaacttcctctgagagttactcccaaataaagttaagtttgaatttaagatttggtacaaatcatgcatatacttctctccaataatttttcatgaatttagaaaacttataaatatagttttcatgggttttcaccatatatgtccccaataataccctaacaaattataagtttacagttataaaagtggtacagttcgattcatattttaaactcatttcacacgatgttaatttcgtaattgttgataaatgtctcatggaaaaggaatatgggcccagcgaaaaaaagtaatattgcaaaaattgaagcatggctgatgtgatactgtaggagatgcacatttggagtgggccaagtcattggattagcaaaagggaaagagggaaaggtcattgtttctatgaatatgatagcaagcaactaagcaagtgctccaacagttgcttttcttctcacttgtacaatcctactacatcacaaccccctgatggttccttctctttttctacttttttcttgtttcgttttgtgttggatttcaccatcataagggtgggcaatgacaggattccgcgccgacacccgcgtcctattggctgccatggagacttaaattggcagctccaagaaccctagtggtgcagacaagacttttatcaggaggaaattcttggagcccacaggcatgcagctctgaatttatcatcttggggactccatgagtgtcatctcaattggggtccatgcagattttgcattcatgagaacaaatagcacatttgagttgattttgtgaagatttgacatgttacacttgtactaatgcataggggaaacaaaaaaactcaatttgctcagtactccatgtatatgaatatgatctggatatcaagtgaatgcaaatattgtgatcatgatctcggagtaatttaattcacacatttgagtagttgtgctaagatagctgtaatctgtataaaaggatcatccaggattcaaatgctagaacagtacggaaactatggaaatcaacataggagtagaacataagaagctactacctccctcctaaaataaaacaacttttagttataaatctaaaaaaatgtacagctatattctaagacggaggtaataataaatagtattagtaagacaacaaggacatcatataactcaatatgagaagcagcgaaaattggatccatttgtcctgctaaggcttgatgaatcactgggacccatttaggtgtcctacgttttctctggacatatgattcaaaaatatcgaggtgcattcagtgaagtttcggctgtactaattacatctttcatgtccttgctatgcttcatttcaccatataaaaagaacagtgtattcatcctcgcaaaaaaacaaaagaagtaaagaacgagagtaaaaggagtaacttacaatttggactagggggtaggagttcacaaatacaagagaaataatcggagcttcagacacggcaaaaatttggactagggggtgggagttcacaaatacatcaggcatagttactttatgtttttcagataacgtatcaaagattcaaaatttatgtgatactccatactcaactttgccaaaaggcacgtgcaagatatagttctctggcccacaacaaaatagtctcagtagcagagcaatgatttctgaactgcggaagctggtgaaaaaacagcttcttttgatgactagtggcagtgcattgtgcagcttctgttcattctgttcctattgcagcagccagtctctgcttgtctgaatgtgattcactgcagcaatgtctgcttacaaggacaaacagagaaacaaaagcagcagccaaaagggaaagaagaaattcagacaacagagccattgaaattcaatcactatcacaggtgcctttttgttactagcatggttgcattttttttttgaaggaaaaaagaaagaacatttgtacgggcgcagga

SEQ ID NO: 46230 - DNA, 5798 bp, Oryza sativa
tttggtacttgagctactgtagcatgatttagataagtcatgcaatggcaaaaaggtggacagcaaatgtcaagcgctatttttctccctaatcatgctgaagttcatgagtgtcttgttggctcactttgcatagcagcatctccataagatgttccaaagtatcttactgcgagattgcaccatgtggaaaggttgcaaaaacataacaagggcacctttcaggatcagaaatggacacagaaagatgcaactatactcaatgaggaaaaaaaaagattaactagtcatgaacatctaaactttgccacacaaagatagtttgatagcaacatgcacatttcattcatgcagagctgaacccgactaaatatttccaacattattaggttatcaaaatgctaaagtttcagagatacctagctgctatctggggtgcacttcttaggactggatataattccaacggtttcaagtacattgtccaagaagagcacatactaccgctagtagtatcatccgttgcctgaaatcatgtggcagggagcgcctccgtaatcttcatcgccttcggtttgttctctcccttgatgtcaagcaagaacttcaccacaagcctcatcgacgggcggttgtttgggaggttcttaacgcagagcagcgcaatcctcagaactctacacatctcatccttgaaatgttcagcaatcttctcatctagcactgactctgccccattctgctccacattggtggctgcccatgccaccaggtccttgtcaccaatatcggatgacatgggactctttccagtaacaagttccagcatgaccacaccaaagctatatacatcgctcttctcagttacacgtatagtgtaggcatactctgcgatacaaaacagacaaacacacataagaaactaggaagaaattacggtgacttatgacaatttttagccaattacaacaacccacaagtacaaaaagaaatcctaatcagaacatatggaccaaaaaagactgtctgaactgatcatcaaatcaatctcaaaagctacattcatatatactctaattaggaacacttctcagaaacaaattaggaacacttctcagaaacaaattaggcataaggaactcaccaggagcaatgtatccacaagaaccagcaatgacagacatggtggccggcccatcaccaatagacttcgcgacgccaaaatctgctatcttggcacgaaaatcagcatcaagcagaatgttgtttgacttcacatctcggtggatgatcgcgggaacaaagtcatggtgcaagtagctgagcccctcagcagcatcgagtgcgatgttgtacctcgcaggccaatccaagatgccagctttggcactgtggagaaagtctcccaggctgccattaggcatgaactcatagacaagcaaccggcatgcctcgttcgtaagacagcagaagagcttgacaatgttcttgtgcctaactttgctcaatgtttccacctcggcctcaaagctgtcgatcttcttgctcgccaccgtgctacttgcccaaagcttcttcacagccaaggtatcactcctaggcctgacaacagccttgtacaccatccctgatgaacccttgccaatcaaattgttctcagtcaggctattcacaatgtccctctcattgaactccaccttgtggaaggatgtgagtacccactctgaattctcgctgtcaacttcgatggcgcgcttattgtagctcctatacttgtaaatgaaccaggcaacactcgtgagtagaatgccagcagcagctgtgaggatggctacagccatctggattcgggcacgccggttggaatcaggatcaccattccttgaacatagcccatagcacaggccaggattacccaagaagcacggtcggaattgatcagtgtcgaataagattggaagatgcccagtgagcttgttataggacaggttaagaacacccagcagtttcagatcctgcaattgtgcaggcacctgaccagaaagctcattgttcgacaaatcaagcgtgctcatcttatccatacccccaagctcttcaggtatactaccactgaggtggttgtctgaaagattcaacaatgtcaaattcttcagttctccgatgctgcgcgggatctctccagaaagggaattgttgctcaaatcaagcaggaaaagcaccgaaagagatgcgagtgacggcggcactgtcccggtgaagctgttgtccgaagccgacagcaccaccagctgggttaaattccccaattcagcaggaagaacaccggtgaatcgattgttatcaatgatgaggttggacaggttcgcggcacggccaatggcggcgccgacattgccagagaacgcattgccacggagctcgagcaggtagacatggggcaatccccagaattccggcggcaccgggccggagagccgattgcagggcagcctcaccctcatcagcgacctgcatttccccagctcgtcgggaatggcgccgtcgaacatgttgttcagcagcaggagctggctcagcttcccgccggcgcagagcgtcgccggaatccggccggacatgcggttgtccgagacgtccagcgactggagcgggcagttcttcccgaactccggcgggaacggcccttcgatctggttggcgaagatcatcagctcggtcagcctcgccgccgccgcgagcgtcgccggcaaccgcccggtcaggttgttctgatacatgtgcacgctctccaggctcggcgcggcgaacatgtcctccggtatctcgccggagatgtggttcatcgagatgtccagttgctggagcttcttgaggccgcccaaccccgccggaatcctgccggagagctggttggagaagagctctatctggaccaaagaactcaagttcacgatgctcggtggtatctcaccggtgaggttgttgctcgagaggtccagatcgacgaggttggtcagcttcccgacggaaggagggatgctaccggtgagggagcagttggcgaggaaaagcacgcggagcgcggcgaggtcgccgaggttgtccggcaatggcgacggggagaacgagttgtaggcgagcagcagctcctggagcgcggttacgttggcgaggaaccccgggaacgcgccggagacgaggttctgtatcaggttgagcaccgccagcgacgggaacccgccgccgtaggccgccgggagctcgccggagaagttgttcgacgcgaggttgagcgtctcgagcgcctggagccccgcgaggcaggcgggaagcgggcccgtgaggtcgttcgacgacatgtcgaggtgccgcagcgaccgcagcgagcagagcgcgacggggaaccccccggcgaggtacagaccgccgaggtagagccccgcgacgacgccgtcggagacggcagcgttcccggccgcggcgtcgcacgccacgtgcggccagcggcagaggtcgtcgccgcgccatgccgagagcgcggcggtcgggtccgtgagcgcggccctggcggcgaggagcgcgcccgcgtcgccggacgcggcgccgccggtgcccgcgcggacgcccggcaggaggaggccggcgaacacgacggcgaggtggagcaaccgccggtggagcggcgccatggtggaggtggtggaggtagagtggggagcgtgggtgggaggaggagaggtttaaagggagggaaggaagttgcataggaggattggaagcatctcctcctggggtggttttgtcttttagatagacgaacacattgaaagcgatgagggttggggattttggctacagctaccaagggaagtgtccacacagggagtattatcactacgagatacgcttggatgtggtggtccgcatcgaggggaggctggatatagcgagaggttgtacggatcatgtagcaagtttggaagatatctatgtggtgaacgtggcaatatatagaatatgctgctttttccgtacatgtaaagtcaatgcgcttggctgacgtatgagaaacgtatccggacgttgagttacagttagatgttggtaatggtacgctggcgttggaagaaagcaattgttccgatttttctatgttgacaagatgattgtggctttggctttcccaaataaaatatattattttagttgcttcaaatagaattagaaaaaaaactgcaaaaatatcttacgttacaaaagcgtcgataagataacgtcggataaaaaattattcaattttgtccatcttttcttaaagaggagggctatatttatctcaataatttatgatgttcttgctataccgattgccattaaaatagtataacagctaaaaggtatccgtatttcaagtatgagattattcctcggcattgtaagagcacatttagttagcaaactttaatagaacctttggatgtggcatacgattgagtcatgattttattttcaagaaaaaaaaagcaagaatatatcatctgggaacctcaccggttccaaattaaataagtatgaaaaacaaaccgttcaagatttatctcctgtctctactctatcaatacattcatattcctctaaaaaaaatgcattcatattttttttcatcagttttggtagtggtggtggcccttgtgtgcaaaaagaaatgtgctttgctggggttcgtctcctctgctattagggagtactagtagcgttttacagtgaaaagtaccgtaattattttatgggattactgtagcaactactctcctgcattcattcaaatttgatccaacggctacaaatagctattgacatggatcagagtatggagttctctaccattccggttgggatggcagaggatactatcccactttgctgtggagtacacggtcccgtgtggacgcagcgatatttgcggttgcttaattaagtcagtgtttgggcctgggaaatgcgggaagcgtggtttggttgggcctcgttttccagcgttaaacagtaacagcaacgcctcgtcttcttcttcctctcgcctgcagtcgcacgcgcccagaggcgccatgcacgccggccgcaagcaagggaccacgtacgtactgatcactctttctctgcatgcagctatagccagcttcaagccttgatcggtctgctacgatctggacgacgcgctcgctcagctggatggatggatgcatcagcgtttcgcgcgcgtggccttcctgctccaggtgattcttttgttgcttgcgctgtgccgtttcttaatttgtcttgcacgcgcggctcgatcccctccctttctatctctgccttggccatctctgccactgaattgagaagtgatgcagggatggatgggttggaactgggaggaagacgacgacgacgacggctcaagctgttggttgtagatggggggcgttttggaggattgagatcttctgtagccgtcgacttcaccatgccattatcactgatatgtgagcccgataatatatcgggcctacatgtcagtggcaaaggtacggtgctagataatcctgatccgtttttggatggttgtgcagcagcgagggtgcgggaggaggcgcccgccccggccgccgccgcgcgcgcggcgtgagcgtggctttccgcgcggcaactgtggctacgggagtggctgatcctggccggtgggctggaaaagctagctagctcgttgtttgtgtgttgtgtacttgtgtgcgggaaggttgtgacag

SEQ ID NO: 46231 - DNA, 7440 bp, Oryza sativa
aaataactgaaatttggaatcaaaaaataaggaatattataaggggagactagagtccatatagaaatacaattaggaaataactgaaattcgcaattaaaaaataaggaatattagaagaggagactagagtccatatagaaatacaattaggaaataactgaaattcggattaaaaataaggaatattagaagtagagtatagagtccatatagaaatacaattaggaaataactgaaattcagaattaaaaataaggaatattagaagtagagtatagagtccatgtagaaatataattagtaaataatataaattcggaattaaaaataaagaatattagaagtagggtatagagtccatatagaaatacaattaagaaaaaaaaatagaaatttggaattaaaaaataaggaatattagaagtagagtatagagtccatataggaatttaaaactaactaaaatttggaataaacataataaaattaaaagtagagtctagagtctagagtctagggtctagagtctagattcagagttaaaaataaagaaatattgaaagacgagtttagagtccatataggaatataatttacaaatactaaaatttgatattaaaaataattaataactaacacgtatatataataaaatataaatattacacattagtagtttcgtaaagttagtataaaatttaaaattagaatatcatttttaatatatttgaataatacattgagaaaacatatatgctattacatgagaaaaaaaatataatgatgctagccgcgcaatctgcgtgggccaccgtgctagttaatagtatagtaagcaactattatataaattggctattaaattgactatagatgaattggagctattagtgggctatactattaaacttgctcttacatgacacggaaaaagatttttttgaaaaaaaaaagcaattagcgtacgattaatataatatggagtaatttagtacaaataagttaaaaagaatcgtttttacatatcataataaaacgaacgaatggagttagctgcaccagtgatatatgccaagctatttagctgtcccctagcttggtgtggctaggctagtaatccgtccgtcttattttaagtgtaaagatttttctatatcaaatatttgaccgttcgtcttatttaattttttttaaaaaaatttcacacataaaaatattataaaatttcaaataagaccgactgtcaaacgttgggaacagaaactcacaaatgcacctaaaatgggacgtatggatacgtgcagtaaccttttctggttttgaaacgatagtatatttcatgattaccatacggttttcacgataaccgcacggttaccacagtaaccacgaaatcaggagtgacgatgacgataatcaccctaaacggtttggtaaagtattgagagttgtgcagtataggagactagttactagtatagttgtacagtcatacaaagctatgcactctagcttgttataaatgatttgctggtcatttctgaaccttttgcagagtttggcaacgaatagatttcttaggcattgtttagttcccacgcaaaaaactttcacgatatcacattaaatatttagacacatgtatggagtattaaatatagaaaaaaaactaattacacagattgcgtgtaaaattgtgagacgaatattttaagcctaattgctacatgatttgacaatgtggtgctacagtaaacatttgctaataacagattaattaggcttaataaattcgtctcacagtttataggcggaatatgtaatttgttttgttattagtctacgtttaatactactaatgtgtgtccgtatatccgatgtgacacgccaaaactttttacccctgaatctaaacacagccttattttgagctataggttgtgaagttctacgctcgatgaaaaccaataagggaaagcacccatgcaacacaattgagcatttcctactactttctaccccttcgtctaaaaaaacaaccaacaatcctacctaagaaactgacacactaggatttttttttatagattagcagtaagtagtaagatttttcttaggattcaagtttgacagatgccaccctaattttcactggctttcctgtttgtttttcaaaatccgtgttctggcatacagatacggtaggccgaaaattgctaagaaacggccaagaaaattcagttaaagttgcaaggcagtttctgaatgatcggtagtatagctctgttcaaaatgatctgttgctagctgcctgctgcatgtaacgtgtactcctacgaacgagcttagactgcagcagcagcagcatctactacagtgcataaggcacatgtaccatgcagtacccggggtagtttgacgctagccatgaaaatttacgttaaattattttcctttttctttggttgcatcggttcatcacatgagttgtacgcttggcttttgcacggttgcttgttgttttggtggcttgcggctgcaggggttttgcactgacacgtatcgatctagaggcatggtttcagcttcggtgaataattaaaccgtcaaatttaattagaatatgtttcttttgtcactttttttaccctcggttccaggtacttccaatatttgaattttattgaaaaactagaaaggaagcccgtacatatgcacgggcatatcgtatttattgctaagagaattaagtcatatctcaccatatacatataagaatagatttggcctcgtaataaaaaaaatatgttgtaaaatagaccgtagacttttatataaatgataagcatgtctcttatattcaaacaaaaatcacttttgtccaggtaaagtgtaaatctcctattatcaccattactaattatcatgatatgtttttaataaatagaacttcatctgtaccatcaaaataaggctaataaatcattaatacataaaatgttcatttcaactacgtacataaatgttatgtcaacacttatttctaaatctacgagtaaatattctaaaactaccgcttctattggttattaggataacaccatttaaacacatttaatttgttttttatattgatctggtttaacttgcatatttatttttggagtactaaaatttattttattgtatagaaaatcctattttgaaaaccatctatattccgatggttctaccaacttatattagtattttttttgggtgttatagctttattatggtatgcacataccttttttttgttttattcaatcgaacatccggtaaaatggtttctctcgtatacataggagattaagagggagcgggccgatctaatgatctaaaataatgggtccatcattttgaatgaaaattgacaacgaattatagagtgccacgtggtattctaagagtgcttgcagaaatgccacatgaccatatttgtggagtaataaattttatttttatagtatagaaaattctatttttataagaccgtctatttttttcttccgacgcacataaatttttttgggtcttatagctttttttactcatgtaactgtacatacttttttttaagagaactaaagggctttattttgttttatagtctttttatcgtagtacatactctgatatataattttttggtctttatagctttattatcgtatatacgcatgtttctttgtatttttttttcaatcgaacatccggtaaacattttctctcgtttacacaggaaattttgaggaaataggctaatgtaatgatataaaataatggatccatcattttaaatgaaaactgatagcaaaattgtaaagtgtcatgcatgtagcagtctaagattgttatatagtatagaaaattctattttaaaaaaccatctatattttttcaaccgacgtacatatattttttttataggtcttatactttttttattactcgtgaaaagtgtcatgcatgtgacagtctaagaagagtgtttatagaaacgccacgtgaccttatttgtgaagtaataaattttgttttcatagtatagaaaatcctattttaaaaaaaaaccgttaattttttctactgatatatgtatatattttttaggtcttatacctttttcttattactcgtgcatacgtgtaagtttttcaagtgtaggtacgtatttatcgtaggtatgtactttatggatagtactgtacgtacgatcacgatcacgatgccatcggcaggtttagtttttttttttttcccgtcgtatgtatatacgccacagtaagtttttccggtatatatattgaaaggaagtattagatttaatctaatggcttaaaataatgggtccaccaatttaaatgaaaattgatgatgagattataaactgccacgtggcaacctaggagtgtttgtaggagcgccacatggcggcttaggaatgtttataggaagattaatggatttttagtatataatagatagatagatagattgatagatagatagatagatatagctactatttctaaatctcttatctcaaccaatatttacaacaatcttttatttaattttttcatatattttatcaacccaaccgatcactatcatttctcttttagtttcacgtcccttcttaatcctgtgaaaaacatcagaagtgcttgtgttttttatatgggaatcatttttcaaccttgatttctggaccgtttatgaatacaagtagtatatgattacagtatatgtcagggttatggataccacatatctaatagtagttgactaaatctcgacaggacccactacataccatgttctatacagaagcaatcttcggatataggaagagttccggataaggaaagacaaccagagttctacgtgaaaacgacaaggactactcggattgtatccatattggtttccctagttctacttgtataagaggacacctatgggtataaatacaagcccccctaggaggaggagaggggggagaatgaacacccaacataatcgacatagaagccacaacatagaagcctacatacgctaagacacgccgccggatatcgacttcagggataaacacggctagtaccctacggtgtctccggatactgtcaggagagatgaaagcgctatctctgatctcgccgggcacggattcgaggagaaaggctaccctgttgtcgactacgggtcagatcgtcagaccgctatgtcgacaacagttagataggctaccctaaatattatactggtatgattatcatgaataagagcaatactggcttcagccaacaggatatagggttattacctgacaattcaggggcccgaatctgtataaaaatcctcgcctccgtctctttacctcagtctcgcgtatatcctagtaccaacgatccctataccatgcaaataccgtagtcgagacatcaaacgtcgacagtggcgcgccaggtagggggattttggtgcttcaggatttcgacaagatgggtttaagagatggactctccgacaacaagctattcgacgacttcggaccaggaagatccaacccggccagagtacgtctctcgatgaggttggaatcatcgtcatcaactatttgatccggcgagatcgatcaagctccaagatatcatcgccgcgaaggataatagttcaatatcgccagatacgggacttcggttcatgtcgactacaacggaacttgccgatctacgatcataattggtcccgaccgagtccaaatctgattacgtgcgcctgtaaattctcaaaaccggctggcggctgcaccttgtgcctggatagtcctactcggacacgatgacaagaggatgcacactatacgtgaagtctgtacagggaactgaagcacgtgtccaccatgtgacgggatgccacccgttttcaggtatttgatagattaattttttaaattaatctactaattttgtagatatatccggtatatatctacacaggtacacaatattttcgtacctatttttacaatctatacagcattgtcagatctatattatgtttacctagagcatgttttttatacaatatctattgcgcgagtgtccccgatgttaaatcgacaacggtttaacgctggggctcgctctattttcttctgtataaatcatgcttgtttacggtttacataatgcctgatatttatatctgctcgttatatcctgataatactagaagatacatgcagttttttgagtacatactcgatattctctgctatatgtcttgccttctagaaaatatttttcatgaacaattgagcacttgagtaggttgtggtcaagtacatcgcattgtcgagaacgatctcgacaaatgcagagtcgttgcgcccaacctaccaacaaagaccgacgacctatctcatagcaccggccatggctggactactcgagaaaaggttgttaacggataattcctcgggaacgccgttggcttgatcacccgacatgattgcgaacggacatccggatatgctacaagttgggtgtgtgagtcatgctggccacatgacacgcacatgtaataaaccaactctagcacctccattggtgttcgagagataattctacacgttcggtggttctcgaaccagtacgtagcaatctcccgcaccgcagcttccattggtgcaccgcagcttccattggtgcaccgcaagcttccattggtgttcgagagatgattctactcgctcgctggttctcgaaccagtacgtagcaatctctcacatcgcaagcttccattggtgttcgagagatgattctactcgctcgctggttctcgaaccagtacgtagcaatctctcgcaccgcaatctccattggtgttcgaaagatgattctacatgtttgttggtcctcgaaccagtatgtagcaatctctcgcaccgcaacctcagatggtcgaggtacgactacagcaataacgcagcggtcctcgcaccacgacttcaaataatcgagagacacctacttactggttctcaaccagtcaatcgtagcgatctatcgtacatttacttctagtggtcgagtttagactacatctggttctcgaccagcggtgtagcgattctcccactgcccttaattctagtggtcgagtttagactacatccggttctcgaccagcggtgtagcgattctcccactacctttacttctagtggtcgagttacgactactacctggttctcgaccagcggtgtagcgattctcccactacctttacttctagtagtcgagttatgactactacctggtcctcgaccagcgggtagcgattctcccactacctttacttctagtggtcgagttatgact

SEQ ID NO: 46232 - DNA, 3750 bp, Oryza sativa
ctccgagaacgattctccgacgacaatgctgggggctagggagagtgtataactcaacaaactgactgatcgaagtcggtaaaagagtagacgctcatatacaaaacattggtctgtaagtttaattcattttcggttttccatacatattataacatgttaccctttgagcgttcgctcgggggctatttctatctaatattcttttctgagtattgatttcaggaaaattctatttgacattatcgaagattccatgtctctatggttctacaccaagatcaactaaggcgagtatgataaatgttgacaaggctccgtcgcagactctacgcctactcgattactcgagaacggttggtggatctcgacaaggaatacggaatgaagagatggtgtaccgccgagataaaatttcttgacttcaatccaaattctcgattacagcaagacgggagacttagtcgtatgctttgtactttcttggttgacatcggagattgactcagacaaaccctttaggtgtccgcacgaggctgataaaggaagtctaacgttatctctgaactcaccgagaacggttacgtgcgctcgataacagttcctccaaggtctgcggttgagaatatgaacttgttcatttgcattgaagtcgggggctactgtcagggttatggataccacatacctaatagtagttgactaaatctcggcaggacccactacataccatgtcctatacggaagcaacatttggatataggaggagttccggataaggaaagacaaccacagttctacatggaaacgataatgactactcggattgtatctatattagtttccctagttctacttggacaaggggacacctatgggtataaatacaagcccccctaggaggagaggggggaggatgaacacccaacataatcgacatagaagccacaacatagaagcctacatacgccaagacacgccgccggatatcgacttcagggataagcacagctagtaccctacggtgtctccggatactgtcaggagagacgaaagcgctatatctgatctcgccgggcacggattcgaggagaaatgctaccctgttgtcgactacgggtcagatcgtcagaccgccatgtcgacaatagttagataggctaccccaaatattatactagtgtgattatcatgaataagagcaataccggcttcggccaacaggatgtagggttattacctgacaaatcaggggcccgaacctgtataaaaatcctcgcctccgtctctttacctcagtcgcgcgtacatcctagtaccaacgatccccataccatgcaaataccgtagtcgagacatcaaacgtcgacagtatatgattataaaataaaaatcatatacagtcataaaatcactgtataaaaaaatactagttatgggttttatctagtagatcttgtacatgatccatactactaattattactttattcgtgtcaaaataagtttatttttttcctcccatttatcttaaaataaatttatttctaagcaatcgtcatattggagtttataaaagtagggtataaatatattgaaagtacataagagagtaagtttgtgtccttttggacactttgtcaactcttaaccctcatttttcgcacattttttaaactgttgaactgtgtgatttttgcaaaaaaaatataaaaatctaatttaagaaatatttaatactaattaatcatgtgttaatccattgctttatttgcgtgcccatatgaaagggttaccaacactggctatcgaacacatcctaatgattgcataaaatatgtagtcttttcgatttcatattggtatgctattgaacacaatccaatagttgtatcgagatgtgataaaataaagatattatagtatttttaattttgtattggtacgtgtagaatgtgtgaaaaataaacttattttgggacgaagcgattacgcaatgatcgtattgttcaagttagagggagagaccacgagacaccgtgttcagaacacaatagtctcgcaggactcgcagtgaaaatggttcaaaacggcagagaaagtatacggagataaggccagcagagaagcacggggcatgtcgagtctgagattcgagaaaggcatggagaaagaagctgagcagcagggtttacgattccaatatgaacttcagtttcgggctctggtgaaatgacggttttcatgaaatctggtgaaaagccggtaaattctgaacaaatttcataaaccaaaatttgaatacaaataccttgagtttatcgataagcttgcgaaaaccagtcgactttagccaaattccgagcgaaatcatcgaaatttaagtgttttcctttttttagtttgttattcttttctttcctactataaatttcagtaaatacacagaatacacctttttttcaaaaattacgaaaatcatactatttataagatttcaaatttgaatttagtcgtgtttagacacatgtatggagcatcaaatgtggacgaaaaaaccaattgcacagtccgactgtaaattgtgagacgaatcttttgagcctaattacgccatgatgtgacaatatgatactacagtaaacatttgctaatgacagattaattaggcttaatagattcgtctcgcagtttacaagcggaatctgtaatttgttttgttattagtctacgtttaatactttaaatgtgtgtccgtatacttaaaaaaattttggcacacgaactaaacatagcctttaaatgaaactcatcaaaatctcaaacggcttctactttcgagtctcgtcaaaatcttaaagttttacggaattcgatcggttttcgtcgaaattgagaaccctgctgagcagaacaaggatttccaattgtaacgccccgattttcatttgggataaaaatcatttaataatgcattttctagaaattaaataaaagttaaatcaatttaattaagtgaaataatgggagaattaaaattttccattaaaaatcattggccgggaatattttgtaatattctttgtgccctaatacaccctccggatttttccgtgaattttcggagctcaataaataattttaatgccacaaagttcactaaatcaatttaaagaaaaagaaaaaaaaacaaattaaatcctccttcctcccttttcgagctcggcccaatcctctctccttcctctaccgtggcccggcttgcctccccttttgacgcaagtctgcttttcctccctctcggcctcccctctcactcaggccgacaggtgggacctgtgggccccacctgtaatccccgagatctagccaggccggcaactgccgcctgagccgctcccgcgtcctgccaccaccgcagccttcgccgccccgcgggcaagcccggagccgctcccccattccacccccgagctgccctctccacggtgaacccgagccaccgtcgccattgccgcctctggccgccaatcgctgccgctctcgtccgtcccgcgctacaccgtcgcctccctcggctccgcaaggacgaggagaacctcggccacctcttcccattgccgaaaactcactggacgtccgttttcccgtacaccggtgagaccttcctcccttccttccctctccggccggccatgtcgccgccccgtcctccctaacgcctcccctcccatcccagggtgcagctgc

SEQ ID NO: 46233 - DNA, 6059 bp, Oryza sativa
aattcatttaaatggctcgaaacttctaaaattcatatctaattcatatgaactccgaattgagccattcaacttgcaaaattcatctaaaattgagctctacatgtttgtttagtttttatgtactttttcgttggtttttattagagtttttcctcgttttgcgtgccagtgtgtagaatccgtcgttttgaaagttcgcggtcgcaaggataagagttcggaagattgtttgaagaagcaatgcaagtcacacattccccttgagcattttgatcctaatttacaaatattttatcgtttgcaaataaaattgcatgtcttgctaattacatgggatccgggtattacgtgccatgtttacttgatatctgtactttgtcaacattgggtaataaatcgactagctcatgttacttatgtgacctagctagaactttatgcttagccatgcttaattaccactagctcagttgatgcgataattacagtattagacctttttagtatcagaatgagctgcgtgctcgagacatctggccatgcttcatggtcgtaattatccaactaaaatgcgactgaatggtgggctgtaggtgtatggttttgctagtcgcacccatggcaattaaggaccggttcgcgggatgccctggaagaacttatcgtacataccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgcggtgtggtgtgcttggttagagggagttatgcgaagggtcctgtcatggcctctttccggtatgtcatggtggcatgtcggcgcacggaaacgtgtcgtggggctgtgtcttgtgggaacagttgtacacctctgatcagagtaaaactattcgaatagccgtgcccgcggttatgggcggttgaccagattcaccgtgaaatagtctcacccctaataaatcgacctaatgcactgtagttcaggtgggttgggcctgttcaatgtggtgtagcgttgatcagtggagatctaatttactttaattacttaacagttttactgttttgctcaataaaatattttacaaccgcctttatgcaaatagccacaaaccgtccttgtgttccccttgcacgtctgcatcgttggtgtggcttgctgagtacagtggttgtactcagccttgctattatttcccccttttcagaagtgcagtgcttctgagctgaagacgaagttagaggaccaaggctcagaccctagttgagttttgcctgtggagtggagctgaagccccgctaggatcgtctttttccgctgctgtcgttctctttcggtgtgaggactaagtgcctcttctgtaagtattttacgctttatttacgtttagaactctatattacttgtcgtttttgtgtaccctgactggttctggatatggatttaaaatttgggttaaatttctgtgagtgacaccatttctccatggtcctcctctctggccgagcctttacctttgcttccgtctcttcgagctgctgctgccacctttcgcagtgatgtgagagatggccaagctgctgctgctgcctgctacggggtagctgtctttcacgtcagcccgttgcatgcttgcttgctgccctctctttagggtgtgttcggacccaagggttcccaacccttctcaattgtatttaacgtacatgctttttaaactgctaaacggtgtgttttttgaaaaagtttatgtatgaaagttgcttaaaaaatcaaattaatctatttttttaaaaaaattagcaaatacttaattaatcacgtactaatggaccactccgttttccgtgttcacttttccggatgggaacttttgtagcgaacacagccctcacgtttgtttttaccagcacagttggataacatggatgcacgtacgggatcaaagacagatactccctcgtaaaaaaaaaacacatgtgtccaagtacaaacacagtatccaagtacaaactcaggattagatattttttgacagaggaagtatatacctaccagcaaggaacacgatgacgggaacgagggatgatacactcgtctctactataactaggtccaactcccacatatacactatccgtctcaaaaaaaaaaaatcaacctagcaggggaggggatatacccctcctaggatgatccctcctaggtcacatctccgcctagattttctttttgagacgtagggagtacaacttttgtttttatcgtaaaatataatagattttattcaccaaccctcttatttcaaccaatcacatatacttccatctaggggtgaaaacggttacggaaattcccgatcgaccaagcgccgtttccgtataagaggtacctttttagctatttttaagttttgttttttcttatttctttctgtatcatattaatatcgacactgagtagtttaaatgataaatatgatcaattatctttcttcttttcttctcttatgaagtcatatcaccttaattttcctttagatgattaatgtatattatcttccttattttccttttctcattgagacacattactttagtattgcttttaaatgatcaaatatattatttaaactgttataaaccaaatcattttaattgtttatagctttttcaatagtgaaaattatataaaggatataaagttatgtcgtgtagctatcttgcaggttagttttacatttggatgattaatctatgttatattttttccctaatctcattgagctaatacattactttggttttgctttttattgatcaatcataattgtttatagcttttttttcaataactgatcaaagatgaaaatcatataaagttatatcgcatagctacatttaagttatttctactattatgataaaaaaattcccgcaaaaatttctagttagaaactcctatttcgtaaaaaaagtgtaactctagactactatgggttcatttggttccactagaaaggctaaatatttggaaccagtaaaaagacatgcttttaggagcaagctagccttacagggtgagaaaaatcccctggccagggagagccgatttagctcgccttccatggcaaaactccaattgcaaaaacaaaagagaggaaaagctctactcgcacgaaaaaattaggataagataagaacgacccaggcttctctgaaatcagaaatcagagatatttctcgacaactcggcccaatctcataggcctcttctcccacctctcgctgacgaagtctttccctgaaagcatcctctccacctactcataaaagtcacagccatctggagaaaaatcgattagggaagaggcgaactcatccgcaaactcgatctgaggcaaatctattcacacggccgctcctggatcttgtttctctttttagaaacaaaacgagaagcaaaataatcatcggcagagcaagaatttcgtacacgatccaaacagctacccactatttcttgcctcaggaagcaaactaaacacaggaggtacgacaaggcaagcaaactgacaatgagatggtttaacctcaccgagctaggttacttgcgccaagatccaaatataatgtaccctatctctccctttcaccaccccttgttcaatttttttccatctgaccactaactaggggtatgcattagatggtttgttttattttaaacaaaattggtcatctaaaagactaaaagtgtctaagaccgagtaattgttcggtcttttatcaaaacagaaatggttgacagtttcataagagcaagtttaatagtatagcccactattagctccaaatcatctatagccaatgcaatagccaattcatacaataattgtttactatactattaatacatggtcccacatgtcatatacacattgcgtcttggagtccgtgctgcagctggctacagatctgtagcccgctacttttctctctcatcgtttatcgtattaaaatatgtttatagctggctaatagcctgctattgtacctgctctaatgctctaagattataattaaattttggcaacacttctcttcttttaagatttctttactgctctcttgaaatgatcatatatatatatatatatatatatatatatgtatgtatgtgtatatatatatgtatgtatgtatgtgtatgtatgtatgtatgtatgtatgtgtatgtatatatatgtatatatatatatatgtatatatatgtatatatatatatagacacacacactgcatataggtaggagtaggatgcgacactgtaatctgacgtggataacaagatggattgggagcccctttcccatagattttgtgagcaagcatagctgcatgggcattgggcaagctagcagaattgacgtgtgtgtgctgcctgctggctaatgaccggtggtctcaactctgaagagaggcgtggcagaaaggggtatggtttcagttgggattctttccaagcctcctgcaagattctcaccaaaaggcagcgatagattcgaaaggcaggggatactctcgtgaccattgaggtctttgacgagagccttgatggcgtgaggatgtcacgacatttttcttttttttgttaaaaggaaatttggtcttgaaggattggaatgcaaacttgttctaattaatttgtgtttgggaagtacattaacagaaaagtgaagcacgaaggtacttaacatccaacccaagaatcactagggctgtgctatcgatcgaccacatcatagtttaggacaggctttccttgaacaaggtatctttacctctatatgtttagactttagaggagagtcgacagtactaaaataatcccttcaaattgtaattttcaaaaggctcagagaagcaataaaggaataaaaatccaatgacatcaagccgtcaaagggcttcatctttttcttatgcttatacttatcatccaagatttaaattttcaaccatcaaagtttatttttcagtcgttgcttttagatcgctaagaacacgtatataaaagttttattcataatttacttttcgtttgcaaatacgccgtttcgcgatggctccgaatgatttgccactggccccttcctgtgagtgttagagcgcaacattcataggtgtgcatgtgtgcatcatccgtgtaatagaaaaaaatgttcaaagagttttgaacggtaaacaatatcttaacaacttaaaaattgataatgttccattcgtcacatcattttttttccataagtctgatggagcgatggcctccgtttccacacgcgcgagtaacgcatcgcataagacggataaagcacaaattcaaagatagatcaattttttttcagtccgtcattctcgcatcattccgagcccacatcaaattagatccggtcgggatttcacataatcagtttgtgttacacctgtcctagaaaaatccctaatttgtagaaaccctaattttcaaaatctcctcaaattagatcccaaatacaagaactataaagaatggcaggcaaaaaaaaaaacctaaatcatggtcacaccggtttagatcttcggccgcaaatatggcatgatttcagaaatccgattctcgcccttgactaccgtgcacgcaccctagccgtgcaacactcatgagtagaatgccagcagcagcagtgaggatgggcacagccatctgtattcgggcacgccggttggaatcgggatcaccattccctgaacatagcccacatcggaatcgggcacaggccaggattggaagattaagaacaccccagcagtttcagatcctgcaattgtgcaggcacctgaccagaaagctcattgttcggcaaatcaagcgtgctcatcttatccataccataccccc

SEQ ID NO: 46234 - DNA, 2050 bp, Oryza sativa
aacgtcagggtttataagtacttattgttaaacaaacaaatgatattacactttaatgttgaacatgttgataagtaaatattaaatactataaaaaataatatgtatatttgttaagggcccctttgaatcacaagaatgaaaaaacggaggaataggaaaaacataggattctgacaggaatgtaagtgtaaaacagaggattgcaaaacacaggaaaaacataggaatgaccgtttgattggaccacaggaaaaacacaggaatttgaggagagataaagactcaaaggatttcttccatgaggttctacctcttgttaaaattcctccaaaacttgtatgggaagaggcattccataggaatttcatatgattccatagggttcattcctttgattcaaagggctttgtaggaaaaattcctataggaatgaaatcctctaaaattcttatgaattttctttgaatcaaagggggcctaaaatattatggaatgatatgataggtgatgattggatatgcttgcatgttgatttgtagaattaaatagattgtagatgatgttgcgtgcttgcatgaggttaaatatgtattattgctagcaggtgatcttatcaaaaagaaaaacaaatgatacctgcactttaatgtggaacatgttgataagtatatgttaaatctctactattactttgttggtattttggtacgtcatccgtatttgagtcagtttttaaattcgttcgtttttaaaaatacagatctgtgtatgagtaggattttaaattcgtgtagttttcgaaatacaaaataagtcgtataagaaatttctttaaaaaaaacttgcatgctaacttgagatgaaagtcagactcctaattgtagctcataattttctaaaaaaaaatatccaagcgaatttccatagtgaattttatcggtttttaagttcgttcgcttttgaaaatacaaatctatgtatgagtcagattttaaattcgtttagttttcgaaatataaaagaagtcgtataagaaatttctttaaaaaaaacttgcatgctaacttgagataaaagtaggactcctaattgcagctcatgattttctaaaaaaaaatatccaagcgaattaccattgtaaatttcatcctagttaaactgtatatagtggaaatgatgtgataggtgatgattggatatgcttgcatgttgatttgtataattaaatatattgtagataatgttgcatgcttgtatgaggttaaatatgtattattgctagtgggtgatgatggcatggttgcatgttaagctttggagttagtgggttgcaactttatagaaagtatagattgctaagttctagtagtattataacgtacttccaatcttccatatctatagcctataggctagctagtgatccgcaacgacaacgaggagttgtcgaagcgaaagtcgaaggaggagttgtctattggtatcaaggaggagttgttatcaaggaggagttgttcattgataagcagtgattcattttgagcaacaaccccagccaccccctcgtctttagtttcggtgaagacgagtatgtcggctgtgaggtgcaaggggacggtttatcggagctctaagttgacatggacaaagctatcgaggaggtgatggcagaggccatgaattccatgaacgtgaaggcgaccgagcaagcggtcgccgaggccggcgcggaggcagaggcgaacactgtagtaggcttggatgccgaggtcttggagacggtggcggaggcaaaggccttggagacaatggcggaggcagaggccttggatacaacagtagagggcgacatggtgaccatcgtctctcgcccgtctggctacccaaaggctacaacttcggaggaagcatcactagagaagcatggtgcgtaggttagggcaaataggaatgcattgcatgccatgggcagtgaacgacacctttagttagtattcgtaccggtatactactactagtagtaagtcatattagggctgcaggaatt

SEQ ID NO: 46235 - DNA, 10322 bp, Oryza sativa
ctcgatgatatcccttctcttttgtactactactactctaatttaaaatacattgtatgataggctcaaccatggtaattatgcttttgcttataagccaaatttggattttagttaaatcttaaccttgaagatgaattggtagtgtatttatcgtactttattttacatcatgtgtatcgcatgattgccctatggttacgtaccctattgccgctagcactgttcatatcgagaggttcatgggttacgtgacatcggttcgtatatattggtgccgaatcgagcacatcgtcatttacgcaatagtcgctgtgggtatagtacgttgtttgggtttttgactgtattatagtcgattgtgatttggtgtaggctgatgtgagtaattttgattcgaataatcacgattttactgatttgacaaatcacaattcacctcccgcaactaaagtactcctattggagtaggagtaattttctactcctagccagttaagctgacataagaagcgggagtagttctcttcagagtatttcattctgggacgttctcccttaaatttttggcatgcgtacgtggcaatataggagtataaattactgcgtgtgtggagtaggagagagaagcttccacaacaataagatcaggaaaaacaaccatattattactagtgctggtgcccaacctcccagatcgaatcaagcttgatgcgtcgcaacactccactgtctaatcaaatgagttgcaatgttgtagggtgcaggcattgattagacttttacttcgcgacacagagaacaatgcgttgcacctctggacaaatgaacatcaatatagtaggatagggtacatcattaattatcatcataattggactaagagcaagattaataatgacgatggtgttaacaaccaaatttggtaatctgagtatcggagatggtgataaagtcgaagcagaattcaagatggagatcgttccgcaaacagagtaagaatggactaaagtccgaatcggctgcgaccaggatcgacagagtccaagttggacaaggttagctgattgagccgaatccgataatatgacacgacatatgttgtcgggttgagttaatgtgcttcataaggattgccatgtatgtatagagtcctgagaagataattgtatatattaattaggatatttcatgtaattaggaaggaagcccgcgcagatgcgtgggcatcttatttattatgtgtttggagaattaaatcatgtctcaccatatgcatataagaaattgtatattttacctcataataacaaaaatctatgccgtgaaatatactacatactttaatataaacgaaacgaatgtttcttatattaaaaaatcacttttgtccaaattatgtaaactcgcctattgtcaccattacttattatcattgtcgctagatgcctttttaataaatgaaattgcatcttcaccaccaaaataaacctaatacattattaatacataacacatttgtctccactacataacattgtttatgtcaacacttatttctaaatctataaataatattcttaaaatgatgcttctattggttaatgggatatcaccgttaccaattagatatgaatgtcgtctctaacaggtggagctaccaactcttttttttctttgttgccttgaaacatgggttctgtatcgacatactcgtgcctctcaaggctagcgtataatgtaattttaaggcttaattcactatcaacaccctcaaagacgattgcattagtaagtaggaagttgagcactattgtcaacggtggtctccactggggctacctcgactcaaccatatgtatgcccctcctatacttgtaaaagctgctcaatgccctttagagaaagcaagaataaatggatgtaatgaaaataattcttcacataaaaaatagttgttttcatgttttgtgtagtcataatttgtttatggtattaatcagtactgcccaaatttttatggtatagatacaatattctcttttgaaatgagtgaggttgatcattaaaaaatgtatcgctaaatagatatatgaccgtaatcatcttcaatgtatcatatcatcatatcattgtttatattttgactaagatttatattttagcttctagtttgtttttgtcacttattgttcgtaattgcatcatacacctttactatttttaaaatttatttatttatcaaaattatttacaataactaatttgttggagggcacttgcagtcacgtcggtggagtgtatatagcatacatctatcaattatcacttatgcccgatatattagagttactcgactataaaaaaaatatattatcatgagtagtttaatgcacatgttatatgatttttcgttttttaccaaaccaatatggaaaaaggtatggattaaggggtcgtattatagcaaaattattgcctagaaataccaatgaaatagttttgaaaaatctgaaacaaaacatttgagaatcttagtctccataaattaaaattaaatcatatataattgacaaaacataatgttgtttcgctttcacacatgtagatttcagttagtgtactatatatttgccaagtgatatttgacaccacaaaatatgatgtgaaattattcaaagattatgatgaaattaattattatatgtcacctaaattatttgaaaattattataatattaattattatatattatctccatgtgttgtaatgtatttagcatcataatataactatgataagtcatcaacatttgaatacaatggattataatttcatcttataaatttaaaaataattaaaaaatgggtgtttaaatatatttatttgatatttatattgatctagtttaacttgcatatttctagagtaataaatttggttttacagtgtagaaaatcctatcttgagaactgtctatattttttttgatggttgtacgaacatatatatatgcattttaatggtatgtacgtatgttactttagttttttttttcaaacatccggtaaacagcttcactcggataaaaaggagattaaaaggaagcgaggtaatgtaatgtaaaggtataaaatgcggggtacattaatttaaatggaaatcgatggtgaaattaaatagtgtcacatggcggtttaagagcgctagtagaagcagcaaatgaccatgtttgtaagagtaataaattttatttttatagtatataagatcctattttaaaaggcctcaatggttatataacgttgtatatatatattttcctttagagctttaatcgtgtgtagatgataaatatccattgttttttctaggcgaacagtatattaatgtttgtttttgcttttacagttttttttatcgtatgtactatgttctttgttttttctcttcgaataaacattacctaaatgtatatctttcttattcaacgtacgtacataaatattttcggtaaacggattatctcgagtatagaaagcatatactttttaaatagatataatttgatggtgtaaaataacgggtccatcgatttaaatgaaaatcgataatgggattgtagaatgccacagtggtctaggagcacaaagacatcgcgggtaaaaagttagttgtatgatttagatattgttgttacttaattttgttaatataaacttttgctttaaaaaggaattggtggaatacggaaggaatcgaaggaagagaaggtacgtaacttatacatatacgtacgtacctatacatatttaacgtacttacgacctagatgcttggtggggctggatcgatttaggaggtggatttttttaaaaagataaatctaatggttgtaatgggtccaccaaatttaaaaaaaaatcaatggttatttgttgagtgccacatggcggtttaggagtatttataggataccacatggcggtttaggagcgtttgtaggaagtttaatggacttttaatatataatataatataagatttccttagagatatgtttgggcaaaatctgccgcaaagacttatggtatcttagagtttgttagaaatgcgagtcgtgtccgacatggacgtattttgtaatctcgggtataaatagaccctgagccccatgtaatcaatctaacacacgttcaatacaatctcggcgcatcgccaccctttttactttcgttctgtttcgacgagttcttacttttgggttgagctgcatcgatttcgatcttcaactagaggtaaaacttgttatggcggcttgcgttctcgggattagtgcttccatctttatgatactctaatcttgtttatgtaattcgagttatcatatatcttatgtaatctctggcaatattgttatctaaccgtcaatcggctaacgtctgttactagaagacagccgattaggttaaataccgacattgacttagattacataggatatctaccactctataaaacatccaacggcttgattgtctagatattgtccttcttttcatacttatagctgcatcagttgagtttgaccttataagtcgtgattagagtctcaatctctagcctgcttttggttgccgattagggtagtatcggggtttcagccgatcttatctgatttaactatatttatcttatatgctcgattgacatgttaaatctgccctttatgttaagatcttgtcgcatttaagtatatttggctttcatttgatatattctacttgctttaatatcttaatatagagtggtatcggagtattagccgatacatgctagatctatttgatcggctatagtatgaacatatatagtctcgttgttagtatatatttcgatctaagtgatttatactgtctcggcatggtgaccaatctatcccaatcacttgatttaagtatatatcgacataaggattatatattgttaatatctacagccgatcgagtagatttagctctttcttacttattcatgaccgccgatcgatctaaatatgacatcggctcaaagataaatgatacaacatcggcaactagccgatcgactatcgtttatggatttaaccgtggtttctctgtctttatttcttgttgattgcaggatcaaatcaactggcacgctcatacatctaaaagcaagctttggacctgcactggagttaagcagatctcccaggcctcgtgtttttacatcaacagatggctggtggtggtaaaaaggaatacgtcagcagtggagacagcaaaaagctagatacatacagcagccggctataagcacaagcttcaatggattaatatatcattttttttaatttggcatgtcgcgtcacagcctgctcccgtcgccatcgcttcgtcctgctcttttctattgtttctttcgccttggatctcgtgtgcagtcggcgactaattagtcgccggctcataccctctctcctatcctggtcatcgataacgtcagcgtggatgcactatcgctagctaaaattttattgtacttgctctaagtagtatggaatatgatataatatatgactacttttaacgatgaatctatactagatagatagctagaattaggtgttggagtaagggaaaaagaacttggaaatgaattaatgatttggtaaagccatttttctatataaaatgagagagttaaaagttggaaaagtgaaattcttttgttaaagcaactttgccatgcaccaaagggcccggtgcttagacttggcggtgaagcaatgtggcgggacacgtgcggtgactgacagttgggcctatggacagttaaattgaaacttgcatcccctgttccacatgtcagctggtacatgagcccgtcacatctggtcgttttgtttggagggacagcgataagaccaccttgtgggatgggccccccacttctgcatgcacgcactatgaacaaaatcgtttacatatgttagcgacatggaccttgatgggttgagctcgctttccatttatgcccctcgcgaagcacggtaggaattgatatgttcatgtttgaaagacccatagattcataggctcgatgtgtttacgtgcgcgagtcacacgcacgcgcaaacctttcacgactctacgcacgtctcgcaaaccacaacaatgtctgtacgcgtaaacctttggtgcgtaggcttggtgtgataggatgtcaaaatcgcttcctcttaatgagtataaatttaattttgaatgagaagaagtgagaaaaactctcccttaatgtatgcatatgggaaatatgagtgaatctcatatgcatatattgagggtctgtttggtacagctccagctccagctccagctccacctctcctagagttagagctcagccaaacagtttcagctccacctaaaatggaagcagagttgagtggagctttttcacaaaatgaactagagatgtggagctgggtttaggcagcttcacaactttactccaaacccaattcctaaagctaaatttaggagttggagctctaccaaataggacctgaagggatagatgagaagagttttgccggaggaatctatccatcggatgtccgatgcctcgaaaaatatctgacggtcaaatgttgcagttgaccaacaagtgaaacgttaagttatatatggtgaaacaaaaaaaatcagcaactgaaacatttatatattttatgaaatatggtgaagatacacgttgaaacatgtcgttgtcacatatgaaacaataaatattaacggattgaaacatgcgtttatcttttaattataacgaatacaacaatgtgatcagatcatagattggataagtaatttaagagaaaaatcattttgaaacttgctaaaatacatatatgtatgcatggatgaggtagagagagtagtaataggtagtttcaggaattttgtgaaacacactgaagacacatattgaaacatatcactatcacgtgtaggatcgagatgtcgactagagggggggtgaataggcgatttaaaattaaatgacacctaatcaaaactaacctaagatggtaggctcggtgagggtcaactctaactaagcaactaagttatgttttgcaaacctagggtgatagtggctcaattatatctctagtaaagtaaattacactcctatatcaatgtttagcaatcctagggtgatatgatctcaagaaagtctctagaaatgtaaattgcacaaatgtaaatgagacaatcaaatgagaaaaaggagaccagaaatttttcaccgaggttcggaaactcgccggtttcctactccccgttgaggcgagcccaactccaccgctcaaccacgaagccaccgcacgcccccttctcaaggggtgagcaaggcgggagccggcccacggagaggactacccaagcctcgatcactcggggtagttctttcttcactccgaaggtggtgaactccaaaccactcacaaaccggcaccgggcctccttcacaatcttctcggagaggtcaccgagcaactccttcacaagccgtctaggaggcggcaatctccaagagtaacaaacaatgacccggcgtggagatgattaatcgagtgccacactagctctacaaatggaaacaatgcacttgactcttggctagaacaacctcaatcactacaatggatgaacactaagctcaaaggtgtgtgagagaggtgcaaggagtgtatacaattgaattgggtgccaagagagtccccttgctgctggagggggagtatttatactcccaccaaccaaaactagccgttgggggcgaaatcccccaactcagtgctctgccagtctgacgggaggtatgtggccggtcagaccgtgctctaaaactagccgttgtagggttgtcattgggccccactgcctcgactggtcagaccgacatggggtggccggtcagaccggcctcggctcggttagaccgccaccagctcggtctgaccgaatacggctccggcggctcgggattggccatcccagagcatgccatcccggccatatgaccggccggtcagaccgggcaacacctgccggttagaccggctatgtggcagcggtcagaccggtagtgaccctgcggtcaggccggctgcataggccggtcagactagccattaggccatggtcagaccggctctggtcaggccacacagtgaatacgtaaattgaaatatggggagtctaaatgcgagcacacgtcttaatgcataatgacctaatgtggcaattaaaatcatctctttgctaggtcattcccctcttaatagtacggcaaagctataaataaactaccataattttgatcgcccaacgcatcgatcaattaaaaatgaaaacactagtttatcgtcttctcttccttttgctttgtgccgtcaattttaattcatcgataatcatccatgcgcacacatgatgtgaacctaacttaaaatatatagctcaaagacaacagttagtccacaattagtgcttgtcatgaattaccaaaattaacaccgggggcctagatgcttcatcacgtatgaaacattttgttataacggtttgaaacacatgtttttcttttgacataatataatcatgtgatatcttattgtaaagatttaattgcaacgaatacaacggtgtgatcggttcatagatcggataaataatttaggagaaaaaatatttaaagagatgaggaaagaatgaaaaaaaaaacggctaggcatgtatgtcactgttacagtgacaggggttcgtccaatccacaggctaccgatttgtagtattttctaagagcatctccaacagcctctccaaatctaactctccaaacactcatatagccaactctccatttgatttggctagtcaaactagttgttcactccaacagcctctctatctaccctttctactttgactctatgacatcaggacccatatgtcagcccctcccttcttctttctccccttccttcccctctttctcttttttctcgcgttggttggaagcaggcggcgccgacaagctgggagtgagcggaggcggtgggtgcggcgtgcggcggacggcggccgcggccgcggcgagcgggggccagcggccgcggcgagcgggtgacggcgggccgcgccacgcggggggacggcggccgcggcgagcaggggcgggcggccacggcgagcggaggccggtggccgcaccgtgggcgcgggacagcggccgcgccgcgcgggggccggcggcggcggcgagcggggcggcggttgtggcgagcgcctcctcctcgtgctccttccttgcggttgtggtgtggggaactagggatggaggagatgggttgtgtggggcccgccattggccagccaaatagagtggccaaatttggctagtggagggagggttttggccagcatccggttggaaaggctgttggagcatgatttttaactagaatgtctaaaatttggcttggagagtgggatggagaggttgttggtgatgctctaagagcatctccaacagcatctccaaatcgaattctccaaacacccatatagccaactttccatctaatttagctagtcaaactagatactcactccaacagactctctattaatcctctccgaaataaaatcggacccacgtgtcagcctcacccccctcttcttcctctctctctctcccccttcctctctctttacttctttttccccttccttcccgtcgaggcggccgacgcatggcgtagcggagaggcggcacgaggaggcggaaggcggcgctgggcggcgggaggcggcgcggggaggctgcaggcgtggggcggcgggaggcggcacggggaggcggaaggcggcgacggtgacaacggtttggggagcagggatggcgatggcggcggcgctgggaggagggaggcggcgcggggaggcggcaggcgcggggcggcgggagtcggcgtggggaggcagaaggcggcgacggcgatgacggcggcgctgggaggagggaggcggcgcagggaggcggcatgcgcggggcagtgggagtcagcgtggggaggcggaaggcggcgacggcgatgacggtggcgctgggaggagggaggcggagggcgcggggcggcgggagtcggcgtaaggaggcggaaggcggcgacgacgacaactgtttagggggcagggatggctatggcgacggtgctgggagg

SEQ ID NO: 46236 - DNA, 5293 bp, Oryza sativa
gacgacgacggcgccccgacgacctcgcgaggagtacagttgctgcgggccggtttggcgaggcgttttggctggccaaatctagccagccagccagcgattttggccaggcttggccatccggttgaccagtctgttggacctcgtttttgtggttgaatggtaaaatttggcttggagaggctagtagagaggccgttgaagatgctctaagaaagtagcgaatagcaaagtaaggagtgagctggtcacaagcgtccgacgtttttttatctaattggacgttccaactggagcattttcggagttttgccctctcgttggtggggtgcagcaatcgtgtgataaagatatgaaaagaagaggcgaatgtcatggcaagcacacaagaaaggatcccaacgggccgcgccgcgctcctctcgctccctcgcctccgcggagctcgattcctaaaccctacctcgccgcgccccgccgccgccgcgggccggggagatcgccctcgccatgccgccgcgcaaggaccccaacgggggcgccttcccctcggagcccgccccgccgcagccggccaaggccaaggggaagaagaaggatgagaacaaggacgacgacctggtgagctagccaccccccgattcgccgtctccttcccccccaactctctctctctctcacggatttctttgcgtggttgcagtcggaggaggaccaggcgctcaaggagcagctcgagctctacgtggtgcgggcgcaggaccccgatcccggcgtccagaagctcgccctcgagagcatgaggtaacgaggaggattttctgatggtgtgtaactgtataattctgatagttcgtgatgacttatgttttagtgtgatctggtttgggtggatgcatttatcacactacttatggtttggatgagagaggagctagccaattgaggatgatcatgtcatctagtagactataagactaattaactcataggtattttggttgcactgcttacttgtcctgtgcaagagttcgttgttctgcaaacttactgtcgtgagaatttaaaatgcgcataaattcggcccaagctattggtttggcggcacattgttggaggcttgtttatccttttgcccttaaatcttgggtacaatactacgtaatcacaattaccatgaggtcatgctttaactgttcaatttctccaatctctactgcatcatggtgagattgttttatctgctcagctggaatctcgcatcctagtggctactgctgctattggtggcatcactttgcattattcaaccagttagtgcatacacagttttcacatttgtcttattgatctcttgttaatggtgatttatgcttaacaggcaggagatccgttctgcgacaagttcaatgacctctgtcccaaagcctctcaaattccttcgcccgcactatggaattctcaaggcttactttgagacaatgccagaatctgagctgaaggtatcaaccaatcttcgatctctaggttgagtcatggttcaaatactacttgatgcttatatggtattcttcaattattttgcagaagtatatggctgatatcttgtcagtattggccctgcaatgtccgctgaaggagaaagagtatgtgaaaatgccattctgatgtcttttccttgtgtcaatttcctagtgtttttttttaatttgcttgtatgctaacttctgagaatgatttacttctgtaaatagtcatacattttttgtgtgtgttttaaatgatagacatatagagtttaactttttctcactgttaactgtacaatatcaatccttcaagaattggctaatatgctttctttttttgtttcaggagagcctcaagtaccgaatgataggctctgaaggtgacattggttcatggggtcatgaatatgtgaggtaacatcaattgccaggcctcctaaattttttagcactcacttttattcacgagacagttacttcttgtgaatcttaatggtaaacatttattcctgagatagtttatgatgaactaccaaacagtaccttcatatcctgtttgacaacttgatgtttttccctgttatgtttgaagttgaatccttaggcttatttagaatttatggtacggtcaaatatttaactgttatcagtgtattaaataatattgaatcgtaactcaggaaattatagataagaagttattcttttcaggttttcaagtgcatgcttatttgattagttgatttaatcattaatcaaaagaaatgattggttagtaatgctgcggatttaggttgtatctggaaataactttggagttttcagtttttctgtttcctttgtttgttattgagaataaggttgttgctgttggaaacttggaatacatatgtttgtctttcgaatctagattggattttctaacaatgtcaatgtctcacttgctagaaacttggctggtgaaattgcacaggaattccagaagcgccaggttggacccttatccatatcatcatatgaattgcataatatttcttcaccccaaagaaagaaatattttaacttttgttttaatccctaacaaaactttaattccattagcaataggtcttaaagccacaagataagatcacccttgtttatattatctaaatgactatattctttagtttaacatccattgtctagtctagctgctgttgattttaataacaagtgtttttaagtgatcttccctcagacctttttgatttttgtaccccacatctatattgtactgattgatgtatacaccattgttatttggcaagaattgagatagcttgattgctttctttttttttggttcagttagaagccccacacatgttttcttctgtcaattatgttatcacatgtgtatggactaagacagtgaaaagtttaggtgtgtggacctcatttttatcatcctaactttgtttttgcactttgcaggatgatggcatgacaactgattccctgaaggaactggtggagcaaattgtttcattccacatgaaggtcaattttgagtagagtccatgggtgtcattttttaaaaaaatttcattgcaaatgtcttgttacacttggtgtaatgcattaaatattagcaaataaactactagtgctcgatcaatggatggactgatactgattatcatttatattgcagcataatgctgaacctgaagctgtggatctcctaatggaggtatgtgaaacttctatttttaaacgtataaaaaaatgttcctttgtttgcattaagagttctcattatttgttcattggttcacaactgatgtgtgatatcaaattacttcataggtcgaaaagcttgatttgctagttaagcacgttgactccacaaactacaaaaggacctgcttgtacctcactagttcttctaagtatgccactgaaattgatctcacttgattaaagcttagtattctctagttttactgaattgaactttcttcactcttttgtgttgggatgcaaacttgcagatatcttcctgctcctgatgacatgtcggcacttaaaatagcttttgagatttacatgaaatttggagattttgcaaatgctttgcgtattgcacttctgcttgatgacaaggtgggtgaatgaatgttatcattcctgtttgctgtccagtacataatgacactgacaaagatttcattgatttgttagtctctggagttgaagcagatttttacagcaactgatgattttcacctgaagaagcaattccgcgtgtatcatagcacgccatgtgagcctcatcccatgcacataaacatgcaacagaagcaaattttctattgtgttcttgtctacaattcagtattattggtagtctgcattgttcacatttcctctttgcttatgtgttcaatggtttctttttttcctctgctgaagggtttaagcaccgacattgatgatgacatagctgcagatgaaaatgagaaggaggcttttcagcacataatttctaatattaaattgagtgaggggtaccttacacttgcacgaaatattgaggtcatggagccaaaatctccagaagacatatataaggttaacttgtttccccgaaatgctgtctgctgattgcatgtatctacttatttatttgtttatgaacttgctattaatgattaaaaaatgcatgctaatttgttaggttcatttgattgatggccgaggggctacaagctccagtcttgattctgcaagacagaatctggcggcaacatttgtcaatgcattcgtgaatgctggatttggccaggttagttatgcgaatttcatcaaaggtttccagggcaagcaaagttctcaatgttcttgttgcgggataaactcatgaccgcaccatcagattcttcgggcagtggttcttctggaaactggttattcaagaacaaggaacatgggaaagctagtgcagccgctagtctggtaatgcaatgcaacagcttggtttatttccttatacatggcatttaggttattaggtgatcatagtgatgataaaacaatctttttcagggaatgattcttctgtgggattctgattcaggacttgcccaacttgataagtacctgcacagtaatgatattcatgttgttgctggggctttgctaggtattggaattgtttcttgtggtgtgaagagtgactgcgatccggtatgtccatattctaaaacttctaatgcgcaagtctctgtacatcttctaaaacttctaatgcgcaagactctgtactgatgttgtgacatcttttccaggcatttgctcttatttctgagtatttcagcagggatgagtcaattatacgaattggagcaatccttggtcttggtattgcttatgctggctcccagaaagaggaggtcaaaatccttgctcttggccttgctatcccactggttaaaaactattaaccatgtgttattttgtgttaacatggtttccaaacatttcaggttagagagaatcttacagcttttctgagtgactcccaagtacctctggaggtcttagtcttcgctgccatctccttaggtttggtgttcgttggttcttgtaatgaagagattgcacagacaatcatatgtgtcttaatggagcatagtgagccagagcttgcagagccaattatacgcttgcttcctgttgcccttggccttctatatcttggaaagcaggtaatttgactg

SEQ ID NO: 46237 - DNA, 4450 bp, Oryza sativa
ccatgatgagtttgataatcttttgatgctattaagcgataatagttaccagttttatgtatgcttatccttgtgcattttgtctattataatcgttgatcttaactgctccggtccacaaacttgtaagatgggtgcagtttagtacaatgagttgtaaaatgctcaaatcagtgcaatgacttgtgtgtgtgtgaaccaagggtgagaatagtccacattttggttaatcaaatcatttgagtgctgactaggatgccataccagcaagcatgtaaatgcgtataaggcatgtgagtgaacagtaacatgccctcccggaacttgcttctttcctgctagaggctaccttctctttgaatattttttacatgacgcatggggcccactcatgcagtgtggcacaaatagtgcaaccagggcaccgagttgtgagatgaaagatttgtgcagtgagggagatcaatcaggataaagaaactggaatttcgttttttctgggtggaggcacgggatgtccgcaatgatgacagctcaaggatgagataacgattatccaaagacaaggcacacaacctcatatgtatggtgactcattctaccatcattatcaggaatgtcaggcaccgctatcaatcttctgcagatttccctagcaagataatttccaaaaggcataggagaactatccctatcttttctggatcacaagattcatgcatgcattcagcagcataacgctccgattcgctaacatggactattttggccttgttcgcacgcaccatgcaagtagttgaactggctcaaatgttttttagttgtgctgaattgcacctaccatgtaggttcatgcatccaaagtacaattttactctttcggtaattgctatattctctggattaagcactgtcagctgtcttgcaaatgtaacatgcaacctacaccgtctgtttttagccatttttctgtttatatactattatactcattcttgagtactgttctcaggaaagtgtggaggcgaccgctgaggtttctaaaacctttgatgagaagataaggaattattgtgacgtgacactgatgtcgctggcatatgctgggacagggaacgtgcttaaggtgattcccaatcaacagaagaattgtgcatggattataggattacaatattttttagtgcctatttgtttttgacgaatctttccgtttgatttgcaggttcaaaaactccttggaatctgttccgagcatcttgagaaaggtgaaacccaccaaggaccagcagttcttggaatctccctaatttccatggctgaagaattaggggcggaaatggctgtacgttcccttgaacgtcttttacagtatggcgagcagaatattagaagggcggttcctctagctctgggcttgctttgcatatccaatccaaaggtatggtacatgatttgttatttttgtagtaacgtcaaatgtttgttatctttgtgccgttgcacacaatcattcaatatatagaattgctgataaagaattattcgataccatgccatgacagttagttttgcactctgctacatcatcaatttcaattcactactcttgagaatgtgctttgtcacacgactactatttgatcctggttattcgaggaaaagtagcatatttctagttaaaattagtagattgtatcatttggctagataaatatctcatatagttttctgatgtctacatttctaccacttgcctgtcaattaggtaaatgttatggacacaatgagcagactgagccatgatgcagatgcggaagtttctatggttagtaacctcactaacaaaacctaccatattaagttctatgagcattgatatttattcaatcaaattggtacatgcaggctgcaataatctccctgggcttgataggggctggtacaaacaatgcccgaatagctgggatgcttcggaacctctcaagttattattacaaagaagcaggacatctgttttgtgtaagttcaaatctaaaataaacattttttatctttgttttgccaattattctgatctcatgctgttgtattcaagtttcatatcagtttttttcatttgactttcaggtgaggattgctcaaggtcttgttcaccttgggaagggtttgctgaccctttcgccatatcactctgaccggttccttctgtccccgtgagtaacttgcaaagttgttgaatctccttcaatcttattggaaccacattttctaagagagtccattcttcacttttcagcatagcacttgctggtcttgtgacggttctgcatgcctgccttgacatgaaatccatcattctggggaagtaccattacatgctttatatccttgccctagctatgcaggtatatatctcgttcaaagatcttggtagtggacatattagctaaaccagtcacatggattctcagttttttctctactgaaacagcctcggatgctattgactgtggatgaggatctcaagcccctctctgttccggtttgtgttggtcaagcagttgacgtcgtcggtcaggcgggtcgacccaagacaattactggattccagacgcattcaacgcctgtattacttgccgcaggggaacgagcagagctggcaactgaaaagtaaactaaaacatctggagaacaattttcaaatttgtcagttgatctttgcttatgcttatgttctttctatatgcagatatcttccactgacaccagttcttgagggttttgtgatcctaagaaataacccagagtatcatgaagattaagggatagatatggcacacgcaaaatgcaggaagggcctggagtattaggaagaggcttggatcaatatctaattgtcacacaaagcaatgaacaaatagcacgatgaagacaatgcatacttgatacggtgaggactgagttgtaacaaagagttcaggtataatggggccaatatgacaggagaactttgtaagaattaggaatagaatctgtgggtgtaatggcatggccgaaaatgtttttgactataccagaatgaaaatgacccaagagtttgttgccacgtccatgtatatgcagccctactactcggttgtctgatgtttcctttttttttttgaattgatcgttttttgtttgggtcatttgttacagtggctcgcactctagcagcagaaacgctgtactttatgtgatgttgtgcactgagtacagatatacagctggggatatcctgatggtaatatgccaccgactgcatgaatattagtttgtccgtatcaaaatatagtaatctagcgctgcatcgagaagctgagaaatttgtgtttgtgttgataggggtaggttgctagagcggcattaattgctgcatcacagaggatataaattcccctggtttctcgtgccgttttcttgggaaaaatttgggctccatctcgtggtggacatcatcgtcgtctccggggaataagttcactttaggtccttcattttgacatccaatttgaattgcatacctaaaccgttaaaccataaaactagatacaatgcattcctccaaaactactgagggagttaaattttacggttgggaggtctaaatattgtggtttagagatatgaatctattggtcactagtaaagggagtcaaataaacttattcttttattacagctttgggctttagttcgcattaatatggcaagtttgggcttgttaaataagttacttttggtgttggcccagtgaattttatgtcttgcagatggcccatttatatgcagaagtttgatttgcatgtacattttagtgtatcaatcctgtccattcgtttattttgatccaatggccgaaaaatcgtgtgagccctaagaaaaaacctcagtttactcgagtatcttcccctccttcccttcggcgcaaaagaacgagaaatctcccgtcccgtggtctcctgacgagccgcggctgaacaggggaggaggcgccgatctccatccggcgagcagagcagagcaggggatcctggtgagcatccacatcctcctcctgattcatctctctctcccaccgggagtacttttgtctggaatttgcttgcgttcgttaaccctagcttctcttctagatctggaagaagctcttcttttaatttcagagccttaacctgtataacagtttgtttgtttgttccccaaaaagtttgggggttcaactgaactgaacgccccatgtcccatgttggatccgcccctgcttttaggatttctcatggttaaatctcgtcggatcgaacgagtctaaggcttggagagtcgttgatagtcctaattattaatttgctagtaatggagtttgggggaacacaaatgcttggggtgagtattttgcgtctatttt

SEQ ID NO: 46238 - DNA, 3932 bp, Oryza sativa
  unsure (1)..(3932): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttagtgtttaccaccataatccgatctcataacttcatttgattagtatcttaaatttcttaaaggaaatcggaggtcgcttatgggtaaacatagccataaaaaatcatttgttggctaatatcttaacttcgtgaaatttccacttaaaactaaacaacgccattaaaatctaagggaaagaatatctctaactcacgagacgttccaaactcccctaggtatgtgacataagcgacaatgacactatttcaatgacgccttacttccatcattatagaataattattctcctcattcttatttaagcttagttcactaatgacgcagccgaatttaaaacatcatcaatgtttgatcatgtccacaaatggatttcttaagtctgcaccctatatgtgacttgtctttccataacaaaaccctcaagtcatgttatgtatatttaattgtgcaagtcacaaattaagagatacaaaattctagcgtccacataatggagctatgagtcataaatgaggtagaataatcttctcttattagagctcttgatgagctcccactgattgtattatttatttaatggaagcataatatcttatttttcataaacttgaatcacttaattttacttagtgaattatcatttaagtaataatagatgtcagaaatttctaagggtgaagtgtctcgaccttaatgagacatatattctcccctagaaatgtggccggaaaataaggccataatttcgacaatgtctcataatgattcaacccaaaaaataatgcccttaatcttcttatttaactactttattgaatcaggacattaagcatgtccctatttcttgcaaagaacttacacaagaaaatttcaagggtagcatacataggacatagaggcaattttatttccccttgcgaggaatatgagctttattatcattaaatttggaattgctacaaccccatagtaaagcttcatctttgccatcaaatgacaagattaataggatcttacttagtttgcctcttagtcttctatatttcttattgatttgcggaatgatgaaccaagtcaattatggtccactttgtcttagtattacaactctgaaaatgaccgtagtctaatgggagaagaatcatatgaaatggagaagtggcgcatatgaaatgtgcgatgtccatctcactaagtttgcacgccatgtgatttatttcttgtgctaccttttaaattatggcggcaaatgtgcatatgcactaaaattgtactaagcattagttttgacaaacttctaaagttcatctcaacgtttgctagatacagtttcgcaatgtcatgctcaaaattctcccctaacactaatagggatgataatctcaatatttatgagtgacatgcgaaacatagcattatattggccttctcccaggctaaagatgcctcttgagtttaggaaaaaattagtgacattagctgcgggagccacaaggaatcctttgttaatgctaagtcatactcaaataggccttaggctcagttaagtcaatgaggaataataataataattccatagactttaactgataaataaaattaagtggcactattattgtggttgcttgtgcaaattacgtacaatagtacattaacttacgcaataataacttaatctttatttcgctttgcatcaccgttgggcagagacaaaacgaaggaatcaataaatgaaattacttataatccaaaatcaagtcaccgttgggcagaaatgattagggaataaacattaatgtcttaagtcacatcaccaaaaggtagaagtgataaagtaaaaaaacccaaatcaaatcaccatacggtagaaatgattaggaaatgacgccattagtgatgccatagaattaaaattaaaatccttagccatatcaccgttggctagaaatggtaaaggaattaagcttactgacagagtagatcctcgatcacatcaccgtaaagtagaagtgataaaaggaattaatgcactaatggcatcaataaaattctaagtcatatcaccattaaggccaaaatgacagagaaaataattagatttcttcccttaattacatcaccgttgggcagaaaataattaaggaaataacaatcttaatgaaatcatctttctttctagataaacttcccgctggttccatttatctagaaataacttactcagtattgcaacagatcttaaatgataagaattgctgatggcatataattagtttaccatggctttaatcaatcatatgcaaaataaacttagaatttcatagtcaaagcaccattggtcataaataattatgaataatcttaaaattaattccttaattatatcaccatttggtagaaaataactaaggaataaaaaattataattgacatgcaattataataacgtgggttaaatatagcttcatatcttaatgcttctagtcgaatttctcgttggttccattcgactataaataattaagtttctaaggaaatgaccatcataatgatgttgacatgaaatcataaatactttctagttaaattttcattcaactagaaataaattaaatggcttaaagaaataataatcttaataaatattgacatgaaattatattaacgttagtcaaatataatatcatatcattaatttctttctagttaaacttcccgtcggttcccgtcggttccatttaactagaaatagttttccgagtgatcaaataattgaccataattttccagcaattttaaatggctaaaataatgccagatgaaattgtgtaattttgaaattaattagggcgtttagtgaattaaattgatttcggcccaattcttccgtagtcggcccaaacttgggccggcccgttttcgcgtgtgtgcgcacgcgctagctgagtgcgccccagccagcggcccaggtggcttccgcggccgaaggcgcgtggcccgtcagtggcgctggcccaacgcggagaggatccgagccgtccgattgatggacggctcagattgttcttgcgccggtaaagtcgccgacggggaggggtaaaccctaatccccattttcatttctcctcttctctctgatctctcccccgatctaatctcccggcgagcgagcgagtggaatcggcggcgatcttggcggtgacggcgttccggcgaggtggagcacgcgtgcgacgacgagcaccgagcggcttccatttgcgccggctggggggagcacgcacgagggcggcggcaagccgtgccgggtgtcggcggtccggcgaggcgggcgcacaagcggcggcgagcaccgatgcggcccggacctcgtcggcgggggggcggagcccgaaggcagccgccaagccgacgcttcccgtccccggcgagggaaagtgaggaggtgaagtggcggcgatgccgcttcccggagaaattccggtgggtttagaggcttcgaaatccggtaaattcccgatcccaaaaccctaatattgagtttaatctggatttaattcgggttttggtcttagggttcttagaaccgaaattagggtttctcgaattttggggattttaggccgatttgctccggcttattggggaaatttcaatcttgtttattcccttttgcctaacagtggggaatttaatctagtttatccccctgttttctccaatttacttctta

SEQ ID NO: 46239 - DNA, 11187 bp, Oryza sativa
cgccttcgtcctccctctcggcatctctcccgtgcagcgagttggtgtgggcacaggagccgcagcggcggctcctcggcgcggtggtggcgcggcagctccactgcacatgcagcggcggcgccgcggctcctcggtgcagtggcggctccttggctaggccgtgcctcctcggcctcgtcgtcgctgcctgctcagtggctccccggcgcagcggctcccccatggctcgggacctccacgacggtgaggtggcgaggaggaagttgggtgaggagcagcagaagcctcccgctcacccctccttcctcctatgtgatgttggattatctcctatcctggaattttttttttagctgatttcgattggattgggttagatttgtgatgatttgggattggtcgtgggatcttcagagcggatgaatcagagggaggaggtgcgcaatgcatggactaagacggatttgtgcggtttttattattcttctcgttcgatttcgcttcctctacgttctatgtttggttagattttgtattcgattgaatttgtgtaatatcgatgtgtggcgcgtgtgggaacggagggctcgattccgattgggattgtgggggtgggggtgggggggaggggattgcgatggacggatgaaaaggcgaacgttcgaggtgacgaacggaaaaatccaaatcttttaattagttaagatttaggttacatgcaagagggttggaaacactttacctttttctagaatataaatagaatagtatatactcctatatcgtatcaatagtaggatattaaaagtttcattattaggctctgttcgtttcctggagttcccaactcccccatctcattttccgcgcgcacgcttttcaaactgctaaacggtgtgttttttgcaaaaagtttatatacgaaagttgcttaaaaaattatattgatccatttttgaaaaaaaaattagcaaataattaattaatcacgtgctaatggactgcttcgttttccgtaccggagggatgggttcccaactcaaccaaaagaacagagccttagtgtttttcacgtattttggtaaaataataggacgccctgtaccaccctatccttcaaatctgtattagcgcactctgcataataattgaggccatatttctcatagtagcttgcttatatgaaagggtacctggaggtaaatctatatagaattttcatgtagtggcggagccaaaaataagatttttgagcccagacaaactttaatataactagtatttgagataaaaatttcaacgtcaatttacttatcaatctaaagttgtgttctcaccaacgagcctgggcggccacccggactagccactgttttcatgtgggataaacactcggacctaacggtttaaaccggaaccggaacataaattaacatgctgaggtattacacgtcccttgaacagatcaaagttatatgtacatgcaccatttaaatacgtactggttttcaaatacatagcttcctaaaatccgtagtcaaaccttaaaatcttgaaacattaatatgcaaaatccattatactgaatggtcttaatagatttatcatgaaaaatgataaggactaaattaaacctgtccattaaagatgtgtccttgcgaaagggcctgtagcctagtggttacaagagcctcagtagcacctgaggtcctgagttcgactcctcctgggagcgaattttccaggatttaacggcgttgtgctttcagtggtaggcgacgtacccgtcgacagcgaggcgcctgtggtgacttcgtcaatctctccaggatttgccggcccagtcttcgaagatgctcgtaagggtagagtttgcgtgcgtagagtttgcgtgcgtgcgttcataggggtgagtgcgtgtgcgttgtgagtgtctgcgttgtactgtgtaattctcaaaaaaaaagatgtgtccttgtctaaaagaccatatctttacctattataaaagtttaaaatgtttttgtctacttttgcacgtcgttccagtccgattccggttttttcatccggctttccagagtctgtcgcgagcacgtacgcatagccgtccgaccgccggccaatctagcatcactagccgatctcctcaatcggagcttcccttcctattccctctcaccaccagctccgccttgctgagaagaacctatttctctacgtttcccctccatctgccgccaccatgaaccacaccggagcctcctctctctcctcgggacagagcttttgccgaccgcgttcccaacttctccctcaatttcactgtttgccgccaccttcccagggtacacagcgagtgggaacacgttttgcctccgacgtcgccgcctcctggctacaggagcgccgccgccctgctcgcctcccctctccctcctctcgcctctctgaaagaagaaagaagaacggagggaggaaggagcagagaacgagagataaaaaaaaatactgacaggtgggtctctggacagtgcattttttctaaatttcatccgtcttttttttcgccgtttttccttcttcttttttttccatttttcttttttttctccgtttgttttttttcctttctttctgttcgcttttttttatccgtctatttttttctttctttctgtctttttttcgccctttttcttttttttcttattttctgtttgtcgtccatctatctttttcgctgttattttatcggtcttttttcacttctttttctgtccacgttttttaaaactttttttcgtcgccttttttccgggttttttcatccgcttttttcttcgaccgaatttaacgggaggatcgattttggcatgtacggacatgagattatcttccggtggttgaagatggcaatcgactatgcgagttggatctatatcacgggggatcgctaactagcgattgattgtcccaggcaatcgtttttttcaccactttttcttttcttcaccatatagtttttttagtttatatatccaaagtttatacatatagggtttacacatcttttataggtcaaaagttgatataccgatttaaatttgaatttgaattcaaatacaattaaagatgaatttgaatctgatatataaacttttgacttataaattttaggtctacaaactttaggggtataaattttagatgtgtaaacttgatttattgaaatttgaatttgaatttaaatacgtttaaagatgaatttgaatctgatatataaacttttgacttataaattttaggtgtacaaactttaggtatataaattttagatgtgtaaacttgatatgtataaagttagtaaaacagaaaagtagagcggtgcaaaaaaaaatatcgcgtggggcaagggaaccgatcgcgccataggagtttcgtatagctccacttgtgagttgggtcaagaggcaggcttgtggattgggtcaagaggcaggccaaataaaacgatgtagcgggctcggctgagattgaaaagtaaggaatgaatgaatttttggttcaaaaccaaagagtaaaatgtacgataataaaaaaaaggatgaaataaacttttggtctaaaaccaaagaataaaatgtacaagtaatccaaaaatattttacccgtgcaacgtatgagcatgttttctagtactacattaatcttcaaaggagtggcacactggcacaatacacggacgattataatttctcagtaaaaaagaggccattccactccagtataatcttcaaatgagtggcacaattcaaacgcacccccatccttcattacggctccatttgctcaagaaacacgcgttcaaggtcaccggccatggcagctcgtacggatacgtcactacaccaccggcgtggtgcttgggctcatcgatcttcatggtggcgagctcgatggagatcacccgccgccgccgccgccgcttgtccacctccgccggcgccaggaggacgcgtcctgctccggcgtcggcgatcaccgcattattaccagcgatgatgaagctctccggcgccgtgtgcgccggtagctggaggcgcttctccatccaccactgctccctgcgacgggcgaagaccgaggggacgccgctcatcaaccaggcaatgcgcacgtcgccgtcggcgccggcgacgacccggaacgccgacgacgtgccgtcgtcgcgccgccgggcgcccttcatcgcctccggaagcgccacccgcgagaacgtgctgtaactgtaagtgtaacaactatgaacaagcatgcggtcgccgtcgtcgtccatccgccagtagaagccgcccgatgcacgccccacgaagtggacggactccgcgccggagatgtgcacgccggtggccctgcccgcgagacgccagcggctccaggggcggtcgcagggccagggccacctctcggagccgaagacgaacgccgtggcggtgccgaggtcggcggacacgccggcgtacccctcttagagggcgacgaacaccttgagagtgggcacgggcatccggctgcagacgtggtggtagtggtcgcggcgcaggaacgcgccgatgcagcggtggtgtttcatctcctccaggcgagggatcagccggtaccgccgcgtcaggggctcgcagacgacgaggtccgggaagcaatggcgcatccagccggacttcctcttggcgaggaggaggaggctgccgctgctgtcgacgagccgccatgaatcgctgtccgggaggaagccgagggagaagtggcggccgtcgacgcggggctggagggagggagaggccgacggaacgaagactgcgccgccgctgccgcgtccggggtagtagtagtggccgacgatggggttgcggccgcggcggtggaactcgaccgcacggcagggggagccgccgccggcgccgatgatgcggcgccaccgcttgcaggtggcggccgcgcggatgaaccagtgcggcgacgcgaggcggacgaggacgcgcgtgaggagagcgtcgtcgaggtcgtccacggtcgtcgcacggcggcgcagcggcctcctcgtggacgccgccgccatctcgcgacgccgcccctgacctcccgcgcgtggtacccggggggttttggtgcgctttgctgtaatttccattcagttacgcactgatcacggagtctttgttacaggattttttttgtggtttttagagagaaactgatcaaatttggatgaacgattcgattacaacgaaatttatttgaacctccgagcaatgaagattgaaggaacaaaatctgatatcgacaattggcatttctttcattgatgcaatggttaaacttagagtaaatttcacaaaactacagatactatgaccaaactatcacaaaactatagatttaaggagtggtatcacaaaactacacatttagcaccaaatttatcacaaaactacatatttaatatgaagtgtcacaaaactacatgtttagtaactaaattataatacaattataggtttagaaccaatttaatcacaaagtaataatgtttagagctccaccataaccatagtgcctagggatttaaactctaaaagttgtagttttgtgataagttcaatattaaatatgcatttttgtgatacttaacctaaaatctgtagttttgtgataaatttgatgctaaatgtgtagttttgtgatacaactccttaaatctgtagttttgtgataatttggttaaaatacctgtagttttgtgaaatttactcttaaacttaagattgcaatgatcagtactatgccttgggtggagaagtgcgttggatatctccatatttgcaggcatcgagttcagccttcgtttgaagtattattcggcatctgatcaacgagtgcgaagacgtcttgtggatcaggcaccaggatgtgatgtcttttcgtcgtttattccttgtcggcgtctggctactagacaggggtgaagccatttatagttaagagggtgtgggcagggcgaaaaagtcataagtaagagtaagcaatgctaacgataaaacaagacatcatgtgttctgccataaaaaaagcttgaatttagctctttagttgtatcatttgatatttgacagtttgagacttgagacaccatgctcgacagcgagacgcaatgggaggacggagagagtgtgaagccaaagcaatgaagacgaggagttgatttacgttgtctctccgtctctttcttattaattaattttctatatcatgtttattgataatggactaaaaaacatgctaatgtgctagttagtacagcagggaggatggtcggataggggggtgttggccccctccagcaccctccgtagctgcgcccctgctcctatagattacttgagagtttgctgccttaggaggtcctcgagaaaatgatgtcgtcagcaccttcctcttagattggttgagagaggtagtcgactgaggattgttctccgtcaacttagtcgatgctatctcgatctcagtggttgttgggtaaggagagatcggcacgactgcgtagatggggaagatgatgatccgacttgcattcatgtaaatgcatgttgccttggatctcccaagcttggacggttgcggatgttctcgtcagaaaatcttgagcttgaagccatcttgtccaaaccttttgcaccaaatcctactacttggcgcactactgtcgatgggttatatcgcaactacgatattcagaagtatcagggaacgatggtgctaaggtctatatgaaactgtatcaagcaaagaaggacaaagatttatattggttcagacccctcgtaagataatagccctaattttgtttacatgcgattatggatgagaattccaaaaaaaaattacaatgggaataaactaactaccctaatccgtcgtctaggatccgccgagaacagcttagcgagatctagtagacaaacacggcttcagcttccttcggtgtatctcaatgtggttggtggctacggcttataattcaatgatcctccctgagcaaggggtccttgtatttatagcatggactgtcttcttctctaagtagaactcggagagtcgcggttgaacacgagacgaaggagaccttatctcatccgagtaggactttgacacattctactcgcgaagataatttccttcctatcaccatatttccttactataatatcaccttgttgatgcgaaaaacacacactggcctggaagatctgcttaacttcagtacaggtccaaaaatcttacctttaggttcgtgagtgtgccaattgatttgatcctgcaatcaacaagaaataaagacagaaaaaaagtggttaaatccataaatgatagccgatcggccagtcgccgatgacatatcatttatctttgagccgatatcatatttgaatcgatcgacagttataaataggcaagaaagaactaaatctattcgatcggttgtagatattaacggtatataatacttctgtcgatatatacttaaatcaagtgattagaatagatcggtcgtcatgccaagatagtatgattcacttagatcgaaatatacattaacaaggagattataagcattcataacatagccaatcggatggattcagcatgtatcggctaatactccgatattactctatattaagatattaaaacaagcaaaaatatcaaaaaagaagcttaatatacctaaatgcaacaagatcttaacataaagggcagatttaacatatcaatcaagcatataggatataaagtagttaaatcaggtaagatcggctgaaaccccgatgaaaccctaatcggcaacaaaaagcaggctagagattgagattctaatcacgacttataaggtcaaactcaactgatgcagctataagtatgaaaagaatgacaatatctagacaatcaagccgttgaatgtttcatagggtggtggataccctatataatctaggtcaatgttaatatttaacctaatcggttgccttccagtaatagatgttagttgattgaggattaaataacaatattgccagagattgtataggatatatgataactcgacgatttacataaacaggattagagtgttataaagatggaagtactaatcccgagaacgcaagccgtcatgacaagtttacctctagttggagatcgaaacgatgcagctcaacccgaaagcaagaactcgtcgagatgaaatgaaagtaaaaagggtggcgatgcgctgagattgtattgaacgtgtgttatttgattacatgggtttgggtcatatttatacccgaaatacaaaatatgtccttgtcggacacgactcttatctctaacaaactcttaagataccataagtctttgcggcagacttttgcccaaacttatctctaaaaaaattacataaaatatcctaattaatatatacaattgccttttcaagacccaatccgtgcgtggcaatccatatgaagcacattaactcaacccgacgacgtgtaccgagtcacattgtcggaatcggctcaatcggctaccttgtctgactcgaactctgctgattctgatcagagctgattcagactttagccgattcttattctctttccggaacaatctatccctgggattccgcttcgattttatcttcatttccgatacttgaattaccaaatttggttgttaacacaccttcgtgtatatctgtaggtatatggcatccatatattaccacgaacccacgtataggagttatgccttatccatatcctgagaaataaaatgatgattcaaatgtaaaagtaaggtaatgtggtatttttgagccaagaaaaacaggaagataattttaacatagattaatcatctaaggactaaaaacaattcaggtgatatgatttaatgagagaagaaaaggtgagagataatttggatcatagattaaatatctaagggataaaaacaattgatgtgacatggcttaatgagagaagagataaataacattaaggaagtgaggataaactctataggtgtataagatactaaaaaaataatggagacatatattaaaatgttatatgacttatgtgggataatgatttaacatgcttttattttaaatctctaaaatttaataaattatagaattattgataatatagcatgctcgtatgttatttaagatgtaataattgttagtggcttatgatgtggcatctttacatgttaagctttagaatttagtaggttgtaaatttataataagatggaattggtacctgagtagagattatgcttgatgatccaatttttcatgaaaaaaataggtgaatagctaatacgccctgaagttccattataggatcagtttagtctctgaggtttcaaatcgtcccaacaagtttctaaaattaattgtttggcttaacatagtctttggacaaacaaaaacaccatataagcatgccacatcatcctcgcatgcaagggcaatgatgaaaatgagcattctacgttggtgttgccctgtgccgcggcaatgcgacttaactggagctatcgtcgtgcaatgttgcgatgacgcggccatcgcttgccagtgcccaaaccctagatggagaaaacaaaccgcgaatgggtaataacgggccgagtttatttctgttgtctcttttttttcatttactttttccattttatttccttttaatatggtatataagggtagaatggtcatttcaaccatatccttgcatgcgaggatgttatggcatgcttatgtggtatttatttttgggtttaaggactatattaagctgaataattaattttgaggtcttgtttagattatttgaaacctcatagactaaggctcagttagtgtcttctatagataaagattaaaagcgagtatgcaaaacgagaaaaccattaacgcataattaattaagttttaattattataaacttgaaaaatgaatttatctgatattttaaagcaacttatatatagaaggttttcgcataaaatgcactgtttagcagtttgaaaagcgtgttaacggaaaacgaggaaaaatatgtatcttacaaagttagaaagggcctaaactgatcttggactgaattgactattaaaaaaataatccctaaaatagattagttctcgttctgttatgcatagaggtgcccttgtaagattcaatgttgcaaaaagcagaacatttctgaaatatccactaaaaaaatctgaaatcgggaattttcaccatatatcgtgtagaaattttgaacatttttttctatatgattaaaatcatatatttttggttaaggaaatggggaagtatgtggagtaactttgataaccacaaattccgtctcctcagtgaggaaaaactaaaaaaaaaagagagacaaagtcgcatgtataaagtcttctttctctgttttaacttgtataggtgaatttaaatatggatgtttactataagtgatgtacctcatcctccttccgttgaaaataatttacaacaggtactattaattttctcacttaaaccactcgttttttatttcaaagctttccaacactaaaaaaggtgttgtacttttaaagtgtaatgtcataaatataagcatatattttttttcaatttagtgtaacaatctaagacgaaatagtggttaaaatagcaaagttaaagctgttagttattttaaaatggagggagtaattatctaccatttctgtttcaaaaactatacaaaatagtacttctccatccacaaaagttacacatatttcatattttgagtttttccaaataagttgtttctatttgtagtctttatgtattcaaacttaagagataaattaagtgttttattagaactcaaatagtcatctaaatactcattggttacatgtatgtattcacttattgattttgtaatatctaaggtgatttaatttttttcttaatcttagtgtcaaaagtaatatatgtaactttcgtggatggagggagtacgtgacatggaaataacgagtgtatttaagggaatcaccttgatact

SEQ ID NO: 46240 - DNA, 2746 bp, Oryza sativa
tatttggtctgatgaacctccagaaatcaaggtgtttgtagttctttcagtgttagaaatgattgtaggtcatatacaaatcgattgaagttgggctctttcagaaaatgaaatggtggttaactgattgtctgagaacaacagttatataatatatttaccagaaccgctaactttcttctcattgtaaacccccgaatattttcttcaacctcaatttgatgtattcagtaattttggaaaaaaaaacacttatagttgttcatcattttgtgggagatttcaggaatgagcaatgtaggcgactactgtcttgttgaaatgctaatgctaaccttatatgatcaaatctttacaggtgactgtgccacaaggctctctttgcaacctgaatctgaaatttaaggcaggattacctccagacgcagtttacaacattataattgatccagagaacaaaagagttttcaaaaacatcaaggtatgtataagcaagttcctgaatagggtaacaggaaacatgaaggctcattcatcatgatattgtggcacttgcttgatttccctgatttggttactgataccaaatgagcagaggaattgctctagtatcttaaccggccaagtactcgtgagaaagttcttgttccaattttcaggaagtaatatcacggaaagtcgtgcttgatgaaggacaaaggcaaatagttgaagtggagcaggcagcaatatggagatttctctggtggtctggtgtcttgtcagttcatgtttttgtcgaccagaacagaacaaatcacactgtaaagacttgaaacattgctactagtctttgagaaacagctaagatacattctctgatatgtggcttcatgcaacaactattggcaggtaaagttcaagcaaggaagaacaggttttatgaagaaatttgaaggttgctggaaaatagagcctctatttgttgacaaggaagcatgccatcctttagacccatgcacattagaaaagtatgattcctgcaccaatggcacaggaagagttggatcttcaattaccttggatcagcttattgaacctgatatggtacccccgcctccgttttcatggtatctgagagggattaccacgaggacaactgagatgctggtcaatgatctgatagcggaaactgctcggctgcgaggtttggcaaataatgctattgacaagcaatatgttgagggaaagtgtgatactagtagagatcatctaacagaagagtgcaatgatattaaggaaagatggcgtcagagaagaaaaacaggacggcatggaaactcccttagattaactgctcaaggataaactaggcattttcgcttctggacaggatgcattttagggccaatttacctgtactccaatggtaggtggttttcattgtagaatttgatgaattgcagggtattcatattgatattttgtagatggctaataacatcatgtgactagtttgtggactgtttcacacgactctttcgtacagtaataatgtaaaatggatgttcagctgtgtacaattgatgaggtgaataattgcccagttaaaatgtctgctactgaacactgctcttccatttctaccatttatctgaagcacagttttttttaacgaaccggccagcgccaatttgttcaaaagaaaaaatatatgtgcatcagactgaagcaaaattgaacttacttgaacctcacgacagttcaaacatgataagtatgcctgacacaacatttttatatgtgacaatatgaaatcacaattttggtacctcttttcacgaaaaaacatatgctaaatcggtgactgaaaactgaagctagatagaacaacagataccatttcctgagcctgaagtcctgaaccaaactgacggcaaactcaagttcagttgacaacacaaaccagttcatcctttctccaaagctgcaagccaagaaaagccccaaattccttacctttcttgacatgctcaaggcaacagcaaacaccttccttgcattgcatgagacttatgaacctaaaactctacatagcttcatggacagttcaaacaccttcgatcactcgatcgagctcgtcgaccccagccatgtccggccagcctccgccgccgccgtcaccggcgatgccgtcgcagccgcagccgtttcgcttctggctcccgtataggagcaatgtggcgtcatcctctcggcagcaaccgcggccatcgtcagggacggcgccggcgccgccgccaccaactccggcagatcgtccgccgagagcgtcaccggcgccggcgcgggcaatgggggaagatatctctgtccatggtgagtcgtccgatgaatcggacacgatccctgtccagagcgtggactcgccgcggtggcgcggagctaggcggcggccgtccgtgccggacatggagctgacgctctcgaggtcgccacgcgccggcgaggaacggaccccgcgcgccggcggcgaaggcggcgaaggcaacgacaccaagatctccatctccgggttcccgaggtcgcgcctgttcgacggcgcgcgcgcgccgtaccggcgggagatcgaggacgggctcaagagccttgccacccgcggccgcgaggcgccggcggcgagcgcggacggcgtccaggggtaccgcgtcatcacgctggccggccacaacgtcggcgcgagcatggttctcggcggcggcggcgg

SEQ ID NO: 46241 - DNA, 3295 bp, Oryza sativa
gtggtggcgacgggaggagcggagaagaaggcgggaaagagaacacgaggtaaaaattgaaatgcgtgcgtaatttacgaaattgaagacagtgtgtgctttgatttgtaatggttttgtgtaaatttgaaatgaattcttctgggacaacgaaatgaaatcgcattaataataagctggtttgagatcagaagagcgagaaattaagctgcattcgttttgtaaaatgctgctatatcaatgattcaacagcaatggttatctcaatgtctgacaggctaacagcactaagatcaaatgatcattgatcaatggtaccttgtctatttcatatcagaaagtgagatacatttctgaataaatataagtatgtatcaacttttgagcgcttctttttcgaacatggagatattctcctattcctgcaacaattaaactgtaaaatatgaaattcatgtgaaaattcatcgaaatttctagatttcaaacaaatgccttagcattcaggtgagagcaggaatatgggagagaacagaaatacagaagatcgagaaaagaatcaaaagaaaatatgcgtggagatatcctccagccgaggcctttcagtcgttcaaaaggcatatcccagaataaatttgttcggaagggacaattgcattttgtgcctccctgaaggccacaaaaacatgctacgcgaagcatcaaggatcttctctacagacttggcctaggctcatgtgtgtgcttttgttaaagagacggagtagcatgccggtattgcacatttgctgatttgcacagttgctgtggttcatgagatgaaaagaaaagataactgaactgctctaacttacctacacatctatatttttaattgaattcggttggtaagaacttccagcttaaaaataatatgaacgcggtcaatctcgattgaaacatgcaagttcacttcctccgcctgatcacccggcgccatcgcccgacctcgccagcgcatgaaaaaggccaagagtgtcagcaaggcccaccataccccccctcctccgccttcttagctgtcctccttaagtcaacaacgctacccccatctcgtcgtcttccttgtcttcggcaactccctctcctcctaaccactctttttactttgccctcaccgctaatacaggtccaccgtttgccgcacatcacgcgtggaggcggatctgtagggtggttcgggtggtccctggatcataaaaaaaatcacaaccaacccctctactatatataatttcagaaaaaaaagaagaaaagaaaccaaaacaaagtgccgctacgtttaggtaattgcggcatcggcacatcgtgttggattggatgccacgtcttccgcgccccgcccgtgattccgcaccgcatcaaccaacaagtcgacccgtcgccgagtccgagactccgatcgccacctctcgccgtcgctgatttgacacgcaaccatgccagagtgggcgaataccatgctcctctctcttctcatgtgaggttgcaactcatgaactcagcaaagaggcggttgatctcttggcaccgatttctatctccgcggtgagcactaggtgcaaggccgaagcagtgctggcagcacctacaagtctccaaatctgcaggtacaagctcccgtgttctctctctctttctctttttcatatctcctttctacaatctgcattgttcttgcctgaaatccatgtgctctgctgtaatatatgcttctactgtgcaatagtaatacaacaccgaccagaactaatgccaaagagatcatagattcaaagttgatctcatgtcgctgctaggtaattcggttctgttttattaacgtgtgtgtactgattcggtgaaacaaccaccgagttgatctactgaaatgtagtgcttgttgatctgctgcagtgcagtgctaattgatctcacccttaaaatgaaattaattggtgtcgaaaaaaagaaattaattgtttatatgtacttctatacattttgtgagtcggaccacctataccctaaattttagatacatcactaatcacgttgcttcgatgacacctccttcttgttccgccgcctaacttccccctcttcctcctcccccaaccccccttcccccctaaccccaacctaagatgctaaccgatcggtttgccaccatcatgccgaaatccccattatctcatcggagctaaagccaaaatccccactattcatcttcctttgatctggtttagttcctaaaattttttttctcaaaaatatcacatcgaatctttggacacatgcatggagcattaaatatagataaaaacaaaaactaaattgcacagttcgcatggaaatcacaagacgaatattttgagcctaattagtccatgattaaccataagtgctacagtaacccacatgtgctaatgacggcttaattaagctcaaaagattcgtctcgcggtttccaagcgagttatgaaattatatttttcattctatccaaaaaccatttccaacatccagtcaaatatgcgatgtaacacacaaaaattttcttttcgcgaattaaatacacatttctttttttttttcaaaaaagaacatgaagaaaaggcacaatgatgacaacagacagtttcccacagaagatccaagacgcctgccactctaaactaggcaaaacacctccgaagtctcagctcagcttctcccctcctcaaccaagcagaaatggcggcttcttgcgcgctcaccctcccctccgccatctccgtctctgtctccgtctcctccaattcacctcgacggttcaggtactaatctctgtgcccctgacctgtactggttcaagtcgatctcctgtgcgtgcgaaggattgatccctggtggtggtgtctgtgttttttggggggcgttcttggatggatgcaggcgctctaggagggtggtggccatggccagcgtggggcagaaggtgtacgcgcccggcgtggcggtctccgagggcaatggcgggctgccaaagatcgacctcaagtccccgcatgggaggtaattctaggtttggttgatttggggtttctttttattttaaggtgaaatatttggggtggataacttgtgtgagattcttggagggattgtggtagtttggtttgtgagtaggaatgttagatgtatggtgccaaaggtggaggaacttggttgtgtttgtttgcttgttttttttttttttttttgtagagatgggataaatatttgcactgcattg

SEQ ID NO: 46242 - DNA, 3103 bp, Oryza sativa
ataagcctttttcatttaactcggcactccacagctatttcagtgtaagtagcagtttcatgaaggaaacaaaatcttatttgtttatcaagcacatcattattaattctcaagtatttggttgtacaggcttcaatttctggtgtttcagtgaaaggtctcaaaggttgtaagaccctaaataaggatcccgatcccaaaaaccctttggaggggaaagaagagaggtcagttttgcattttgatcagtcttttgttatttttgtttatattttgttcttctatactacagtaacatttgaaactcccatggtcccacatttttccaataatatatttctttccctgaattgttcactgcattggtggaaaataagagctatattctgaatttctgattcctcctaggtgtgttcattcttggttttaacgggttgggaaaaaaataacatgacgtcatttatttgttcctagatcacatatgtccaatcttggagggttatgaaaaaaatttaatgagcaaccctagttcttgccttgtcttatcttactggatttgtcacttttctagacggtgggcactgttagcagcttggtgctgttggccattgcattgcttgtctttttatcctaccctgtgttgaacttgggaacaaatgtgcactccttttaattgtgtaatatgttgaacacaacgtaaatattagatatacttctcagccacttcatatgatacagggaagaggtgacttttccaggatttgtcgattgcatttaccttggtgcaccgagtgagctcaccctggacaatggattgggtgacaaaattgtgatatcaaatgcgaagtatgctaaattgatttgttacaagaggaatcgtataaactctgtaaagattgcatcataaaattgtggttaatttttaaatacagttggtcagatgcagtgctgtggaatcctcacttgcagatggaggcttgttacaaagattttgtctgtgttgaaaatgcaaaggtatgacaactaatacaacaaatgcacatgaagtttcgctaacaattatagacaccacaaatgaaaatttaagaaaaacatgttgataattagtatgtagttttctctaatgatatgatcaattgctgatgcagattgaaacattacaactggggccgaaccaatcttgggtggcagagcagaaaattgaactgatatgaattatgaagctaaactgggcaaaacaatagagtacaacaattatgttgcaaaaatgaacttctctttttctttacatcatgaaatgcaaatgtcatagcccctaatgtatcatctagtaggtggcataagtcatatttttgaaattgttttatgtaataaataagtaaataaataaattcagttctcccattatttcatcctctcctttttattaatgagcggcctgctaagttttaagtttcaagctctgtttttcgcatatcttgcagtatgcaattggaggctttgagcttcagatcatcttttttttttccataagatgactgttgaagtgcactggaattagcattttgttcatgttttgtcgtagggaagtgttgcaatcagcttattcttctctgttccagttttcctggatgtccatctttaagtccgtgaaatcttttataagttcattacaaacactcttgcatgcagtgtggttttaaagtgaatcacagctcataagatccttaggttcatagattcagccagtgcaaaattgttttctgcactctcataatcatatatcaagactccaaatgaaaattaataatgatatccagcccatttggaaataaaactagttgtgtttctgttaatttcctttctgaatgctggttcatattcttcatacgattcattaccaggagatacttactgcaagcatggacatgctatcatacaatatttattcagcaaaatgtatgttacacttacatcccagctctcaaacagccaaaagtgagagcaacgagcgataaaaaggggaaaaaaaagtaatttacaaaggcaaagtgaagcaagattacaattcaggggattcagtagctaagccgtaagctagtttcgctgagtcaagtgtattcgcaagaagcatcgcaatggtcaccggtcccacaccaccaggaactggagttatagcagaggccaacttcacagcttcttcgaagcagacatctccagttaatcgatagccgtaatcactggttggatcctatgaaagagtatcatgagtactaaatgggcagaaataagtagtgtaaaaaaaaaggggaaagtgcattgatgcacaaatccagaactgcactcatgaaaaaagttcagtaggaggcatggttagctgtctatatcaattcacattcaggacatatcataggtagagacaaattcatacatagaataccaactaaaccggaagggttcaacaagatgctattaaaaatggatgtgctaaataataacaccaataatgcagtaagccagtaatgttgtaaatcaagcatttctgttctcggcccgaactactataaacaacatttcctttacctcaattgggtttgttccaacatcgatcacaactgcacctttcttcaaccagcttcctcttacaagattggccactccagcagctgagatcacaatatcagattgacgggtaatctcttctggatttgttgtgaaagcatggataatactaacagtggcatggtgtctctgggagaaaaaaaatcaaaaatactattagtttgtcacaatactggccttgtaataatgaagaataatcaaggtaatagcttggctttacctgtaaaagtaaagaagtgggcaacccaacaactttgcttctcccaatcacagtgacatgtttccccatgagttcaatcccagactggagcaataactcaaggcaagcctttgcagcacagggcacaaataaaggcttccggcttctgagggcaagattaccaacattcaatggatggaaaccatcaacatccttctctaggctaatagcgctcagaatcctttcttcatccatatgctgatttagccaaaaactagcatg

SEQ ID NO: 46243 - DNA, 3349 bp, Oryza sativa
tactaaaatgaaaacaaaataaaggatagctgaagttggctgtctattacaatgacaacaaaagtagttgcattagtcatcgaacaaaacaatcatctaattggtgcaaatgaaaggttttcataatataaatctacaaacttaatccaacttcctgcagctgcaacactagaacactagacagtaattacctgtggtagaggtagttgcacaagaatgccatgaacagatggatcttcattgaatcttgacacagaatccaccactacgtcttccgtacagttcccaggcaactccgccaacaaggactttattccaacctcctcacagcccttaattttgtatcgcacgtatgactcagagtcccttctatcgccgaccaatacaacagctaggccaggcacatgccccactgcatttttcatttgacgaacttcttcagcgatctgaaaccttatgtcttccgcgacagacttgccatcaataatggtcgcagtggagtcataatcaactacaacaaagacaaaagcacaagtacagaacatcaaatcattaacataagaagctaaacgacaataacataaggctccctgtatgaccaatcaatagtgaagaactgaagcttcacagtcttttcatggaaatggaagcgtccacaagcatgaagggtatcaacctagaaatttccctacaacctttgcaccaactaaaccaaagattattgcagccgccaaataaaactactctatactctacagcatggtttcaggctttcagcttggcacaagtaaatctataatttttttccccactgcacctttccatttttcagccttacactagcattcattccatttgaattaacattctgttctaccaatagctccattctcggatgtcatcattcattagcaacaacagcaagtctttcgacactaaactgctacaggatctggaggtgggttcagcaccactaagctgctaatctccaagtgggttctgcaccaatcaagcgagaaccactgaatttaagtatccgcagcacgctctcaaaacccatgtactaaaccccaaaaccatccgaatacttcgaatggcatctcccggcgaaaccactggtcgacgaagcgcacgcctagcaaaagcttcacatcagcaagcccgccggttacctccggcgccgctcgggggagacggccgcgccgcggcgcgcgggggcgagtcccaggtgtcggggatgtccggcccgagaaggcggctgctgctgctcctcctcctccgcctcctccgggtcctccccttctcctcctccggcgccggagcagcagcctcgtggagccccgcgcgggccgcgcgagggaggaggaacgccagcgggcccgcagcggggcgccggcgagtggccgcgagcagggccacggcggcggcggcggcggcgccgcccatctccgtcgaagcggcggcgagcgcaacgtgtgtgaactcggaagcgatgtggatgtgtggatggaggatttgggccttttgggccctcgacaaaaagagatatttttgtcatgattgttttcccttttcttttctttttgaaactttttttgtcacatttttgggccacaggtttgagtttttgatgcattttttctgaaaaaaaaaagatctaaagtagcaggaagatactgtgcttgtggaagatgctgtttctgatgtcattgtcggggtatattctgatgaaatctttgcctgatacttcacaacaatccatcgaaatcgttgtcgatgtatttattttgaatgaaaaatccttgctaagaaaatagagaacactggattgaattgtaaatttaaaattatgttttcttaaaaggttttgaaattaaattaactcgaaaaccaccatatactttatgctcggaccaaaagaaaaaccaaggggtaatatgtttggtgaatgtccaccatgtcaaccatgagtcatcttttgcgtttcaacttactagtcacaatcaaaattcaaaattttacagttagttgattttaatgtttctttattttaatttaatttctaaaacacaaatataaaaagttttatgcacatttttttcccgccaataagcataacggcttatgggcaaaacgatggaactgaagtcatgtacaacactaatgtgaccagttgaggtattttgttgtaaatcatgattcattgatttgaagtaatttattttagcactttattttgatgttgttttctgtatggaaaatgagataattcaacatctttttatggattgtcattatgcaaagtttatatggagagcagttcagttatcttttataccttcctattagcatatctcatattttttatgggcggctgttggggtgaacaataaaaagagtaaacttatattagtgggagcttatgcaatatgttgggctttgtggttgagtaggaatgatatggtttctgacaaatcatcatctattttatatatgcagataattttcagggcaacatatttgctctggttttgggcacaactacaaaggtgtgatgaactcgaagagttcttaaaagttgcacgtcgtaagcttgagacaacggttatgcaacttttgccaattatagatggagattcacaaatagacttcaataatgtgttctccttatcttatattggttaatttttatatttgtgtggtgtttttttttcttatttgaactaaactcattttagagtgttagattgtaacaataaactgtaactctcctgagcagaggccaggacgttatattccattattaaaaaaaaatagatctcaccctctttagaatttattataaccccgtcacgattggatagaaattaagtaatccggctagggctgagaatactcgttagtacaaacagatctcaaagatggtctgaattttagtgagtactctacatgatacattcaaagtcgctcgtaagaataaggtgcgcgcgtgttacgagagtttctttttctcgcctgtctttggaaaaaaaaagttcacccgtatatattctttccgacctgggccctgcaaaattccttcgaagcccacacaacaaaatacgacaacagtcgggccactccgcgagttgggcctagcagcccaacctcttctccgccccactgccggtcgccgcctctcgccgtctcgcgtcgcgcgagctctgcctctgctccggcctccacgccccatcgccgccgccgccgccgccagcctcgttttgcgccaccgccatcaagaatcggtgacacagatgctgtttcctacggagtttgaactttgaaggcgccagccaaccatgctcccttc

SEQ ID NO: 46244 - DNA, 3183 bp, Oryza sativa
gccgccggggacgcctcctcctcttcctcctcggggaggctcgaaccggaggtgatccggagcaacaaggccatcacggcgcacatgcgcgccggccgcgtcgccgacgccgagcgcctcttcgccgcgatgccccggcgctccacctccacctacaacgccatgctcgccgggtactccgccaacggccgcctcccgctggcggcgtccctcttccgcgccatcccgcggccggacaactactcctacaacaccctcctccacgcgctggcggtctcctcgtccctcgccgacgcgcgcggcctgttcgacgaaatgcccgtgagggattcggtcacctacaacgtcatgatctcgtcccatgccaaccacggacttgtgtcgctcgcgcggcactactttgatcttgcccccgagaaggacgccgtctcatggaatgggatgcttgcggcgtatgtcaggaatggacgggttgaggaagcgaggggtttgtttaattcgaggacagagtgggatgtgatctcttggaacgcactgatgtcggggtatgtgcagtggggtaagatgtcagaggcaagggagctatttgataggatgcctgggagggatgtcgtatcctggaatattatggtctcgggttatgcaagaagaggggatatggtggaggcaagaaggttgtttgatgcagctccagtgagggatgtattcacatggacagcagtcgtgtctgggtatgcacaaaatggaatgttggaggaggccaggagggtgtttgatgccatgccagagaggaatgcggtgtcttggaatgcaatggtggcagcctacattcagcggaggatgatggatgaagcaaaggaactgttcaatatgatgccctgcaggaatgtggcatcatggaacacaatgttgacagggtatgctcaggcagggatgttggaggaggcaaaggcagtttttgacacgatgccacaaaaagatgcagtctcctgggctgcaatgctggctgcatattctcagggtggttgcagtgaggaaaccctgcagttgttcattgaaatggggaggtgtggtgaatgggtgaatagatcagcattcgcttgtgtgttgagcacatgtgctgacattgctgcacttgaatgtggaatgcagcttcatgggagattgattagggctggttatggggtgggatgttttgttgggaatgcactcctagctatgtactttaaatgtgggaacatggaggatgctcggaatgcattcgaggaaatggaagagagggatgtagtttcatggaatactatgattgctggttacgcacgacatggttttggaaaggaagcacttgaaatttttgacatgatgaggacaacatccaccaagccagatgatattactctggtaagaatttgtttcttggaacataccacatacaattagtgctagcacaccaatttgccgataactaaattcagtttatctcctataaatggttgattaaatctgtagaaagttcacccactttcgataaaatatttattataaatgctaacagtgagaactgtcccagtttagtaaaaagcaatagtaaaaagaactccctggttttttaaaggtaatggagatttcattaagcaaatgaaagcatctagcttctgcacaaaagtgtactcagccagcctgttttcttttttagtagtaataaacaagaagatttgttcccttattctatactcatggttttggggtaactttaactttcaggtcggagtgcttgcagcatgtagtcattctggcttagttgagaaaggcatttcatacttctactcaatgcaccacgattttggtgtgacggcaaaacctgagcactatacgtgtatgatagacctccttgggcgcgctggacgattggctgaagcacatgatcttatgaaggacatgccatttgagccagattctaccatgtggggtgcattgctcggtgcaagtcggatccaccgcaatcctgaacttggcaggagtgcagctgagaaaatatttgagttggagcctgaaaatgctggcatgtatgtcttgctttcaaatatatatgcatcttctgggaaatggcgagatgcgaggaaaatgagagttatgatggaagagcggggtgtgaagaaggtgcctggattcagttggattgaagtacagaataaagtccacactttctcagctggtgattgtgtgcatcctgagaaagaaaagatatatgctttcttagaagaccttgacatgagaatgaagaaagctggctatgtatcagctacagatatggttttgcatgatgtggaggaggaagagaaggagcacatgctcaagtaccacagcgaaaagcttgctgttgcttatggaattttaaatattcctcctgggaggcctatccgagttataaaaaacctcagggtatgtggagactgtcacaatgctttcaagtatatctccgcaattgagggcaggctgatcctattgcgtgattctaaccgatttcaccactttagaggagggtcttgttcctgtggggattactggtgatggctaattagatttcttgtgcaatgaatccctgaagaatctgtagttgacaacgcaacaaagatggtgcaatgcaggctacaaacaaaatattataggcatcttgatgactcactcggtccacaggccttctactaggccaccatttcaaaaagattacatgagttggtgattgtttccatgctgagtgaagaggtgatacctagacaaaagcataatatacaagatcataattccagtgtcaagtgatagactgatggtaactcaggtgaacagtctcaaaggacaagtttgctgaggcaggtttagattggaagaagtttggacaacaaggtgttaatcctcccctgttagtgacatcttaaggtaccaattcaactgagatatactgaaaatcaaggggtcatagttgtttttaggccatcaacaaattatctttgtttctatgtgaccaggtatgctattaaaatcaaggatggtgtaaatatcagtgcaagtattctctgttgaactcaaatattggtgttacaatggatatttgttattccatttctgcgaaaataagcatgccagaaaatggagcgcctgacggtcttacacgagcagttgggg

SEQ ID NO: 46245 - DNA, 5183 bp, Oryza sativa
ccaatgactttgggttgacgcccgtgcgaaaaccgtctaataccaatcggttttcataaaccaagacctagcggtttcacgaaagtcgatcggttctcgctaaattccatcggttgggtgcataaaaaaaaaacagaaggcgaaacagccatcagcagggaaacctgattaactgacagctccaccccgttttgctattccaggggggccctctgcaacaacacaaggtttgcctccacctctcttgcatttcctattctctcaaatactaggacgcgcaccccgcgcgccattccgcttccccctcccctcctctcgctctcgcttgcggccgcgcgcgcgggcccccggtggtgcgagcagtcgtcgtcgtcgtcgtcatcgtcttcgtccggggccaggtggtcggggggcgaggcgatggcgtacagggcggaggacgactacgactacctgttcaaggtggtgctcatcggcgactccggggtcggcaaatccaacctcctctcccgcttcacccgcaacgagttcagcctcgagtccaagtccaccatcggcgtcgagttcgccaccaggagcatccgcgtcgacgacaaggtcgtcaaggcccagatctgggacaccgccggccaggagaggtgaggtcccttctctctctctcttttcttgctcgcgttctcttgttgtgccgcacgccctctgttctgatcggttcatcatccagcattgcttggttcggcactgcggccaattaggttgatcacgcttcgtttcttcaggaaattcaatgtttttctgtaggattcagtctgcgcgatttgtgcgtatagtttaggaaatgcgcaggttgtttctggtgcgctctcttctgtgtggttcaggattagtaggcacagcatattggtttaagattgatatttctttgttttttttttttgccccatgcattggatatgtggatagtttacatcacgtcgtgtacagtcagcaaaactatagcctttcttaattatgctctctctcatgcgtcattatttttgtttttcatgtaaaatcctttatttacctatctttgaatgtgagccagtggggcatgctatcttcctgtgaaggaaacgttgctctatgacttatgttctgagagagattctagtttattttctagcatcgctatcgtgcagttttattctacacctgcattggtgatgtcctgttgttgccatgtactatttggcatttgataattcgtatggacatttacatgatttcaatccaactgtctcctcacattatttagaaaattgttctgctgcaacatctgtttgtcttatggctctaaataaaaccttttctggcagttgaccatccatccttcaaatagtaaataccatgagtggtcgtccaataactatagaatcactaggaatattctttttttatttacagctctatgctgatgtttacagtattactcttgtgccatttacaatcaaattgctgtccctagtgtctcaaagaacttcatgcatttgatatggagtattaggcatatcctttgggatcaatttctttggaatctgctccatgtatttgatgacatttcagtcatgttgatagtttcagtgctcggtatggactttgaagttccttctgtactctctcaacaggtatcgggcgattacaagtgcatactatcgaggggcagttggcgcacttgtcgtgtacgacgtgacacgccatgtcacctttgagaatgtagagaggtggttgaaggagctccgggatcacacagatgcaaacatcgtcatcatgcttgttggcaacaaggctgatctgcgtcaccttagggccgtatcggttgaggacgccaagggcttcgccgagagggaaagcaccttcttcatggaaacgtccgcgttggagtccatgaatgtagaaagtgccttcactgaggtgctaactcagatctatcgcgtggtcagcaagaaggccctcgacatcggcgatgaccctgctgctccaccaagaggacagaccatcaatgttggtggcaaagatgatgtttctgctgtgaaaaagtctggatgctgttcatcctaaatccattatgtccatgagaaggaaccatatgctcacctgattatatcatgagtaattaaaaggataactttcttttgctgcctaacctggttgcctgtgagattttagtgttacatcaagaaggttggggctgttaaacccaggttgggaaaaagctaactttgaagtgtcagtggttttatggtttgcatttgtggtttcttcattggtgtactattgttccatgtaaattgacaggatttgagatcctccccacctttcactgcataacatatcccagtaaaatgttgttgtaattggatatcagactgtagctgattggcagcaagagttctaattagaagggctattatattctgtaactcctactcacaaatgtacaaaagtttgcatccttgaacttcttaccagcctgtatattacggtactgaaagattgtttaagataatttcttctatttcagtagatgtgcgtaaaggcgtaaactatagcatttatcattttctgcatatctctgttttgcaatattactacagattgtgactgacctacaagatgtttcctttcattttatcagtattaatagagtgaaatgatcagctttgaatgtctgttgtgtaggagtactacattctggcagatatgaacaggttgcactggttaaatgacctttcgagagggcagaagaagagggtatcaaggtctagttgcagtggttaaatgacctttcatgagcagtggttgcaaggtagccttaatacaattcaaaggacagcaacattggttaaagcaagttcaatttagtggaatatggttggtccggtgattgcccatgttctgtagttacattgccaagtgtaaggtaggatgcaatgcaatggttatggcatgacaaacctaactgcattgctttagcaaaaatgatgaattcctgatggccatgcctggcgccatgatcctgttaaagaagtaacctatctccattttgtgaataccgttgcattttttttgaccgatttaagcagcactgatctgacatcatgttatcagccaatttctgaagccatacatttttctgtagcaaaatttgcattttttagaagcacagatcttgagttctttgacattaaggacttgttcacattgttaccactttcaaccatagtaaattttggtattatcaaattttagtactgctaccttgccaatgctaacaaaccaaacaaatccttgccaatgctaccttaccaaactttggtaattataaaagttcccactcttaaaaattctatcaaattttgataagcattcaaactaaacacaatcaacgataccaaaatttggtagcagtaatgccaaaatgtgctaccaaattttaagcaaagccagtgagaattcggtgcttccgaagaaaatgcaatttaattcttccatggtcattcagctccacgcaattctcagctacaacgaaaatcaccaaacaaaaaagaaaaatctccacacgattttcagctaaaacgaaaatcacaaaaaaaaaattgtaagatgagtcatggaaactatttctcactatcagcaaagaaatgtagccgtggagaacgccaccgtgttgccattgcctgctctgcctccccttgccacggctgatctcgcggcggccaccggcgccgtcgccggcgacgcgtccgtgctcctcgccgtgaaccggtggtggtgcagcggcatggagttggcgtcgaggcggtggagcgcggcgacggtgagcacggagcaggcgagcatcgggacggggccgaacacccacatgagcagcgccgtggcgaggtagagcgcgcggagccccgccgcccagaagttgccgccgcggaccacggcgcgctgcgcgtcgcccaccggcggcgccgcgtcgccggcgagcgcgctcatgaggaagctcgcgtgcacgaagtaccgcgccgactggatgaagcaggtgaaggaggcgaggaagcaggcgaggagcgcgacgcacttcaccgtcgccgtcgcgtggctgccgtcgccgtagccgaggacgacgacgcccgcggcgcccggcgccggcgagctgctcacccacgcgccgatcagcgagcccagcgcgatgcacagcgacgccagcgtcgtcgccgccgagatgttgtccgagatcacgcccagcgccagcgccgactcctccggcgccgccgcctgcaagaaaccactagaatctttcgtcaccattgatcagttcttgaacaacaaattgaattgatcgaacaagatgatgaacctgcagcatgcgctccacccaggcgagcttgttgtgattctcgtagccgatcacggtggtgtgcgggtggcggagaatccggtggaggagcatgaggtggtagccgaccatgatcgccagcccgcatgggacgagcaccaaatccatggagctcttgtcaacaagcatcatgaactgactacctcaatttctgtctctcaatttctcaacctatatatcaattaacctctacctagctagcttagctctatagctaatttttagttgctgaatcttgctgttcttctcttctactcttatcttgattcgatcttgctccctttctctggcatgattgcaacacgatggacagaatgtgtacaaactgtacttgccattgcttagattgttaggtcaattaatttgtgttaacttggtaatgggcactctcgttttcattctgtccgtgatacttgatagtagttgcttgtgggtctcagcagaaaaaaactattgttgtggctttggatgcaagagaaaatgacaagatgaaaatttcatcctatgcaatgtttgcaccatctcaaaaggaggaggaaaaaaacaaaaactgtactttgcagttaggagagagtggcttttgcttgcacttaaaagcaacatgggattacaagaaagaataatttcttaatggacttcctcaagctaagccagctgcatgaatccaaatttggtactttttttcgtattttattttttttctcgtgcatgtgctgcaatactttggctctaaaattagggggaaatctcacaa

SEQ ID NO: 46246 - DNA, 2234 bp, Oryza sativa
cagtatcactattgagatcataatacatactgatcagtgtgtgaatttcagtttaagtatgtagattagtacacgtcgaacacagcgtgacgctcagtatcagcagaaagattagtagctggacaaacacatgtaattagaccagaagcttattaagacctttccatactgaagcaacaaaaccatcaaaacaccagcacatcctgcatccagccgctaagaacacagcgcaagatatattaacacagataatatcaagcaagtaacagatgcagccagtaatctcacaagagccaacatgagactccgatattaaccattgacacgtgaaacacattaaggtttgataaataaaaagatctccagctggagtgtgacaccacatagtctctgaggactgtctgggactctgggtttatttattgaccaacattacagataagaaagcgcacagcacaaacaaactcgaagcactcatgacgcgaactggaaatactcatgacgaacgaaatactgaaaagacgataaggcgaagtaggcgatgattgggaggagattcggcgcatcactcttcctcagattcagaatccgcgctctggagccactccacgaacggcttggcattcttcaccacctgggactccttgccaccagcaacagattcattataccactgagttatcacttcttcatccaggacgtccccatcatacagggccttgagaacaatcggcacctccttcacagcttcggggcttgacttggcgccgaaggccaccagcgcttgcagcaggaccatctgggaggcttcatcaggcacagcagcagcgaggaatttcttcttcttcacaacctccttggcgaatcctttgccgaggccgccaaagagtgcatcaaaaagagcattcatagcatcctggggtggcagcgctgaggaagtcatcagacccttgagctgaacagcattggcacccttgctcaagttatccttcatctccttgaccagatcatcataaggactgcttttagcctcttcaaccacatgttttgtacttccgttggaggcaccctccttgtgtgaggcctcatgcttcttcttcttctcaggttcttcagtggacagcattaccatctcagcagttgcagcgctcagttgttcctgcatgcgctgttttgcagcctccaacgaagtgtcagtctgccactggacatcatcatcatcatcctcatctgcagccacattgtcaccatcatggctgcgagttggtgaatttgaatgatcctcatcagagccagcagcagccttcttcttcccagcaccacttttagaggaggtactttccttggatgcacctttcttctttgcttccttctttagcttcttcatctcctcatcagcagcctcaccttcctttagacgctccttctcagctctcctcattgccttcttgtctttcccagcacccttcttctgttcaggtggattcttcaggataaaagttgtgagcttgtccctcatgtcaacatctgacacaaaaccacaggcagcacacttcagtgtaatcatctgggtcttggagattaggacctcagtctcagggttgccacatccatagcattggacatacttcttgatgaagttctcaaggagaccagccagcttagcagtatcatgtgccccattaaccaaggaaataccagtcttctcatcaaatttagactgtgcaccaagctcacatccaaagtactttgttgtgtaggaagcaggcctggctagggcttttgctatatccaccatgttcacaatgttagtcttgatgccattgccacggccttctattttggtgatcatcctgggcatcttatacctgtagaaggcatcatcacggtttgaagcaccaatgttttgcagagccatcttggattaattttctttcgctgagataatatcagaagcaccaagagccaaaaggaacagtagtcttgtatccttgaaatgaatcagcagaaaccagtgcgcagcagggccttccaagcgagagcttgtgcctttttctcgttgtccgagaatattctccaagcaatccaactgatcccaagtaaagcaagtcttgttcagacataaaagaagcttcaacttttagaccctccactttgtcagattgcagcgaaactgatgttgcctcctgcatcacacgtcaacatcagattcttcattcaggggctgcaggaat

SEQ ID NO: 46247 - DNA, 2236 bp, Oryza sativa
ataattcaaatgcaagtaaaatatacaatatacaacatatctgatgcatatatgataccaaagttcaaacaaatactataaatcacttaatcacataaatattcactccatcgacaaagtaaacaatctatctatttttattttacttgcatgatcctgtataaaatattgggatagtgaacattacgatgccagcaaaagttgaaaaccacaaagcatactgaaagctctaatatatcagacacactgaacaaacagtccgtaccattatacaactgaagcacgtattacacatttgtcgcattcagcatatactggattaatgtgacatctagctcaactgcttactactgtaatatcaaacctttcaccactgagaaactctatggacctaacaaatagcataaccgtatccatcaaaagtgtaaccatagctaaatagacaaggagactatcactcaggaaaaatagaaaacagaagctcgtaagtgcgacataactatgagtaaagaagtaaccatgcataagcaaataaaactgggattttgctggccaacatcaaaagtgcacacttggcatagtaaacaatgccataaataaactcagcctagcagattgatgacatcatggaataaatgaatacaaaaggaaggatagcaaataaggaacacgatagcaattggcaaaaacaatttcagatggcaaaccattgcagtagtaactgggaaatggttgtattagcacgatgaaacgcaatgtaccagtacaactactacaagattcatttacacaatgatagatcactctctaaatactggactggctaattcagcatactatgaaatataggagacacaagtcttttgcagagttctacattcgatgaacagtcataagtttcataacaatcacaacaataattaatgatagtaaaatctaaccaatagatggtaaccaatgcaatcgcaacatgtttaacacatcctagcagcatgaagtacaacagtattaactgaaaaaactacacgaggcacaacaatccaagttggatgaactgcaacagcctgagcctgagtatatgaatcatccacccaacatcacatgaccgagctgacacacagataatagacgcaaaatacacacacaagcatttgtgttcccccaaactcccattactagcaaattaaaaatcagtactatcaaatgactttccaagccttagaatcgttcgatccgacgagatttgaccatgagaattcctaaaagcaagggcggatccaacttgggacatgggggaacgaacaaacaaactgctatacaggttaaggctctgaaattaagagaagagcttcttccagatctagggttaacgaacgcaagcaaattccagacaaaagttaagtcccggtgggagggggagagatggatcaggaggaggatgtgggtgctcaccaggatcccctaccctgctctgctcgccggatggagatcggcgcgcccctcccctgctcagccgcggctcgtcttgggcgcaaggagcggaggagacgacgagatggggaagatttctctctttctttcacgccgagggaatgtaggaaggggaagacactcgactgctccactttttatctttcgacggattttcttcctagggtttcacatcatccagccgtaggatcaaaacgaacgaatggacgggatttaatgggccatccacaagacataaaattcactgggccaacaccaggtccacttttgctcccttaactagtgggtccgattcgtatccatgaaccacattaccacatatctcgaccccgaactattgaaatcggtgtaatttgatttcctcggtagttttggtgagtgttttggctagcatggagattgcatggtggtgttgacttgttttttttgtcccacgtggcgttgatgtggtgtttaggtggtattagaattaaaaaaatatatatgggatccatttttcattcacacaaagaaaaattgtaggacccactgattatgtggggtccacatgttatcccctcttcttcctcttcttcctcttctctctctttctctttctcttcgtatacttattgataggctattatttcattttcaattgcaggagacagggatttgctctactaattgagttcatatgatatttcaggaactacggtattacaaggatcttattcttatggtggacaaatggggctgcaggaat

SEQ ID NO: 46248 - DNA, 1221 bp, Oryza sativa
tcaggtaatacatgcaattacttgaatataaaaaagataaaagaatacagtactaacgtattttatatcattttctcttgtagaattttatgattttgacaacaagtagattttccctagaagcaacaactcaacatatgcaatcagcagaactcaacattttccctagatgatcaattattattccactggaaaaaaatatcatttatattcaaaatgacatgagctgaataaattagtgtcatgtataaactcatcaatcgtgcttactcacactgccgcaagcaatcctggccgttgattacaatccaacgacacaggctaataggcctacgcgcacgttcgctcgtgtctaggccatcgcgctcgcccgtggcctactcgactgcctgcacgcgttacgggccacacgtgcctccgtgcgcgatgaagggcgtcctcgcttaacgagccgcgccgaccaagcctcgtgaattatcatactggcgtacactgttttgggccaccgccaggtttcgggccttattcatttccctttattgccaaaaataccatttattatttacagaattaatttttaatcactttgagctattattttaagataaaattgcagtaacttttgtatttgcgagatatgtacaaattcgagattttgtgaacatgtgttataacttataagtacacatgcaatcttaaccatctgtatttgttttatattcaccggttacaacgcataggcatatttgctagttatctaaaagttaaacaagtccatgatgagttaataacagatggcagtgatatcattgatcaatgttaaagctaattgagcatggccatatactacaaaacattcctcaaaataaactacataatataagagggtggataaaaatacatctctgggaatcatgtatacaattggcaaagataatactcaattaaggccggacataaggcatgaccatagtaggtaatatttccattaaaaacggcacctgaaggctgaaaatctgaatgtcagataacccctgagcataacacacaccaacaagcaaacaaatgtgtgattgattcagaacagaaataaggaaaaggagccctcacaacacatcgccagaccacatactctcatggtttatgtgccaagaaacagtttgcggctcagaattaatttactagaacagtaacagcatacattagagacaaattaacata

SEQ ID NO: 46249 - DNA, 2481 bp, Oryza sativa
  unsure (1)..(2481): unsure at all n locations
tcatgtggctgccatcgctgtcgcctgcaggggcgtctgatgcagatgtaccggtgcatcatcttcagatatcaggccatcttttaccggcatgggagtgttgtcgcatttctcgttggaccgaggaactgtcaaagctgcattgtcaagaaaataaaccaagacaaaccagtataaggttctgaatatgcaaacttctacgtatcaaattgtcttgactctttctcattccacaaaaaataaaaatcttagtccaacttggctaaatgtcaccattaagaaaatgtaaccacatatgtaccactatccaaattattttagaacactcaaagaattccaagtagttgtaatgttagggtcggaatcgtctccacgaagaaacgcaactacgcggatgtggcaaccgggccacgcagcgtcgaaggagatcacgcgagctgaaaactgacgtggcatgccggaatagggataatgatccgattgcttacatttagagaagagtttgttatccctttttattagctaattcaattcaattgtaagcctacttaagggccacgaaatcatgaataaaccaagcaagattcaatctatagtcccatctccaattctctactctctcatcccctgcttttgctttcgtcgccaatcatgggccggacgtcgaagaggctgccaaagcctcgacctccggtatttaattcatatcccattcggtcattagccggtgctcataacacgtattaagatagaaagagaatatcaaaattacccacaaggaaattatatgagcatatttgtcagctatatactatcctttttaacactgctggatgacaggtacttcctccgtttcacaatgtaagtcattctagcattttctatattcatattgatgtgaacctcatcttaataaatctagatagatatatatgtcttgatttattaatatcaatatgaatgtgggaaatgctagaatgacttacattgaaacggagggagtatatcgcaaagagagcggatataaaaaaacatcaaattcctttaaacaagagggcgcatgatctatttccttataatggtatattcaaataaagaagtgaacctcatcttgagatgattaaatcgggagaaaattatttgaagtaccatacctgccgcctcttcattaggcactggatgctcacttgttgaggtgtcccaagaggaggatgcaaatggcgctgagcttgatgcaaaggaagaaagatgagatgaaggcgatgagagctggtttcctggaatctgttgtaccatacctctagttgcacttgactacatcaagaaacaaggacatggacaattagttagtatgatattacaaaattttcgtgaaaacataaatctaggcaataaggagaatcccatttaaatttataacttgctggcctctagggagttttttaatagaaggaacactctagtattttctctatgaagtgttaagaactactgaaaaaagtatgattcatgttctggtacccaattagatcacctcattagaaaagggatcttcaattcgagcacaactatacaacaaagtttccgttcgtcatcattttcagttggtagtgagaaactggttcaaattggcatacaactttctcaatcaccagtaactcaaatctatcaaagataaattaagtattgacataaggaaatttcaaaggaaacactaagcaaattgtttttatttctttaataaaatgtaagtttacctcagtgacaacttcaggctcctcaattctatcctcatttaggtgtgagatggaggccaaatctttacttggattattccttaaaagttcaatctcagcaggttcctcataagtgatctctgaaatttcactgtttcttgatctgacctgctcagctttctccgaccgttggcaggactgggaacttctggtacttagagaaaaggattgtactatacaatcctgacacccagaaacatcaagctgaagatttttaaggttttgaagtgattcaggtagtgctttaagtccaagacattgtgacaaattcagagactctaaattattaagcttgtcaaagcacgatggcaaatattcaagcctagagcagttcgagagattcaaaaaccgaagagaggtaaggcattcaaaggattccagcagtttaagatcagaacaatatgaaaggtttaggcttttcagatatgcaagttggccaaatgattgtggtaatacctcaagtttcaaacattttgacagatttaaatactgaagtgaatatatgttgccaaaaaagtcgggcaacatttggaattcaaaaccacttaagttaagatctaccaaagaacagaggctagcaaatgattccaaaaatctgataggtaatgctgnnnnnnnnnnnnnnnnnnnnnnnnnnnnnnnnnnnnnnnnnnnnnnnnnnnnnnnnnnnnnnnnnnnnnnnnnn

SEQ ID NO: 46250 - DNA, 739 bp, Oryza sativa
caagtccaatcttttccattgtgctgtgtgattagtcagctagtacaaaataacactacgagccatgaattgctagagttggataatcttgaaataatattgaatggtccagatttgtataatttgggatcttgggtacctcctaacttacccttcaaagtttcaagttactatcggtttctttcaattgacacaacaaaggtgtgttatcaggttttgtactttttttcaatttgttaattatgtgctcattttatgcatgaagtgaggctgaaatttatctatttggagcctgcgtaacatcttggaaagtccccagtggaaaagacctcctatttgtcagaccagatgcggtgttcaacggccagaaacccatcaggttggcgctgaagtttaggataaattatctgaagcttaacaaatgtcatgctaaccatcttctttcctgaaaccagtggtggaatcccacattgcttcccccaattcggtcctggtaccatgcagcaggtttgtgaaacccattttctgttgtagccatttagataggaaagaaactaatatatttaaattctcatcagagcatatgactaaacagactttgatacagtcaagtgaatgatatcatatttcagattgatgtcacatttaatatatacatcaatctggaaaatgcatgtagtaacatgttaagcagggaacccaagttagcctgaaatgaactacctgcagcctgccaaca

SEQ ID NO: 46251 - DNA, 2808 bp, Oryza sativa
  unsure (1)..(2808): unsure at all n locations
ttcttgtcgctcttttctagcctttctaaagcagaaacctaccaaatgaccagctttcccacaataggtgcactcatacttggttttctctacanggcttggtttgtcttctggtttntgcttgtgctcaacttgttttggatttttgggtctaggtaactctacaggcttagacttgctagtcataggtaccatctttggttctgaggttttgggtgtactagaactagtgtttccaatgaaacctgcagactggaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtatgaattctctttcttagcagactcaagatcaactttcagagaaatgcatgaagaacaagaatcaatagatttgatagaatcaatgacagttttagcatcttttagttcagtttccaggatagcacaattagcacatgaagaatgaataggttccttagtagcaaaagattctaacaaatcattcttggtcttaagcatggcaacttgttgtcttaattcatcattgtcactagtgagaatgggacaattttcacacctaccaatcctatcatgaacaaatttttcttttagttctttcaattccatctcaagcaaacccatatcaactttcatttcatagcaagtagagcaagcagcactagcactagaaggattcccagctcctaaagcacatgatttcaacttatccttgaggagattaatttcagaaagatatgaagcacaagtagaacaggtatcctcctcaggaatcatggatcgaagcctagcaatttctagcgccattccatcattttcagattttagtttctcaattttatacttagaagacctatacttatcactaatttcaatcatcaagtgtgccattctttctttgcttagttcatcatcaacagagtcattatctgagcaagaatcatcacaaagagaaccatccaaggaagggatatcatcaagacatacctcaggatgctccgatgagtcatccttatcctcaagcgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatccttcttcccctttcgcccttgtccctcgggcttcttggtcgtcttgtcactcttcttcttcaacttgggacaattcactcttttgtggttaggctctccacactcaaaacacacaaatggttcattggtttttcctctttttctatctctcacatttttgtaagctcttgagaattttctagcaaaaagagcaagatcatcttcagggatcttctctaattgctcctcagtgactgagtgtaaagcggcaagagagaagccaccatacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgggtgcatctcaaatctttgatatcctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtgtaaggagatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgataccaattgaaagaccaagaacagctatagagggggggtgaatatagcaattcaaatcttgcccccgaaaatactcatcaagccggatttctcaaaatccttactagaatcgcggctattagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacgg

SEQ ID NO: 46252 - DNA, 23723 bp, Oryza sativa
  unsure (1)..(23723): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgagtgtccacctcaagtagcagctctagggcgttgcttcgaatcaggcaaaataatggctgtatgtggggatttggttgactggactggcacacttgattgcaatttccttatacgttcctcatgcaaaactactaaggtatgtaccgctagctagctgttgatttaaaatttcttgtctatttatacacggtgattgattacaaatgacaatttgtccatgtcactcaacgtaggctggaatcggaggacctcttattggtttggatgggaaagttattggcatgaacttttatgataaaaaaataggaaccccttacatgccatgggatgtaattcttaaaattctggcatgttttgagaatgaaaggtatttgcggatttcttctctcttttggttattcaagtgcttgccatctgatgtcttcatgttatttttttttttaaaaaaagacttggctgtaagatttgctaaatataattcaatggtgtgcttggcagtagtgctgctgaagttggcaatggtagtgatccatctgatgcgcctggctggaaaatccctggagatggcagtgtcaagctaaacaggttttctgatattatatatatatatatatatatatatatatatatatataacagtgccaagttacgtctcaaaatcctcatcacattgcgtatattgaactacatacaggtggcctgtgcccttgccatattggcgtcctcatgacgatgtggaagagcaagaacccccagagggctgtgaataccagtgcacatacagaaatggtgaaagatggtgctaccggtagaatatgttcgttctactcctctctctctctctctctctctctctctctagtagccctgtaatgttactacatgtcccttgccgtgttttgttttggtgtgtatcgcactgggagttgaagaacattcagctatggtgatgctgagatgttaaatacaatgttaagtaaaagtagcgtgtctatcttggatatatcctatttgttttttaaaaaaatcccaaagtatttggcaggacgggaagtgccaaagcttccaacttgaaacgtattgaatttcgctttgtggatgctgcacgagtaaaaccgatattgtgcattatgtgtttgtgtggaaatataaggggtgggtggcaggggatgctcatgagatggtcgtctagcaatgtgtacttgaaattgctacgggttttattaaaactcagataattgctgtgggcctcatggttcagtccatggacagatttcattaaatattggctcattattactacttgtaatcgtaatcgtgcatgcgcattgtactccctcattttcatactacaagtcgttacttactttttttttgggtcaaatttcttgactaagtttaaaaaaaaatatatattagtatttttaccaaaaacaaacatattgttaaaatatattcaatgtgagattaaatgaaagtactccctctgttttaggttataagacgttttgactttggttaaagttaaacaagtttatagataaatatagtaatatttataatacaaaattagtttcattaaatcaataattgaatatatttttataataaatttgtcttgggttgaaaatgatattgtttttttctacaaacttaatcaaactggaagcagtttgattttgactaaagttaaaacatctgataacctgaaacggaggtaatttgctactccttccgctccaaaatataaggcacatgcatacaactacccttaacccaaagacaagaaacaaattaccctaataaatataatgcatgcatccaataaaattagagatgttaagggtgaaggatttaaaaaagtaataatttaatggggaagatgttctagttaattatatgcatacatgcatgtcttatattacggaacatctaaaaaaaagtagttgtgtcttatattatggaatggatgaagtaatttttatataaactttgtcaaatttaacaaagtttgactaagaaaaaaagtcaaataacttataatatgaaacggtgagagtatgtcttaagcatattacacgtagacaatagtttattttcttttttagtcaacttgtattatctatttttaggcttgagttcatttctatgtgttcccaacccatttctctcgtattccatgtgcatgcttttcaaacggttaaacaatgcgtttttgcaaaaaagtttctatacgaaagttgcttaaaaaatcatatggattcatttttgataaaaaaattagctaatacttaattattttatgcattatcggacctctatgtttttccgtgcgcagcagctgcattcccaacttatggaaactaacacagccttagtattaactacttggatttcatataaaaagtgcaatagaaaaaaaaaactggcataattttatgtgaaccaattatggtcaaccaaccaacagatagtgttgctaggagtttgggggcttgctagggacgcgcggcgttttttttttctttttgcgccactttttttttgctttttcctttttttttcgtgcccctcccctcacgcgttttcctgattttttgtttttttttcattaattagccggcacagcgctagagagggagaggagcgcgatagagaccgtcacctcagtggagggagagcagcaagcgtgccgggagcccgggaggagttcaatggaaataaattgctaatcgggcggagcttacggttgttactcttacttgttagtttaagtgtgttggcttaatgagcatgtgcttaagaaggagagaacaagcaggagcggtaggatgaaatagacggcagatatggcagaactgcacgcccgtgacgtttctttggtaagtcagacgatccgagttcatccaaagctggtatgagtctgaccgtctatgcatataatccattgcaaacttccaatatttccatcacatcaaaaattttctacacacacaaacttctaatttttccgtcacatcgttttaattttaaccaaattttcaattttagcgtgaactaaacacaccctaatacactaatgtcaattgaaatgctgaaaaaaatcctagccactttactaatgtgccaataattcatcaattacagctacatgcttggcaatattattatttagagaagaaaatatttgcaataataaggttgtgtttgacttcagatccaaaattttataaagttgtatgttcctagcttcacgaattcacggaactgaatatgtgataccgtaacaattagatggattatttaacatgcaaattttaaatttagtgtggatctgagatctggagtagccaaacggatctaaggttgatgcattgacaactctaagctgcgatgcctaatgtcgacgtatggctacaaaattaacaattaaacatgcttgttttcgtgctaaatgccaacactatcaagattaaccgcctagagcaatggatcaaaataagttggagttggaagtactaccttcccattttttttcttccatttcaatatttcccgagataatatttgcgagaaaaaaatattactccctccatttttttcattttatgctggttttcataaaataaaacaaaatgtaaactaattaatgacttaacatacaaacagggataatataataccctattatgattccagtttatatctatttgtcacataaattttcgttcgttgtccccgtgcacaatcatcgagcccacacatcaatagcatcattacacaaacatatctttgtgatcaaacttatccacaataacattaactggtgcaatacacgggcaatgtgtcttttaaaaacatggaaacaaaatatgccataattagaactccaaaccatatataagtcgataataataattattactatgattgatttcgaaatttttttaattttagaaaatatagagtgactataaatattagaactgcttaggagtatatattgcttgtatagtccatccgtttcaatcaaacatttttaactttgattattaataaaaaagatcaatcatgtaaaattaatgttcctagatttatcattaaacaaattatcgtaatatacaactctttttatttaaaatattttattttatagatattattagttaaagtagtatctcggagactgtgtcaagatctaaaaaacaattatatattttaagacagagaaagtacgtactcactcagatcaataagagcaggtataatagtaggctaagccagctgtaaacaattatatattttaagtcagagaaagtacgactcagattaataatgcccgatattttcctcgggactgcctatacatttgtcgggtgattttttaacaagaaatcacccagattttttttacacttagatttatatccaacggactacaaaataaaataacaaatacaaatttacttattcaacatttttatcaaaattatagtgcacttatatgtcatatcaactaaatttacatatgtagttttagttatataggactgtaattttatattttaaatccttacatgtcatatcaactgaatttacaaatgtaattttagttatataggactgaaactttatacaattatagtgtaattacattgtaacttacatataattacagtataattatagtgtaacttacatgtaacttcaatgtaacttttaaaacaccgctagtcatacgaaatagtcatcacgggagatctctcacccgtattaaagtagtattatcgttcaatcactttcgttctatacagtggcaaagctaaaaaattaaagatgcgtacaataccctcacttagttatcagtgccttgccctaatcagatgctaatcggtaggttgaaaaaacgtcaaattttaagtaaaaaatttgacgacagatttataggaaaactgttttcctcgggcttcggacgccgacgggaaggattctcgataacttccctcctttcctcaattccgctctgcacggacggatttttcatatccttggactcttccgaagttccaaaacaaaacaaaaaaaaaagaaaaaaacagaaacaaacaaacaaatccgtaaatccccgaaattccctacgaaaaacccagtcattacctacatcaggactccaccgaacgcaagacaagagtaaaacggaagcaactcccagcaacagatcgtcacggacatggacagtacacgaagactatagctgtgtttgcaatcccattttcccaacccctctccctcgttttccgcgcgcacgctttttaaactattaaacggtgtattttttgcaaaatgtttctatacgaaatttgtttaaaaaaattatattgatctattttttttaaaaaatagtaaatacttaattaatcacgcggtaatgaatcactccgttttcaatgcagggagtttagttcccagcatcctatatccgaacacagccggtaccagatgtgtcgatgccgtcttccatcaggacctgatctggctcgccccatatcgcacctttggttgctaagagcatctctaacagtctttttaaatcggactctccaaaacacgtatataaccagctttctaattgaattgtaagccaaactcatttatcactccaacagcctctccatctacgccttccattctgaatctatgacactgggacccacgcgtcagcatcaactccctcgtccctccttcctctttctccctcctccaatcctcttcctcttttcccccaacgtagatggctacagcgagcatggcgtcggaagaggaggacgtcgacggcgacggcgacgatggaggcgaggcggccggcgccgaagaggggtccggccccttcttccccatcctgctcttccctcgtcgccgtatgcagctatgcatcagctacgttctgaattcacaaaactgaaatgatacaagaaagatatcagcacaatgccatgctagaaaagaatgaaaagcatgaacaaatgcactcaggttgagaagaaagaagaatataccgatctcgatttcaacaagcttaacagagacaagaaaaacatgaacaaaaaaagaagttcacctttctgccatctaccagatggaaagaaccgggaagccataaatcctattcagtaccctttttctaatccgaattcccaattgctaatcgagacaaacaagcagcgcagaacagacggctacagagattaaggtcgtacctttgcaaatctgcagagcgcggatgcgcagattgcggaagcccccggcgacgacgtcaaaggttgtcgtcgatgacgccggagtagaacaagagggacggcgactgggagaggtccagctcgaggatcccggggaagcgcgcggcgaggcagcgtagcatggccgggtcggggcgcgcgcgcaggcgccaccgatcggagctctagacccgtagccagtggagcacgtcgtcggtgagcacatcgttgatgagcgcgccgccggatacgatgcccggagacgatggcagtggtgctcgaaactgatgggagaggaagagagtgcgggaggagagagagagaggagggagagagtggggccacgattggcaagccaatttggactggccaaatttagccattgaggagccagtttggccagccatatggcttagctatccatttagtaaaattgttggagtttgtttttgtctataattattaaattttaatttgaaaagtgaaatagtcaatctgttggagatgctctaatctggcttagctcggctcgccatcgacgccagactgaaggtgcaaaaggttggcgccggtgccggctgcctccattttagcggctcctttttccgtggaccatttctttcgtcggaactacgggatccagccgcgtgttgccgcgtgaaaacgagagaggagaaacgggaaaatagaatgaccacagtgggtcccaccgtatgtgtatgtgtcttgtatttttccttttaataaatccaccgcacttttgcacatcttaaagcatgcttctacacatctgggtacagtgccatttacgatgatgttgcaaactactcataattacaatttatagtaaatggtcatatatacttccaaaatacatcatatacacgtacaggctacaaatttacaccatactaagtcacaatataagaacttctatagcccgcccaaccacttatccaatcttgtccccagccatttcattcatttactgagcatcaccaacagattggctaaatcattcacgataccagaagtttaggaatttttttaaaaaaaaacatgctccatcagtatccctgaacgtcattcaaaatttagccactcccatccccgcgtttctcgctctcgtcttgtagttgtagggggcagggctcgctaccaaaatctattcacgcgcttcttcccgcaaagctcgtgaaatggtcgaggtcgtccgccgatgccaccatccaatctccactgcagcttaccggaatgaaagggcaaattccataagcaccgcagctgcatcgagctgctccgctgctgaccacatcttcccagaaaaccggacggaaatcatagccccgagggcttgattcgtcacgccgacgactcccctcatggcatagatggccatatggcccaagacccacggcccggcccgaagcccgcaattttggcccggtccaagcacagcccgggccgtgcctgggctgcaccctcggcacggtgggccggcccggcaaggcccgatcaaataaaataaaagaattttgctgatttatttattgctatatccaatttatggaattgatacaccgtttaattgatactatcatttagcaaaatgaaacatagcatatgcatccatctttcggctcgagaatttcacgggatagagatatggtataagaaataggctattaagtaactctaaatgaattgttttagctccggttcgtgaaggaccagagaagctttctagttatgaatcgggtatagaaccccctttatagcttcatgctgtttgaatagttccaattaatggaatcgaagtcattacacgagtgagtttagcaagtggaatatctgactttgaaggagctgctgcaagttctcgaattgtagttgtcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaatatatataatatgttaaaaaactcttgtcttatcgcgaaatgtttcaaaagagcataaaatttattttaagaactaagaataagaaaagagtataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctattctactatatagaaatagaaagaattatatagaaatagaaagaatagaaagactctttcttacaagagtttcttacaggagtgaaacaaaattaaagaaagatcggttcaaatccgatagtcgtcttttttctctatcaatgttccatgaacaaaaatacctctttttctccgaactcactaacctctagaaacatctcaaatacaaatcccttttcgatatatttctatatactgtatccatgtatacaggatccgctatatctgctttggcactggaatgctcacttcgtgcctatcgcgctatttctacataattgtcccttatcttatattgttttcttctcgtcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcagtagactcatatcctttattccttaattcattattccatgaaaatggattattccatgaattcctcaaaacgaggctcatcaaaatgcaaaatctaatactactataagactactaataaaataagaaaaaaattcgaacgattcttattccatatcctttataaacgaatttccctaaaaagtaggggatgatccgtgaattaacctaaccatcaactaaaaaaaatcctacaaaagcataatggaaaagtaggaaggactcaaaatagaaaaaactcacattgggtttagggataattaggctcgaactgatgacttccaccacgtcaaggtgacactctaccgctgagttatatcccttcccttttatccactagttcccctctctttagtttaacaggatagaacagtttgattgctgacaaggctcataaccgtggggttgcgggtttactgattactagaatttttttgttagaatccaaaagttctttactaactagaaagaaaaacgaatacctactgcttattgcaaattattcctgattttaaaccagagtagattttcgtgatgtgattcccgctaaaagcatacatgtactgtaatgcgcttccccatgggtatctggtaaccacgtatgtaggggtataatcggcaatttgacaacataagcaataaggaagccaaaataaaatagtatttccaatgttgcagtgagccctctcccccttccattagaagaggtttttgtccctccaccttcgttgaaggctgtttatcggaagaacccgtactttcctctgggcatcgtatcaaaaatcgccattcctgagattaaccacccgccgggggagtttataaacaaaaaaatattgctaattccatcttctatactgagatataccaaaaaagtatagtgatgccaaatagacttatataatcgtataaggcaaggtccaagacaagaggtatacaaaatagacttattttccagccatttaaacacagctcacagagttgagggaccaaaaatagactttttctgttatacctgaacatccgtcgcctctccccaaagctcatacgcatcctcgatttgtcccgccgccatcccgattcaaccatttggccgctgtccggacgacgccacaccgccgcctgacatattgtctgctcgacgcctccctgtaccggccgctcgccgtcgtccgagaacacacaggcgacaacagggtgaggcgaccgcccagaaccatcagagacgaccaggcgactggtcacggtgtctacgattcagcggatttaatttgtcgatggagagttcctccatcaaatcaatttagctattctgaaattgttcctgctactgctggtgctgaataatctactggatgttgctgctaaatgtgctgctactgtatgctggtgtttctgttgctaaatgctgatagttcgttgctgctgataaatgcagctggaaatgttgttgatgatgcttgctggtttttgttggtgcttaactgatgttgatattgctaatctgatgatgttgatctggaagctagctgctgatgatgctaatgatgttattgatctgatcatctgaatgctgctgctacctgctcatcttatttatgctgcttgtccttgtatatgctactgctgagcaacgggtggacgccgggaggagcgcccggccgatcaagatcacgcgggacaaaaaaaataaaactgatttatcttgattagttcatatgcggcccacttttttatgttttgggagtcatttttaggtattctcttggatagatcaatatattcacccctcaaattttatttaggaatcctaataactaaattttagggatagaattttcatagtctcttggtgatgctctaattctttttttttcactctatctttaatccctcaaagaaacaacagaaaaacagaaagttaaataaattttcttcgttatattttaggagagccatggaggagtccctactaaaaagttaaatcgatttcattcattatctcatcttttgtcaattgtcatcgttagcctcgcagcgactcgtgatgctacaaacaatctcactacattggtggcgaccgaatcaatccaaaaatctctgtattccctatggcgagcaaattaggaatgcaccaaacatcttgggaagaatgacttctcttatagccagaggcgttcgagaaggtaaagactaatttgaaaaaaagaaagaaagaaagcaatggccaacatgtactcccctcttccagatggagagaagagggaaacactagacgacttgagcaatatgagatagaaatggaggattaccatgtaagtctctttgtatctgtttagtcagtacattatttctgcataaagtgcaggcagctgtctctgggagactgggaaaatatcaagaaagaaaggcgaaggcttcttgttgaagaagctgaggataaacagcagggatggtttgtggtagatgagaaaaagggttatacaaatcttaataactcgcaacataggggccacagaatgtcttatcaaccacacgaggagattccactttcaagagttaaatagaactaagttgaatacttgtatttagagaacatatttgttaggaagaaaatacttcatggctcatgatagagccgacaagaaagttggagtgacaatctcagaactacacatgatagtgatctgatctatgcctattgttgctgcttctcaaaaataccgatgctcaagtaaaccaccaaaaaagaacttacttgagtctatgaatggtgctaatcagcagtaaaggtcaccaaaaatcttacttgagcctatgattgctactaatctgcggtgaaaatcaccaaaatgttgctgctggcctgctgtttctcaagccacaaaaaagggaacttgtaacatttgctttgctccttcttaggatgggcgttgctgcctatgggaacttccctcccttcttccttgaagcaatcttcttcttggctgcatctgacttcggcagcatcgcattcagcataccatccatatgagatgttaacagtgccaccttgatctcatagccaccaaggtacaaattgagctctttcacacaagtcccagcgattagtcccataacttttccttttaggctgaagaccggagaacccactaatctgcaatgcccattgaaacccttctcggcatagtggcacgttcccaggaagtagcactcagaaccattgatatggttgcgtcgaaggtcgagtgcagcggttgattctgatatgacaaagcctgggatgtggtatgcagaggttgctgaagaaggggcaaaaacgacaataggttcgggcataacctgaccacgcatcttcttgattggtctgcagtctgtgtgccttttcgtcctaagagacagaacgtatccccagaagcaaaagccgaggcttcccgttcgatctgatcaaagaaacagatcttgagggtatcctctctgcctgatgcaaatgacgattgggtcaacacgtaagtgtactttccctttgatttcaacacgcatccgctgcaatattcaccattggcgtcacggactacgaccatcgatttccttgctctcttctctaccggaatgtccatgagttctacagattgcgagaggaagtaacataaggacaagtactaaagtaggtctaccggaatgtccatgagttctacagattgcgagaggaagtaatgtaaggagaagtactaaagtaggtactagatatggggcaagatgcaacacggggaagcagcacacgcaccttcaccttcaaggagtggaggagcagcaggtgaccgggccatttctcctccggcggcgacggcgaaaggataaggcggcgcaactctttggtgcgggagcgggaggaggggggattagagagagcgaggcagccgcagaaaagaaaacctagtggccaatatggacaaagggaacatgggatgggccgggatcgccaatcgaaggccgcaatgggtaaccagagcaggacggataaggcgcacggggatgaataagtttatccaaggtccctgaacttgtcaacaaaatctgattttcgctcttcaaacgaaaaaaaatacaacggtgcctcaaccatcaaaaccggtgcaatataggtcccataacgatgtggatggcagttttaactggcatggtgcctaaatggttaattcgattcggttttaatctgatttggcattgacgtggcatatgaagcaaaatttaacaattttaaaaataaaataaaatatatgggcacacatgtcagttgaacgaataaatctaaaataatgggttatttaacttttgaccacttttaagatatgacaattaattattttccactcgctgtctatgacatgtgggttctatggcaaatcatttatcactatccataagagtagcaaataattaattgttccaaaaaaaataatgggcaccacttcctccacgtcatctcctctcttttctgtcttctgctcgccaacgccgctggagaacgggagagtggtggaggtcaggggccagatcaccaggtttcatgcgccttcttcttcatctactcggcggcggcgcttgcattcctcagctcgaatgcagcgcacaacgcgcacccgtcggcgagcgcgcgcggagaaggacaagggcggcggccaccggccggcggggagaagggcagggggcggcagccatcgggcggggagggtggcgagcgtgtgcggagagggaggaggccggcgagtgcgcgcgggccacgccccgtcctccgagttggatagtatagagaggtatactgcgtaacgtgggacgattgtattgagcctcaggggaccggtatatataggagtacatgtgaaggagataaggaaagattatagataaggaagtaatccacacaaatcaatcatatcctaatacatttctaactaccatatactttaacatccccccgcagtccaagcgtgagcagcgcggacacttggactggagaagaaaccggcgagagtgctcaatatcgatgatagccctttgtgccgtagacgatgtagccgagatgaagttgtcgtagtcgtagtagcctgtcgtcgctgatattgatgcagcacaagtcacccaatagtgtgcggttgtggttcgtggcaaggatcacggcgccaagcatgagagtgtgcgggtgtaggcgaaaagccaacaaacacgatgaccaaaaggaaaaaaaaataaagaaaaagtgaaagtgcatctacgacccctcatttattttggtgttaatgacaacacaattagaggttcactaatgctctttgttgagatagatgcaaggataaaaaggaatggaacttgagtttaaaagcattgcggcatcttttgtggtaattgtcttctaatccatgtatatcttgtgttcttgagtatcaggatgccgaactattaagagggataccacatgcatataattggtagaacactagtgctcaaaatcctgcttttgaagtgttcttgttcttctcctgtcggactatccgatataaggtcggattgtctgatacattggactatctgaaatttctcagaactttactctctgtgttgaattgctttttattcctcttgagtgattttttttatgtcaaatcagactatccgatgtgatcggactatccgatgatacagagactccgaaattcaatggaacttgagtctctgtgagaggatgaaattcatgattcaaaaataacggactatccgatatggcatcggactatccaatcgatcggattgtccgaaattctccagaatttcgttctctgtctctggcttgcttggggtcaaaaacatcagactatccgatgtcacctcaaaaatattctctcccaacggccacattttggggatctataaataccccccacctaacccttttctagggttacccaactcattcatttacattcactttgggttgagcttggtgctaaggtgctttgaatctttgagctctttctccctcaatcaaatccctcctcattctttgtgtggtggatctttgtggttgtggatttggtgtttgagggcctagtgtgtgtttcactcgatcttgagcactagggtttgaccaagagttatgtggtgtttgttactcttggaggttgaggactcctagacggctaggtgtcactcccgagccaccgatctacgtgtggttggccgggagaagtttgtgaatgccggatctcgcctccgcaaggaaagagataccccttagtggaaggaggagtgcttagtgcaacctcttgaggaaagggttagcaaagacccggctcttagtgagctcctcaacagagagtagaatcccctcaaggatttgaactccgggaacaactcggtgaacttcatcgttggtgatatctcttctccccctatttagctttgctttttgtgccgctatagatctagtcgctgtttacgccatactcttgtttgtgcactagatctacttgttctgtttctttagtggatcagacagtctgatccaacatcagactatctgatattgactgtggatcagactttccgaccctaactcaattttagcttccgcataaagttttaaattagcctattcacccccctctaggcctaattgaccctttcaaaaagaaatttaaaaaaaaacactatggtaatcacggtgtgaagacgttggtgatgacgggcagacggtgatgtcgacaatgttgttgtaggctggggcagcaaaacaacaacatccttgatctcggtgaaacgacggcgtgggcgacgcaaaccgatctctgatcgaaaaaaaaacagcagcagcggctcagctctttcgtgtctcctgacgcactaaccggatgcagccatgcatgcatgccatggaggcacacaaattagaaccatgcatcttcgttacccatcgttgcatgcaccaaccagttacacctaaaagcctaaactgataaggaaagacggacaattcactttatacactccaacactccccctcacgcgagatcccctcaagtctcaagcgtggaatattggagtgggctacaattattttatttaattacgtgccagtcaggattcgaactcgagatatctggctctgataccatgttagatagtatagagaggtatactgcgtaatgtgggacgattgtattgagcctcaggaggccggtatatatagaagtacatgtagagaagataaggaagtaatccagacgaatcaatcctattctagtacgtttctaacatcatatgctctaacactccgctgccgctgcaggccacgccggctcctctcccccgcgacgccacccaaagttgctgcaggcgttgtcgccgcagccgttgcgagaaacttcggtcgccaccgccaccgaaagctcctgcagacgttgtcatcgtcgtcgccgcagccgtctcgcgaagctgctgcagtcgttaccaccatcgttttcatgtgaatcaatcgccttctccttcctggattcgccgatgaggatgtacggactcgccggattccttcatcctgctgctcctgcttcgcttccttgtagccgccgcccgccgtcgacatgaagcatgtgaatgaagcatgctgcagccacgcctgatgtaccaagacactgatgaaggcttccacggattgtttgattgaatcaattcgctactagttgggagtagtagttgaaggttctgacagattcgtcgatttggtgattatttttttcttgtatttttctgttcttttttccttctgtatgtatgcagttgtttataaaaactgggtactacattaatttctttggaggagtaataaaattgtgccaagatttgtcatccgaccagtgtgagttagcagcttccatctaaatcctaatatatcatattttttcatctcaggcagagatgcacaagtgcacaaccaaacatgtaagatgtgaggctgccaattcagatgaagaccgactcaaattagtcacgtaggcgccacgtcagctaaaatcgtcatccaaacaactaggggatatatattgcaccagttttaacagttgagggatccgttgtatctggttttccggttgaaggacgtatattgaattccttgacaagttaagggacctcagatgaacttacgccgcacggagatgctccagtccgtgtgaaggaataagtctactttgcctccctccactcctttccctgttgaatcacatccctcaacatgcaaaaccaagtataacccgtcctccaactcataaaaccgttgcaaatcgactcctccaacagtttcgtcctacgtggcatgttcaaccctgttgactggctgagtcagcacgtggaccccacatgtcagtgtcatgtagagaaccctaaaagtgagggtaaaattgcaaaccctaaaaagtaggggtaaaacagctgttggaattaaaagtgggggtatggatgcaattgccccctacttcttctatttgcactataaaaaatatacatttgatagaactattaatttttattttattttttaggtgacctataatagatattatttattagaagatttacattgccatatatttctatgcaacaaaacttatatatatacatgtttatgttttcacgtttcactcatatttgtattatattccatgttcttatttgaaacatatattttatttgtatttcccaaacatagtaacataaatatttgcatgtattaaatatttgacttattttttttctcatcaactaaaatacattcaagtaattatttgtttgatacagtcatcctatgagttgcatataattgactgaagtctgaaggtattgttatgaactttaaaaaaactagaggtaccactttgttaattaacataatatctaggtctgtacacattcgagaattgcggtcgtacttgttcgcttgtcacaagtacttggcaatgcatatggaaaccaagacagtactagcccgcccggaaatcaaccaaatattatgtaccgtcccaatctaagtataaagcattttaaccagattgtaagcaaggataagcaaagctaaattatctgggtttctatagttgaattatgcctacataaaatgggatatttgaatagaagggttataaataaataatttgtaaagtataggcttaaaatgatcaagaggtggacaataacttgccttgcttgatgtactgagatggattgatattatctagtaagtcagaagaatcctcaagacctagggttaaatataaaattcaaattcaaaagaaattcaaatgaaatccaaaaatagggcaaaataacataaaatgagaatagcaaaaaaaaagctttagaaggtagagaatgattttagaagaattttggtctaagtttcattagaattgggtttatatttaaaagatatgggcttctaaagtttcgaattcaaattaaaccgggaaattactaaagagtactgtgcgtgggtcccactggccagtctctctctttcttctcttcttctaccgccagccgttccccaattgcgaccggcggcgctagggttgcggattgcggcggcaatagaggggaaaagtgggtacgggcggagaggggaggctgctagggttctccggcgatggtgagcggcagcggagggttcaatttcatctgtggacggcatagcggctagggtggcggcggtataatggtgtcgtgaaggtgatcttagatttggttgttagacacaataggacatgggtgctggaagcttcactagggttcatgggatgggttgatggctatgccgaccgtcggcaaggtgtggagggcatgcggccgtgagcgccatcatcgggggcgatcgagttcggccgatagccgtgtaggtgatgcaatggtgcaatgcgactggaaaaatggaacctaggtggtatgtagatgctagaaaacggaagaactcaccgagttggcttgaaatggcgagatgcggtcgagaaaactcctcggcggcaaaaacagggcatagagggacgacggagctcggtcggacgcgacgaggtgaaagtccacgcagggctccggctaagcttcggatttgtagaacatgactcaacgaatgtgtttggttgattggataggacggaggttgggcggagtggtggggaagtagtcgcgcacaaggtgctcaaccggcggacagtggtggttgatggggcaaatggagaggcagggctttgggggtagtgtggtaatggttgatgttagagcatcaccaacagattatctataattttctcctaaaaatttgcttttgggtttcctaaactgaaaataggaagtgaaaaaactcctctctccaacagataacctaaattcaatccccaaaacttaaaagtgggcccgtctgttaaactaccaagaaaaattccatcttttttttctttcacgcgcagaaagatcgctatctcccacgcgcgggaatgaaggagagagaggcgggattgcgtgattggaagcgactttcacgcccgcatataaacggagcgaggaaccggtggaagggaactccaaaacttaggtaggagagcaagggatctgttggagctgatttttggactaaaatccctcaaaattagttttgggaatcatataggtagactgttggtgatactcttaatcgatgatggatgagtgagggcttggggtcctatttatagggcttgggcgagcagatgagctcgagcgccatcaacgcaattgatgagctcggtgttcgggcatggcaggggtggcagagggctgagagagggaagggaagagcaaattgagtggcgggacatcatgttcaaacatttactgacgacagtggggtttaatcgggggcgaagacaagcggcggcgagctggcgtcctcccgggctcgacgcacggcggcggcgaggggtaaaacagtcggcttggcggcgttcggttcgagttgagagaaggaaaagtgactgtcgacttttaccccaaacgcgtggcagaatttggtcgttttatccccggtagaagcaaactcagtcttggcgtcagcatcgggtgggcacgcacggcggcaggcggtgttaagctgcggcggcggccgtcccggtttctcctccgacgagattagtgcagcggtatatggttgaggctcactggacggcggatggcatgcacggggcgccaaggcagcgcggctaggggtggccacggttgtgacaggacacgtgtcgcacaagagattaagtctttcgcaggagcgtaagacttcagtcttaccaaattttcttccggaaaattgatggggaggccacggttttagagggttgtggtccccaaggacctaacttagactttgccaaagtttaggtggaggttgggctgctgttgtcgggctgaccattttatcgaacacctagagtgtgatgaacagtaaattcagaaattttgaatattttgcctaaaaggaatagaaattatctaaggcctttggatgggttttgctaagtttttgcactatagcaatgtctcactagaattagggtaatctaaggaaattttctaagttttgaattttgaaagaaatttgctaaaaaaattagggtttttgggtaggatggtataaagttggttttaaaggaattctaaaggggtattacttgaaccaaagaccaaggttaaaaaggaacttttaaaaaaaactttgattaattcaagtaaaaaaccaacataatgcagttaaattttagattaaaatttgaggatgttacaatgatgcatacctgcttgatatcctggagaagagattgcaccttgccaccgccatttgcacctgcatctgtaactccaacagtgcttacctgaacataagagttagcaacaagccccatcgtacatctagttcgctatcatcaaacaaatccttgagatttgataataacatatttccagcagtgaactgtgattacaagcattcagtttatatttagaacgtttaggtttttaaggtgcaaaattactaactggccatcaggaatcttaattggtgaaagcagcaagctttctggatggaggatgagccacatcatccagaatagaagaaccgttggatggatctagtaaaagaaaatacaccgttgaatctatacatatgtaatatatgttggacctatcaagaccctcatttatgagaatagaaatccattggaccaatcaagaagcttctggacaaaaaagttgacactatgtttggttaattaatctctagattaaataaagaaaaaaaaataaggctcagctataaattcatactgaatttattaacctctatgattatcctccataagtgatttgtagcaaattagcattagatcacgttccatttctccatatgcaatgactcagcatctatgatgcactgatacttcactttcttgccgtaccggtatccgatacgtccgatactccgtcgatacatatgcttgggatgttttttgaattatagagaaaaacaaagaaaaaacaattgctaacaagttccctttaaaaacatgtcaaaacgtatgtttggaatgtttttgaattaaacgtatgtttataatgtttttgtaaaggacgtaactacagagctagtgctaaaccagataccaagaggcaccatccacctatactttaaatacaattttttcttcaattactcatccgatctacaatccgattacaccgttgtgttcgtaacaattaaatctttacaacaagatctcacatgattatattttgataaaaaatcacaaattacttttatgatatgtctaaattacttttagatttcactaagttacttcttagatatataaaactaaattcagtaaaacctaaaattaatttacatatattataatagtaacttagaacaaaacgaagataactttagcatgtcatttgaagtaaatccgttgtatagataaaaacacacacacacacacacacacacacacacacacatatatatatatatatatatatatatatatatatatatatatatatgtatatatactggatttttcacattttggtccttttgaaaaacttatttcgcaagtagacccctagaaaaacttatcccaaaaatggtcctttttggggcgccagcctctttggcgccgtccccctgccgacgtggcggggcgatgctgaggtggctagggggagtgcgccagagtggctggtgcccccccccccccgaatttttttatttttgttttatttgtttgatatttttttcacgcttagggacacacaagaaccaaccatagaaaaattgaactcaaatgaatgtaatatgtgacatgtagaatttttcctctcctctcctctctccgaacgagtgcagaggagagagatgtgcaacttttttatttttattttatttttttgatatttttttcacacttaggaactcacaggaaccaaccatgtaaaaaataaactcaaacggacgaaatatgtggcatatggaattttccaaagctccaccgaaaaacttctttcctcaaaaacacaatcttgcaagcggaatttggaggttttaatatcgccgaacccggcaaagcgggggagaatcggatgtaactttttctgtagatgtccgtgcatatattatttgcctgattccgagtccgtatgagaaagttatgcctattttaatagatgacatattttgtccatttcgatagagttttggaaaattctacatgtcacatattttgtccgtttgagtttattttttatacggttggttcctatgttctcctaagtgtgaaaaaaatatcaaaaaaataaaataaaaataaaaaaattgcatctctatgtactttttaacttatatatgtcatttcatgtggttatattttgaattagattaagtaatttcatatagtggtagagtgcattatgtttaacatgctgatcaaagggttttactaaaagagttatggtctaattttagtgaaagtgcaaagtagactaagtggtatgctagatattttcagacttagctaagtggtagttcgagtttaaatttttttttgtggttggttgtatcgtgatcctgagtgtgaaaaaacatccgaaaaaataaaataaaaatgacactgttgcaactccatacagagaaacaggaatggaggcggcggcgc

SEQ ID NO: 46253 - DNA, 12062 bp, Oryza sativa
gatatatatatatatatatatatatatatatatatatatatatatatatatatatatatatatatatatatatatatagagagagagagagagagagagagacacacacacggtcacgctacgtgacgcgagtcacaggcgatgcacgccagctaagccgtagcgccactcagagcgagagcccgcattcccagcgtacagacccgccacctcatccccatcctgcaggtgcaaacagagtaaaaaaattaccgtggggcaaatcagttacagtggttggtttatgagagaaacacgtgattatcgaccaccctgctcccctcccccgcaacagacaactgagtaaaaaaattactcattacaaaatttgtcttggagcgggcgtaattgaagttaaaaaattactcataggggttgactactgtggtacgtttcaatgaaatatacacgtgacaggcgatccttccagcgaaaaaatcttcttgccgtcggtgaaatttttactaatgggtatttttgttcggtatatgatagtaaatttttaactaatcaatatttcttctataaacgtaatatccagagcaatttattaactcagggattcttgtgctgctcagtttgcgagtaaaattttaactcatattgacatagatgaatattgggcgtccatttttcgatccaacggtagtttctacgtttgcattacatataaggtttgcactacatattttttccctataatacttattagggttagtaatgtttttacttctatatattttaaacatcactctcagtatgttcatagtaatatacttactcaatctgtccgtaaaaaagtgagtgaaaatttttaagccatcaacatactagtatcattatccttttatggggcatattttgacacatacagtcaatattagattatggagtattacgtttaatcatatgcatatcaatcgtacaaaaaatcacccgtgcgtaacaaactacagaaccaacaaagagaaaaaaaggaaacggaacccccgtccacgggaggatagaaacagcagagatacggatgacccgagaagcacgccgtacgtggtggtgctgcatgcgctaggctccctccagatccagcgcagcaaccagcgtctacatcggcctcttgccctatacgcatcgacgctggcctggaagctaatcgccgggcctgaagaccgtcgccgccgcacaaggtggaaagcaaccttcccctccattccagcttgaacgttgtttcagggccaccactgccactggccgcctactcgtgtgctccctgaaccgtgctccctgaaccgaccatgaggcacgccatggacgacgtagccggccgccgccaccctcacgggctccgaagaatgaccaccggcgccggccttcagatcgggcaccttcaagagggaggcagcccgacgccaccaatcgccctctcctacctggatgcatgacgacaccacccctcaccgatggatctcctcgccaccactcggggctcggcctccacgccatcgccccaacgagcagaccggtcacccgtcgccgctctatccccaatttctcagatccgaaaaaaatgaaagaggacgggagtatgaatgggggtttggatacggtgagatggttatggatgatataaatagaattattggcgtgagtaaaaaaattactattgtttgggctggagcgttgacagggtgggttgggggtggctcttggtggtgcgcgagtttattggagtgggggtaggggtacaggggtgggattgagattgatcgtcgatgagttaaattttaactatatatagaactactaagaagttggataacatcaagttaaaaatttactcgaactacgagagtgaggggagggggcgcaggggtgggataagactgatcgtcggtaagttaaattttaactgtgtactacggacctggtgggagcgtggatgggtggggctggaggctgtttcaggtgctgtttaatatgtagcaccttagggtgttgtatagtagttatatatatatatatatataaaagttgttcaatgaaaaaaagcattaattaaagttactttctttttttataacttacttctataatatatgtaaattacttttaggctttactgaatttacttttatatgtctaagaagtaacttagtgaaatctaaaagtaatttgtgatttttcatcaaaatataatcatgtgagatcttgttgtaaagatttaattattacgaatacaacggtgaaatcggatgaataatttaagagaaaattttatttaaagcatagatgatagtaatatttcccttacttgctcaatggattaatagcaaccaaaactcctaaagtactagcgcatgggtgtctctagttaaagactagatttacggttttgtaaacgtatgcttgggatgttttttgaattattataaaaaacgtatgtttggaatgtttttttgaattatagagaaaaacaaagaaaaaacaagaaaaattgtctaagcccaggttcgaactgggacctctaattaggaaacctataaaggctggcgggctggggcgacgctggggtgtgccacgttggattttaccgtgacgaagttaccgtgcacgcggtgaaattttgtaaaaaagccctccagtttgtgcgtaattcaatcgaggtcccccacgaaaagttcatttgaagagtcagttcacggataggcccttaaaaaagtcggatattgcatgcgaaagagagaaaattcacgaattaggaccgcgctctaaaacgtggaagcccaggggttttttcgaaaaacgacgccctaacccactcacccctaaccctagcctataggtgtccaaacgggcggcacggcccggctcggcacgggcacgggtccggcacggcccgtttcggcacggcccgttaggcacggctgatgaaacgggccgtgccgtgccggcccacatgccgagccgccggcccaagcacggcccgtggatggccgggccgtgcccgtgccggcacggcacgcctgcggcccacgggccgttcggggcacggcggcccgtgaaggcaggccggcaggcggcagctgagctgcactggccgccaggccgccagccgccaggccgccagtgcacagtgtttttttttaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacttttattgatgtttatatcattacaggatacaatgatacatgctgcctcgttaaaaactttgtcatgtaaaaactcataggggaaaatgagaaaaccatgacaaagaaaagagtacaactcaaaggtcagaactacttctaacaaaattctactggggttggtctggatctaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccgacaactattcggccacaacatgcgaagaggcgtctcacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattactccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcaatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaacctcgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgcgccgctggcccgctttcggcctgacgggccgccggcgaaacgggccgtgccgtgccgcgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctaccctagccgctgctcacgctctttcctctctctcgtcttttcctctccctctccagctcccgctgccgccggctcgtgccgcctccgcctccccctcgtgccgccctcgacgacgcccgtggccctcctcgacgaccatagtaaaaaaacccgtaccggtggtcgacccggtgatctcgttggttcactggttcaccggtcggaccactgggtcagccggttcaatgctgaaccgaaggcatatgactattatatgttttctattagacaggatgagttagctagctaaatggtaagcatgataaggtctcgacgcacaggttatgggttcaaatcccttcccacgcatgttttctctcctattttgcataaaatgtaaatgggccgtggggtaggatgatgggccttacaagtccagccccaagtgttagcccaacttgcaatgaaccacctgttcttatgagcccggttcaccggttttcaacaaaaaccggccagttcacccggttcttaccgggtcaaatgcacgagcggtctttttattgaaccgaccggtgagagacctggttccggtttttgccggttcaaccgccgggcccgtccgcttttttacactatgggttccacctggttcacacgcgcgggggcggcggacggagggagggacggcgccgctcgggagagggagcgggagcgcgtgcgtcgccggtggccgagccgagccgagctgcgtcgcggtggtgctctccgcgggcggcgagattcagccctgacccgaggaaggtgaggggaattcttcctcgggggtgggtttggtgcattccgtggtgtgagatgcgggggatgaacaaggctttcggggtttgggatgtcgcggggatttgggggcggtgggtggttttcggctgggaatttgcggatttcgtggctgctagtggtgttcccgtggctttacgaacagatgtatatgcttgatctcgtgcggctttcccttctatccctctctccatggtttgctcgcgttggggggtttcgaaaaattttccctactgttagtcctcgattctggtcgtcggcatggtggcggtcgcctccgcctccccgctcaccgccgcggcggcgccctccatgtgctgctcgccgcccgccttcctccctctccgtgcgcaccgcaggaggattttccgcgcggaggcgatgaagacgcagcaggagaagaagcagaccgaggtggccgtcgaggagtccttccccttcagggagacggctcctcctgatgagccgctggtcaccgccgaggagagctgggtggttaagctcgaacagtctgtgaacattttcctcacggtgatttccacgagtcaaatcggattaacatcaaatttgaggcagattttgttcaaattcagattttcattgctgtaaccacacacatattcctgttctattcgcaggagtcagtcatcacgatacttgatggattgtaccgtgaccgcaactacgctagatttttcgtcttggagacgattgctagggtgccgtattttggtgaggatctcgtcgtacatgctcgctatagcctgcaggtctctgaatttcacaatatacaagtatggttcctacacagtaatgtttcggttactgtttcactgactgcctgactattgaacagcgtttatctctatgcttcacatgtatgaaacatttggctggtggaggagagctgattatataaaggtgcactttgctgagagctggaatgagttccatcacctcttaatcatggaagtacgtctctagctctttctgtctgcacatcagtgcatttatatatgctgtttcttcctgttttgatgtccttttagattatgttagctgttagcatatcccgttttctttaactgaatataatctttaaaggaattcaacctactgcttattgacacattatctgtttttttttaatattttggttatggtctttgatgttctgactttattcctcatcttggttcatattaggaattgggtggcaactctttatgagttgatcgttttcttgcatggtttgctgcatttttttactacttcatgactgttgcgatgtcacgagccccggcgtaagaacgtatgggatatgaatgtgtgattggcggtggacgagggggtttggtggaacgacgacccgtgatgaacagcaagggatgagcaaatagagaataggagatgagagaactagagattgaatctgcttaattaaacgccaccgaaactgtgcctctaaataggcgtacacgaattaaccaatgtgctaaaaacaagctaacaaactgataaacagactaacaatctgaactcatccaatcgccgcactgtagtcatccggcacgcagcttccgcgcgctactccgccgttccgcccggcgacgcttgcggaaccacacgccctctgcgacgatacgtaatcccgaccatgacatgcgatgtacatggtgagcccaagaatggcatgtaagtgtgcacctatgccaattatgaagtaaaacacttcatttttatttccatgccttttatgtaatgataacgcttggaattgtttatcttatatacataccgcttttctgaatgtgttgagaggcatgcgtactcaacctatgacaagtttattaagctccatgaaggtaataaaacgttgatggatttgacatctctcctgtcgtgcaaaattttatcatgacaactagacatctcaaaatttttgttgctttatctaggttggacagactttgtaaaccaaagtggaaatgaggggaccgggaaaactaagtatttactttttttatagggataagtttatgcctaccttttgtcacagattgcccttgtgtgaataatttgatacatgcgccagtgaacttatgttatatcagctatttacttcaattattggcaatcaggattcaggcatggtgtttattttagttttataggtatcgtgtgcataaattcaaaaacatgtattattcttccatttttgattaagatgtcggctctggtatccttttatgatgtactatatttagattttttttccgtcctacatagtggttacttgaattgtgggagagttgaaacatacctgaaaaaattagcaaagctagatcccctaaggtctgaacaccaaactggtagactctttgcattactatccattcagaagttgatgcattgtacattttaaagggtgcattttaataaaccaaaatgttgaacactgcaaccaataacaccatgtctacccgacctgtccaccaactagaaatttacaggaacatcacactctgtcaattatatttacgtatttcttggcaaaataacatcctgatctgacctttgactgcagaaatgtagctgatgccatgcctgcatgccacccatgagtggcatacctaatatcaatatcaaggaatgacttcctgtagtgctcttcttccttgagagcacacgcaataagctatcaaagagtatacagcttttccaagaaaacgaaaggtagagattttttttatcaaatatatcaacacatgacctatttgttgacttgaaaaggaggattggttatacttcaggtttcttggtccttgaagtgggaattggatatgcaaactgacagctccttttctgtttgtggtgcagggaacgacagagaattgccactctctaacccaagaaatatcacaggtatctgaagcaaatcactctctaacgttactgtttttttattctgttctaattttatctggctaggaagtgggaactatcgggcgctggaatattgctgcttctttgaagctccttttttttctgtcacaaaaactatttcgtcgaagtaaatggatggttaattcgaaatgtgcccatcttgacgaaaggagcctagcactaccaccacatggccatggtaggctgagtccagaatagagattagattccccaatccatgacatgcaattcgcaaaggtgatactcagattgtgtactgtcaagagaatggtttcctgactttaccatccacaacagagtcacactaatgtaatatttttatgtaccattatactacaacatttttattttccatcaagtttttattcctcatgttcttcacatcctctgtgcttctctggtgatttacatggtattacttcatgaatttacagacatttattttctccatgttttttccccatgtatctatattcacactgctgaactttgcattctattttgcagttgcaagatcttggcagcacacttattgagttgtggaacctaatggacacaccaactgctgaacagaaatgctttgaccatgttacgtctttgatttcagtctcaccaaatacaaaaatgccccaaggatgccttgcacgtgaacttattgagaagtttacaattgatcgaccattttatgttcttttgctttatttggattgtcattgaagctaacttaatttttctgtaaaatccggttgaggttaagaggttgaattcttctgatcattgtcaatacaactatagcgattcattgagggtaagagctcacataacttttatgtgctttactaatctttttcgttataccttccatatttgattactatgcagtagtaattatttttctgatcattgtcaacacgactacaaatatattttatagtagaacctctcatgaattacactgaaaaacaaaggccgaatcatcgcctgcacaattgatctttaataaattgaacctgcccacactacctgtatgtgccacagttctatatagaaatttcgtgattagctacgttatgtaatacctacaccaaccatcctataatactatcactataatttcattgtaccaatatctactattaacaccactattcgcttttatcaccggcaccttccacacataaaaatacttatagacaaattttcatacaggtggacattcaacgaattatgtttctgcgcaaaaaatgtacaagccacacctgatctaaaaaattacatcaatgttattaagcgtttcctacagcattcgagcaaattctatgctgagactgttaacaggacattccttatgcagaatagagttgtaagttcgtacacctcctgttcattccttcaaatttataatacatactgctcgttttttctgcgcaccacagaaaactaacataacatcccagttgcagtactttgctaagaattttcagaggtacatcgaaccactgatgcacaacagaaaaacaatcaacatttaggtccaagtagcaggaggcatttcaaccgagatgattctgaacatgtcaccagacgggcgctgcaacttggtgaaaggatgggcagatttcgcaacaaataagaacatatctcggatcagtctgcatcttccacttctataaaacaacttacttggaagctactatcgatgttctctaaccaacataagaatgctcttagtcatgctggaggcatccttttgt

SEQ ID NO: 46254 - DNA, 5042 bp, Oryza sativa
ttaagtacgtgataaatgggaaagagatggttgcctgtaaaaggagataatgttctgatttactcctagaacattgtgagtatgtgacataaaaacctagtctacacgaccatccaagcctccaaggtatgtgaattcttaagcattttgaatagttccgtaggatttcataaggtcaatttttttttcaatagttgtattgcaaaactgttctttttctgattatggagtttgaagcttatctgcacacttcacaagctcctaaatgatagtttaaacaaaactccaaaatgataattttttgttaaaaattctatattctaaatcaagctttcaactttatattagttaattcattattttatacttttaaatagctattacacaaccatattatctatcaatccatcagtttcagctatcttaaatagatgcttcaacttatgcaaatgtgtattacatctgactaaaaaccgttcaactgcgctcctatttactgctccctatgttcatattccttttgacttttactctattcaaacttctttagattttactaagtttataaaaaaataataatatctatagcaatatattagttttattaaatattatattgaatatattttgataatatgtttgtcttgtaaaaaaatattactatatttttttataaactgaatcaaaataaaaaacgtttggctagaaaaaaaagttaaaacaatttataatatggaagaagtattattccatacaatagtactattataaaaataaaaccccatgcttattcgatttatttttctatggtcgtgctaataaatatttatagattcatacaaagaaacatttttagatggttaaccagcagtgttgataataaacacaaaacagcagcgtgcaggaagccaggaagaggaaaaccgacggcgacgggacgcaccgggccaaaattttcaaacttgttactagtactgttctcttcccttctctccacttcgcaatggaaaaaaaaaaaccgggaaaaaataaaaatgtttgggcgtaccacggtggttgtacctagcagcaacgcgggagcacgacgccgttaacgcgctcgcccgcgcgaaatgacgctactaccctcgttgctcttatccactcgcgcctcgtaccaccacaaccctcccggtttccctcgtaaatccggaaaccgagcggaggtaggatggtcaattcaccgcgccgtccgacttccccaccgtggcgttggatataatcttctcgtatcgtctcgtccctcttccgttttttcccccaatttctcgtctccccccttcctccaatatatcggcggcgatcccggctcgaggagaggaggctccgccgcgattttttcggtgtcgcatcgaaattatggtgagttggtttcctccctccccctaattcccgatccgcaattcgattgcgatctccattgcttgggttctgccttttttgggggaatattttgggcgatatcggcgaatatatgctgggctctcgcgcgattcctttttgattatggtggttggtgttcggtgcgttttggttgaggaattttggctctaattcggtgccattaggtgggtttgtgtttaatttggggatgtttctgaattgtttccgtgcgtttcagattggggaatgctgtgtttcgccgagattttctcatcttccatatgtgatatcagattataattgtatgtgtttttgtttcgctgcaaattaattatattgatgcgaagtttctctgcatttgattgcagattttctatgcattttaggctaaaagtgctcgggtctgaaacctacgtgcttttcttgtcgccgaagatggtgtcagcaaatatacatcgacgcacatgaacagcgatgatgcgttgctgaatccgtctgaagctgcaataagcatgacggttttgcaaattatgatactaaaccattcatgctgctacgccctcgtctggaactttcttcttctgatgcaaccgtgcacaagcaaacctagcctcgaagcgattgtgatgagttttagaggtggtgcgggttcgatcacgtggagttctattggtgttcagtgactcttggcaaaagttctttgtaaaatcgacgacgatggaaaggtcagcagtaattatctcgcgaatcatattatttgttgcgtgcgcactaatttctgacatggcatctaatttcttctcaggtacaaagtgataagggagataggcgatggctcctgtggtaatgtttatagggcttataacactgaaacaaatgaaattgtaagtgcagctcttggcatagtacatatggttacttggatcttttcatgttaattcagttgccttctgctccttatatctactaacctataaaggaacgaacagtattatttgttgcacctaatcacctatgaatttcccacttgagggaaatgctagcaataatcatctctacatcaccccagatggctacctattcgagcttgcaccttgtttgttggcttattatgttaacatttccccgaatactgtgcaggttgcagttaaaaaaatgaagaggaagtttttccaatgggaagagtgcattagtctgcgagaggtgaaggtaatatatctcatgtgttatcaaatgaatacaaatttgttttcaaatctgtgtgcttaaaaggagaaccatccttctgcaggcacttcaaaaactgaatcatcccaacattgtgaagttaaaggaggtgactatggaaaatcacgagttgttcttcatttttgaaaacatggttggtctcaagtcattcttggcatacttttttactactttctttatgagcaggaaaaaaaagaggaaaggctaaactattactagcccatatcgctatgatcttctagagttttgtggccagttccattaaaaatactggcatgaatattctatcgtctacaaattacgtgtatatcttgcggttctaatgattatagttctatagtttgtatgcctgttgcatttgttgtgacattacattacgtgtatatctgctgaatcttttggttcacacttctctcacctggagctgttaaatatttagcttttcacttactctggtatcattgtttcttttcacaggaatgcaatttgtatgatgtcataagagaaaggcaagctgctttctcagaagaggagatacggaactttatggtgcagatactgcaaggtcttgcatatatgcataacaacggttatttccatcgtgacctgaaacctggtatacctttcgactatattctgttgaagttataggctgtctatataccctagaagttaattagccttctctctttcctctttagaaaatctgttggtgacagatggcactgttaaaattgctgactttgggttggcaagagaagtatcttccagtcctccttatactgactatgtttccaccagatggtgagtttgtgtttcaaatttatctctgtataaccagtgaatatgtatacaccactttatccaaattattgtgaaatggtgaaggtatcgagctccagaggtgctgctacaatcgtcagcttacacacctgctattggtgatgcctattatcccagcccctgcattttactacttccatttttattaatgccagctcaacatgaaatttgagtttgtgcatataaaactcgcattgcatgaaactactgaattatataactgatagatgtgcacttcctcagatatgtgggctgttggtgcaattttggctgagcttttcacactgtctccacttttccctggtggaaggtatgtatgatactgttgtttgggtaccatgattatgttgcctctgtagttggtaatatccataatttactgtattcatgtattgatgcatatatgctgtctgcttacgcatgttttgatttgagcagtcaacagatcacccttttgatttctgttgaagtgaactcttgtttcttcttttggtgattagttgtgttctttttattttgtggatagttggcctgggaattttggggatttcatgccactatctctgagttgcatttattaattccaaggctgtaaaattattgttgttctgaatactgtaacaacaatattttttccctcatgttagtatttttagctcttatgatgcctatgttgttttcttatacgattaagcctatacttctccatactttttcttaagcccagttcatcttgcacagagtagacctagaccatttgtacttatatttccttgtttatggtgattctgctttgcttttaattattttatttgcttacagcgagactgatcagctatacaaaatatgtgctgtgcttgggacaccggatcatactgtctggccagagggaatgaacctgcctcgttcaagcagctttaattttttccaggtgaaattacttctgtctacaaccattaggataagttgcctttgacactgatttccttttcttttgcttgttcaaaagatcccaccaagaaatctatgggagcttattcctaatgctactttggaagctatcgacttgattcaggttagttatgacacatgagtcttgtttcttacatgtttgatttatatattgttatatgaaccccatgtttttttgtccagttgcttatgtaagtactaacatcaagttaattaatataacatcttacttatatattatattgttttaagtaatttaccatgacaattcacaataaattgcactaattactagtttgtaaatagtgtaaggtatgggtttgtaacatgttgatgatatagcttttgttgcttgatgttatttgtctgagaataatgctctatattaacatggtagtatttgtcattctgacagcaactttgttcctgggatccacgaagaaggcaaactgctgagcaatcactacagcatccgttctttaatgtactaatttacacattgagttattcatgggaactatacttcgcttttctttatgtacctaagacttttgagt

SEQ ID NO: 46255 - DNA, 1564 bp, Oryza sativa
ttttgttttattggcttatatttccttttctgcttgtagatttttctaacaatgttccagagcatacaaaagaggtgagattttatttgcatgacgtgggaacatatatttgcatgagagtggaatgggtgttatcctgaagttcgctatcatatcatgcaggaaattctgctgtacccaggatttgaaaatcctcctgtgcagtcaggtccgttctttgtctctctgccctcctccatttttgacttatagttcaggactgtatttgcttgcttttttgcgccaacagccagatggttatagatttaattgagatgcgtggtgctcaaacatggcttcctttttacattatttagcagggttttggcctctcgttgcatcagaccggccaatgggcgatgttccagccatgtcatcctggccacaggcatatgtggttgacgggtaagcatcagcatgtcctttacgaatgagttaatctcccaaagccagacttttatatccgctaagtgctatcattattctgtacttcagccaagccacacttccagctgttggattctctggttctccattcggtttgtcccccttacaaccaaatctgtttgagaaccgttcgttcgcaacacccatccggcaggtcaatttcttctgaggggatacaattaacagattgagcactgaaactatttttcagtccatacattcaacttgttcctttatacattgaactcaaataaacgggggcggcagatgaaatgtatataatcgtagcttgtttcctttttcttttctccccatctaaattcccctcacggagtaccctataatgtcagattctatatttatctagattgtgaatatgtgactttccaaaacagttttgtacgtcgatttgtcaaatgataacagcaagtatggatgagcgataactgacgatttgtgaagctgtttttgtatgagatgattcctgtgcacagagctggtgtgtgtgtcttgtgctatgaaacttgaaggcgtgtgatatgacctactgttttgattttgctgtcgtggtctagtacctgccatatcctgaactgaattcatgtttgtgaaggctcgcattgatgcggccaacgacaagttatgggcttcctgggcgctggatgaatctgacatggatgtaagggtgtagttcacgccaaaattgaaatgttgattgaaattggaacgatgtgatggaaaagttcaaagtttgtgtgtgtgggaaagtttgatgtgatgaaaaagttggaagtttgaagaaaaaattgggaactaaaccaggcctaacttgttggagcgatggcttgtgtaccgctttgttttgtgggtgtcagctcaatctttgtgcctaggcctagctgccactgtgcaaggaggcatcaaaccaccactctaatctgagagttaactgcacactaaacaggttttagccacgcagaaagcgagaggcagcaagaacatcgcagtcacatggccaagcaggaggcatttgcttgctggcagctggatagatgctgtgcaagtgtagaacgcgcaa

SEQ ID NO: 46256 - DNA, 4948 bp, Oryza sativa
ctgcaaatgggcggcgagggggcatggaattttgcaggcggccccctggccgccctgggggagggcgattttgtactgtgctctatattttttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtacgtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaagccatatatctcctcactccatgtatgaaagattgcttctttcctgaaataatttgagacgtacacattgggagatatgccacaatctccggcagcagcaagaacgtgtgagcaagtaaggtgatgaagcttcggcttcatacaactgcaggtacatccaccatccgccttcaagacacattcctgcacggcttgcttgcgatagataccacacctgctcctatcaacacacattatttcataccgatgcacttgtgtgccttgagcaacaactctatgtctcgtgcctttttgattttatcttccatgtacttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgtttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgatcaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatatgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgcagtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttgacaggggaggggctgggctttataggggggaggcaaaaatcgccctcccccagggcggcaagggggccgcctgcaaaattccatgccccctcgccacccatt

SEQ ID NO: 46257 - DNA, 6173 bp, Oryza sativa
tcccagagggcggtaggcgactatttccgtcaattttcaaaatggaaaattatttttgtaaaacttttaataaaaaaaattataaataaaaaaaattcgttgataccgtgtagtacttgaattatatacacgtcattgttcatgctagtacttcatacccaaaacatgttgctactaacatacccaacacactggagtacttgaaatactagtatagtggtagcagaaaacgaatggtacagtacctggtcaacaaatgatttttgcacgcaaacaaatcaccaagaacgccatactattatgtgctcgctgtccggccaagtggaatggacagtaggcaatggcttcttttgggacttctttatggagcccaaacaaccatgttttcaatgccactgaaagctctgctctgctctgctcatctcatcccgtactcttgttgactatgacaacttgacaagccaattcccttccttaattacccctgtaaacgaaaatcaacatgattaattagccagcttatcatcagtcacgtttattactcacactgtcacagcaaaggcatgtgagtgacttttattagtgcagtagcagcagtaaagggaatgcacatgaattgcagttggtttgcacgccaacgaaggtgagagagagcagtcacacggcctaacacaagtacgaggacaacagtgcttggtcatgcgttacacttcgattcgatgccgagtacttataccaagcaaggccatacatgtgagtggtgctgcgtgttgactgcggtcatcaataagtttggtgtgtccctcccctctgcacggagtttttggccaattctagttcctggttatcttggataaaacatgcatcatttgattatggacagatattttatggtctagtactgccttacgtagaaccagcggttataccggtggcgtttgaaagatgccacttatgtcttctctgaatggatgattttttagatatttcgggagaaactgaactaaatcatgtgaaaaaaaaattctgcaaatttgctgcattatataaaggagcatgagtccaacctatttagtaattaggattgcgatttcgaacttttagggtatggtacatcaaaatatctagaaaatagtagtgtttggttccttttcataatttaatcttaaccatctatatgtcatatgcatttataatacactataaatttacttactgtagttattgatttattgctataaatcttaatgtgcattttaaccgtataacgcggaaagcaataaccattggatcctcacattcccaatacataaccattcctatgtgatgtgcaattgcaattccacatcaactatttttttagataatgtattttttattaatctggcctctatatctataaaggatatacacgtccaaaattccacatcaactattaaggagctcaaaataatgccttttaggcattacgagtatacggattacaaattattctcttcgaattttatttgaagtatttgtaaattccccactgcaacgtgaggggtatccactagtttgatctaataccttctccatacgtttgatgtccgtggcttgctatacttatatttactgtatattttgtgtttcctccgttacgtgtacttgcaatgcccacattactcggcgatttacgattttatacgtaatttttgttgaacattttataaataatagacatatcaccactttgtattatgtttttacatagattattctatgtttctttctaaaaacacctccttaccgtgtatgcattgatcaaatgtgtgaagtaaatttcaaccaaaatggtattaaacatatcgattctcagtgttatagtccttttttttataaagcaactaaatagacccacaagcaacaatagttcaaatataagaaaggaaaaaaaaacatattgctttatctcggaggacatttcgatcataattccaacaatattcagacgtgtgtatccaacacacgtgtatgcgcgttatggtactaactgtggacaacaacactctacacgagacaatatgtaacattaggcgacaacaaaaacgacggtggaactgtggctgccaattccactagtccaattagggagcactgttgcgaaaaaaaaacttggtagccagtcagaaatgccaaaaaaaaaagaggaaatcgtttagggtaggagtcttatttattgatgataagtgtggtgtacgtgcatatatacatccaacaaatactaaaaagaacctattactcaaatggaggaggaagcaagctaaagtaaaaatgatccctacaagcatgagcctaataataataccataacggaagaacaataatccacgcgaccacgcaggcaaagaaacgaaaagaaaagaaaaccccaacaaaaaaacaattaaaaaaaaggagtaatagccggaaataagacgaccatgtgttgttgggcgcggtgaggggcccaacccagaaataagcgaggcggacctgggctatatatacccctacccagtctcctctttccggtttcctcttcccttcccccttcctcctcctcctccccctcctccggtgcggtgcggtggagtccccttcctcctcgcgctcctcctcctcctcaaccctactccttctcctcctcctccgaatccaaacctgacacacagaggcggcagcgagaaggtggaggagaaatttgaacggaaaaggttgggggatcgcatcgcaacgaacccagcactgcagcccccccgattccgattgggtggggggtcggatcctcggatccccccgcgccgccgataattcggccccgcccccgcccagatccccgcgattccggcgccggcgccggggatgagagccccgaggacatggtcgccgtggcacgagtgaggcggccccggttgctgcgccaccaggaggaggggaggaggaccgcccgcgcccgcgcccgcggcggcggcggaggaggtgtctgcggtggtggtggtggtggtgacctgaggcggaggagggaggaggtggtgggtgatccggggcccgaggcggccgtgccatgtctcgctgcttcccgtttccgcccccaggatatgagaagaccgcccgccccgacggccagctagcctcgcacctgctcgaaaaggtggaaaccccaaacaatctcacactccccccatgccacccccgtctccgtcctcctcgctccattgatcgctactagtacacatgcatccggggatatcttaacctgacttatgctgttgcagttgcctgtagaatttcagaaccaagccgtaggtcacgttctggtggggagaggggaggggggataagctagccctagatgattagggctgatgtcttaggaattttcagctgctgggctactagggttagatcacagccttgtcggctcgcgggaggcgttatcgctgctcacggggatctcacgagacatccatggaatttagatttgctagaccaatgctttcctaaaagtgtccttgatggcttgagctggataaattaggtctttgactaagcggttaaaggtaggcgtcttcttttggatggatcgacggaagataatgtagtaacgtatagtgtttattcattggtcgcaacttacgtcatgcttatctcaactatattagataggctagtggattgtagcatatttatcttgccactttgctagctgaaacctactcgagtcttcatgaaaaccacgacgtgttgttttgcaccattctgatggctgcgaagatggtgtggtagaaaaaacttcgttggttattttgtttgttagaggttacattcaattttcaattatgtcatggacatgttgatagaagattggacagtcaattactacactccttttatggtcttgacatgcatctttgtggaagttacaaagctagcatgatgcatgttatgctaactttgtctatgttaaaataaagttgtacgttactgaccttagtaattgtctgaccagaatcactatggtggaatgtgtcttttattaattgtcagtctcaatagtggttgttctaaatcaattttagctttcccttctaggctgtagaccatatatgtattccagcatttgtttctatataatgctgatttcaatcctctctcttcttcttttctatataatgctgatttcaatcctctctcttcttctttccatgcctgattatgtattacaacatttcctcactaagtcattattactttaggtaggcggaacttgtgcttctgttatgttgccttcatggttgtgcatatacatgattctaacagatttaactgccttttccctttggtatacctgtcctcagtctgtctttgtctatgtgctgttcctgtggttgcatagatcctcaaatctgtcaatctgcttcgtgcatatttcattctgcttcaatttttttttattacagctaacatgttgttcacttctgttcatgcttctgtttattgtccatattttgagtaagtagaaaatgcatttaacatgaaagttcaaaggggctaagctgaagtggcaacacaaatgcactaaaaatgaaaagatttggactttaagcttatgtctcacaaaagcaaatgccatgtttgtgtgttttttcttttattcttctggctgttggctgtgaaatatgcctgtagtgtctatgcattccatccgtatgataattgctaacattatggatgattttgtatctatgcaagcttacaaagttctgttacattctggcatcagggaactatgtcacacttgagttttactcttaaacaacttttagtggtgtcaaacaagtgaaaacaatggctatgatacagtttatataacatgaatacatgatatgcaacacttagtaaaaatatgctcttatttagtgattcccccactttgttttgtcacccggactcacgcttttgttaatataaaggtgttttctccgctaactatttgtaggctagtagtttaatttcaaaacaaaggtaactcatggttgttgcatatcttttgatctgtaacttgataataattggtacaattctccaaagcaaaatacagtgtgtagcttcatatacagaatcaggcgcacaattagtcttggatattgcagaaacaattagtttgcatttcaataggataaatttgttaccaaaaaatcctgcatttttttgtctcgtttgtttaaaaggcagtagctagccaatcttgcttataattattcaatatttatgtagtactatttcactggttcaaaaataccatttccgatacaacttgataaggatagtacagcggaagccatttatgatgctacttattggcttgtagtgttaatgatttacatctcagtgactgcagcatcggtaacttgttgttcagtagtatgtctttaggcagttccccaggacagtctctcttgtacgtaaaagtcttattatgttaccttggtcatcctgtgaggttaatgattatcagctcagagaaattttcttttgaaaatcatttcaatatgttcattcatgaatggtattgttgacatacatcttcgcgttttttagttatttgttttattctcaaactctacttaactgaaaaaccctccttgtttcaggagaaacacaaggagaagaagcataagaaggacaagaaggacaaagaaagaaaagaaggcaaagacaagaaggataaagaaaggagcaaagacaagcacagagataaaaaggatcggaaagaaaaacacaaagacaagaaaaaggacaagagcaaagataaaagcagggaattagaagaaggaactgaaagacacagcgaggctctccatgggcaaaaagttggagagagcagcaggaagtctgaagaaattaaggatcctaaatccagggaggacttggtcacgaggacacaaaatgagaaagggacgacgaatcaatctgttcagaacttttctgtttcaaatcaacgaggtcgtgaaggctttagtgctgcacctgcactggagaatgaaagaactgcagctaataaaatgcatagtcactctattaatgcttcaaggaaaactgaggtcttgggacagaagagcatcagcatcaaccaacaaaaaaatgggaca

SEQ ID NO: 46258 - DNA, 2289 bp, Oryza sativa
gtggaaggatattgcagaataatattatcgatccaaaacagattaattcaaaacctccaactatggagaaaattacagatggaagaactgaaaggatggagaaggtcagagatggggcacctgatgttgcaaaggaggataagaagagtgatcgacacgagaaaaagaaaaggaaagagaaagataaacacaaagagaagaaaagggataaagaggcaaagaaggagaaagacgaacaaaataataacaaagagcatgataagctaagagaaaacagtataaattatcaggtagataatagtcttcacatgaagtcctcaacccctcctttagccccaccagctgatgatgcaaaagctgcccaagctgatgaaaacctgaagaagcgaaagaaccacgagatgaatggctacttgcaaagtgagttcattctttttctgttttttctgcacttatcagtattgtatagtgttgtagaacaccattatatttttctatggtacattatattataagacttctgatgatgtacagaccatcatgatacaatgcggcctacaaagttgccaagaccagcccactccaacactcctgtggagaatggtacagcatctcatgtagccgcgccactctcttctgtgaagccggaggccataaatattgaaaaggctataaggcaacacaagaaggaagagaagatcaatggcaaccaggaaggtcaacgatcttcagttgagccacggcttcatgatcctctagttgcatccgagaatggtgcacctactaagaagttgccacacccagacagcaagtatctcagtcagatatacagcattcctgaagcacctcaaatgatggaatggcatgggcacgatgaccaggactggctgtttgaccatgatggcacacaaccaaagaaaaccgagtcagagactgaggccgatggagcttcccaagtgtgggctcagcctctgaagattgaccaggcagatgtcattgcgttaccatacgtcattccctattaatacaatgcagcccaaactgctgggtgctgagtgaggatcctgtggagtaactgagcatttgaacgccaaactgcaacttgtttctaggtgctgcatttgctacaactagtgtagctcggcacaaatgggtgattcatccatttgcgggtagcacttcctatatcctcatgcaccctgctagattggtgcatgagattcatcactttgtgagagttggcgtagcagctgaagaatatcctgagtgaatgctgcgtgggaagacattgtccaattcattgtcagaacacgccgattatgtaaggggttgatatatcctgctgttaccgctgcacaattttgatctgtaaggtgtaaaagcatttttataaccaaaatgtacattagaaagaggaggatggggagagggaggaggaagactggaggattcatttatacttgagatggttccacatgctgttggctgagagtctgcttctgctttgatttatcccaaagtttggctctctacctttgacgtgccttttgtacatagctgttagttttacaatagatgatgtggtgtccgaggttgtaacttgcttcttgcgcggatttcatgttgagagtcatgccatctcctgtcacatacattttgaggtacctaccatctgaagaggatggatgactgttaatttcagttgactttaccagtttaacttctatcccaaattgctttgtatggtttataagagtagcttgctggcaactgtttgcatggacatgtcgtttttctaatggatttttttcgctctgctgtgctgctgttgcctttattccagtattgtttaccaagcttatgtctccattaaactttacatccaacatctgttccttgccaaattttaaattatcagtacccttccactttgcatttcgtgttctgctaaaggatcatggctattaagtgcatataatgcccatagacattaaatatactgcaaaggaatacctagcttatgctaatttttttaagaagaaatggtgaagtgtccatcaagacaagtatggtaccgggcacgctctctgcatacagatacggctcactaaactcgcctaatggtgcacctaatgtttatcatcagtttgtcattagtcaagtcaatcatcgagcgaacaatctaacaggcagtcaggcaatggcaaaattagacggcacggctaataagaggagagagccccacaaagcggtaagtgcagtgcatgacagcatgagcatgacaagact

SEQ ID NO: 46259 - DNA, 3607 bp, Oryza sativa
agaggcaggtgcacttggaaaggcgatagtgaggcgtgtacttggaaaggctgactctgcctatgcaattgcacaaacacacatcacacagtgcaatggcaatgcaactgcaaggcagccaaaaagggaggaggaaacagaggagaagtgatggtggtggccgactggccgtgcgagcgtgcattgtctaacgtgcatctatctatccccaccacaaccaccgctttggtggtgagaatgagaggcattctgctcctgggatgggagtgacattctctgcttccagtcgttgctgctgacgactgcaatgccatagcagcaatgatgcttctcttctcttctcctgtctctcatctcatgtactactactaagatcaatcatattcagacgattcctacgcataagctgctacttccaaatcattatcgccatcagccttgtgttcatctgtactagtgtgccaacacttgtgctaatgtaaatcaatgctttcttggggccactagtaatggatcaattgctactagtagtcattaattcattatgcaccatgacaaattgacaaattgatcatcactagcactgtgattcttccaagtggaacctgacagctcaacacgactacacaataggtaaacaggaaaaaagagagaaaataacaagagatgatcccttaaccaaaatcatttttttaattatgctatgaaatacaaagaagaaaaatctcattctcctaactgattagattttggaaggcatgtagaccgagcaaacaagaagaaggaaaggaccaagaaagaggcatatgctcgtgattccacagccagcgacctgattccttccctttccttccttccagcatgcagtagtacggacgcatgcaggcaggcaaccaccaatctgtatctgtaatcagcatgctccatgcttgcttgtttcggttgcagaaaacaggaggattgtcttgttcgtttgcaagcatggcaaaggccagcaacaaccaatccccccggccatatatgcatgacggactgtagatttgttcatatctacatgcatgatctgattatcctatcattatctgcctctgattttaattatgcagagttgttttcacagggatggcactccatttcttgcttataccgagttctgaattcttttttttgttacacggaaaacacatacgcacgtacaacattacacacgtataacgtatagcgcgctcacacctattattacagtcccccaacatgcgctcaaagagacaaagaccaacgtcaattccttggcctcattaaaatcctattgaaaaggcacccatgtatagcacctgaatttttctattgaccacatgcatgatgcatttgtacaactgttcatcagcagaaaggtgctacggttagtatggacctccagttgactactactactacaactgtacagtgaaggactgaactgatctgatcaccagctatactggtatcaatgtaggtacaggtagtatgcatatgtatgtaggagtgagcaacttagcattccgtatcagtgtagggttggatcgacgtgttcactgcaacaaccataccagcaacaaccttcctccatcttgcactgcactatcacactacctcttttagtcatctcctcttttcaattcgcttgccttttcttttcttagtgctccagaatcgcttgcaccccactccagagatcgatgtcgatctcctcctcttctcctgctgctgctaattctctccaagaactgaactgcacctggttggttgttggctatagctccaattctgcagctgcagatcaactgatgcaacaattcagcatcagcatgtctgaactctcaactctgaagaggccttgcattctggacccatttctgcatggcaagcttggtcttgaaggcaagacaaggattcatgtggccgtttgtttattgtgacaaatgttctgcttctgccaatgcgtgcgtacaagtatttctcctttataatgtctgtctgcttcggcagcatgtgaacaatccctttcttgttttccaaatgggattaaagaagaaccaggtggttgggttggagcagattcagagacttgctaaccttatgcaaatcaatttaaattatactacttgaagttgattcatattgaagattacgaagttgactctggaggagatccagtccagggtagatggataaatcaatccatcacttttaccctttatacctgctagattttgctatggactgtactgtcggctggctgtggtaaggttcattcttgtcaaccttgctacctgcttcaccctgaacattttcctgacctatcaagtaaaaaaaaaacagagaggaaaaaaagacgcaattattagggaatgatctaatatcaaataattagaaggggtgaggcttcgaacccagtcgtctagcccaccaccttgtggagctagctggaaaacccccggatatttctccagagagaatatgtttatctagataaaaagatgctaatactatcttaacatggatgtcacaagtgtcaggtgcacttaaggtttgaatttttttttcaagtgctagcatgagacatccaagagagaatttatgtaactttcaagtgttaggaatgttgtacaccatgaaagagaggaagatacactgttgatcatcatcatgcaccagcactagcaaagcagcaatgacaaaattaacaaatccaaaggcaatcaaagagtacatgatacatgtacaatcccctctagtaggtcctaaacaaagataatctggatcacaaatctcaaactgaggataccataccatactctaccacgtacagatctctgtctgtctctactttctctctgtccttctctctcaccaaacctcaactttccccttctttcaggcctccccctctatataagctgccaatcatgcatccttggcaacaaagccaaaaacccaagaaaggagacactgatcattcttgccatatattctaccatatatacatacatatacacacaatttctgtatatatttcttgctaaccattgttgctgctagttgcttcttcttcttctcctctaccttgtcatcgtccgtagtagaagtaatcaagaattcaagattctcattggctgctgctgccatgaaggaacgccgcggcagcgccggcgtcttccccttctccatcggctgcatgtcgcagtccgccgtcgacgtcgccgacccgcacgacaagaagtcgacgacgacgacgcagaacgacccttcctcctcctccgcctccgccgccgccatggccgccgccgcacagagtgagttcttgatcaccgagtagtactgaagatgataacatcaatcttttcaacgacatcattagagtacgtagtgctaacctgcaattgatcaaaaggcgcgagaagaaggcggcggcgagaaggtgaaaggcgccacggcggcggcggcggcggcggtggcgtcctctggcatcgtggccaccggcgtgcagcggctgatcaaggggatcaagagcctgtcccagattttcgccatgtacgacgacgaggaggaagacgaagaggagagg

SEQ ID NO: 46260 - DNA, 23589 bp, Oryza sativa
gcagtattagctagcaaaagaaaagcattattactgctgcatcatgaatccatgcatgcatgcaactgatgaatgattaacaacatgcaggcatggggtagtgctcttgatttgatttgcatattgattagtagtttccatgtggctgtgttgaacatcatttcaattctctgaatgaattggtactacatgcatgcatgcatggctgtgtttccctcttcttctttttttttttttggtttggccttcaattcatttggttgggcatcaacgtgttcagtagtgtgtacatagttacatgggcatgtgaacctgtacaaattgtcatcaacgatattgacagtgcttgctatctgtaataatctctacatgtgagcttcataatcttcttcttttgttctctctccccttttcttctagctctctgctgctttctgttagcatgtgatcctagggattaactgttcttgtgtaattgtcttgtcagtagctagctcctgatggtaataaatttgctgctagaaacaccacattaatcatgcattcaagtctctggtggctcagcaacgccggtgtgcgaccaagcgtacacgcatctactggagaatgtactgttgctgcactgcatccagctaattaattactagctaattaccagttgattccaattatgagcgcaatttggttaagtaattaaggctggtacacgtagtaccacagctagctagcttacacaagtgacagctactgtacttttttttttcggttgctcatcacacgtcgagaaaatgacaaggcagattggcaatacaccacactgctttgtcggtagctttagaattgccaacgaggaaaagtaccagacacgtattgccaccaaattttgtaattcctgtaaaaaaaactgaactgtttcctatgcaattcgggcgaaattctgtaatgatatgggtagcaggaagtagaaaagaagcatgtcattttcgaattgtgatcatggctcctgttagatgattaattaatctcaccaaccatgaattaataataggcactgttgctacgtgactcaattgctagtagcttctgtttatgaatttagttgcacttctttttcggacaaactaggagataacaaaggttattaatcagttgatgcgaacaagcatatctttgatgtgatgtttcgtttttatcagttaagttaaatgacgatattagtagtaccatgctaccaaaatgtacgacaattagtggaatgtcagcgacagtctaattgattaagaagcatgattaattagtcagactactaaaacaactatttcgtttttcatgtggcaaataattatgttttttttagaaaatgaaggtatcttaaattcatcactctacgttaacacgatttatcttatgcctacgctagaaagacagccccatgtgtcatcctctgaggatatgttacttttaatggaaatatgaagagtacagatgctgcatgattgtttatcacagtaagtttggattacatgagatcaatcagtccaaaaaatagtttttctgtgattacatgattgagagcaaaacaaacagtacagtgggggcacagagttagctctcaagtccttcttgtttatggtgagctcacttctggcaaaaagccaacccgtgacaaacctaactgcatcatcaccacattacttcttggttggtgattgcaatttataagtggattaagcactaaattaattctagcaactaaatctgctactttagtatcatgccctcaacccctgagcaccaggtttgagtggtctttaatttgcaagtattgctttgtatttagctgttctagacttctagtactagaaatgaatatataaatggtcactgcaatgatgtgctataagctgattctttcggtacacgctgtagaacactcgtgaattcttgagttgatgttgaaacttacaagagcagctagattccttgatcgatcaacctctcaacatgcttctggagaaccatgcaggtgtgcaaacttgtacctgatgctatgttcagattgaggcttccgcttccgttctggagaggaaagctaaaaaggtaaagagacgtacagcaattgttacttaccggctaatttatttgttttcttgaagagacatagagaaaaagaaggatatcattacattccaaggcacttcagacgaaaggttgccgcttctgtggttcgtgctccatacttcatactcacatagatgatagatcacatgccatagaccatattcatattttggttccatgttgcagcttgacaactaatattttccttctcagaacacgaaatgtgatgcgatcatttggccaagtgaccagtcccatcttttacatgattgttgttcatatctgtggttctgagagatatcttgaaacaatagcagagtcatcagttcacacgttgcataccataatggacttgagctcaccatcagctgctccactgattgctatgccgttgtccctgacatccatcaagtatgacagtgaatcctgcgttactatctcacctgggatcagcaccgggatacctggtggataagggcagataagctcaccacaaatctcaccaaggctatcctcgatggacactctcctcttctttaaaaagaaggcctcccttggtgtcaacttgatggagaacttgtccagtgggctactagcaggattctcttttctggaactggacccattttcagagaagtatttttctgacagatgctttacagaatgtacaagcctctgaacatcatgccttctggtccctaagttgactgcaaatgtcacggcctgtgtaccgaccagctcagatacaatttgatgctcctcagctaaaaaatcatctgcttcatatccagataattgcagatctgaagcacttaatgtgatacgcaagggatcaatagcaggaaaatcagaaagaaagcttgataagtccaaaacagatattcctgggataatcctcagctgatgttttgtttctaaagccatagatactggttcatcaaaagattctgcattctcactcagctgagcccttgcggcatccaaagaagagagtagaaggtaacttgggcttgagctctggagcaattggaggcattggcttactttatctgcatccacaagatctccagccatgtgaagcattgaggactgtgtaagcgagcacagaaccttgtgtgtggattgcacaaccaagtcggcaccttgctcagttgcgctgcttggaaaatttctgtgaaacctgaaatgggcaccatgcgcctcgtcaactataacaggaatgccttgcaggtggcaaacattgacaattccttgtatattgctgcatatgccatgataggttggtgatgtaacaagaacagcacctaccttctttctgtcctcctccagttccttaaccactttatccacctgcgatggggtaatacccccagcaatgtcccacccggaattgtactcaggtactatatatttgggcacagcaccagacaaaaccagtgcagagatcactgaaatatgacaatttcgaggtatgatgaggtagtcaccaggggaacaggtagccatcactgaggcctggattccacatgtacttccattgaccaggaaccatgttttaaatgatccaaatagttcagctgctcgcttctgagcatctaaaatcacacctttaggggagaagagatcatcaagctcaggtagctcaggtaagtcatgcaaaaatgtccttgagccaataagttctgacaatgaaggaggagaagctttccctctattatgtccaggaaagtgaaagcaagaaacatcttgatttgcagttgatttcagtgcctgaatcagaggggcagtaccagctttgacaactgctgaaggttcagcatgtgaaccattagtagtagacgttcttggagtgtcccatgaagtggcacattgtactacaacatgccgcatgattgattcctacgggataacagatgcgcgtcattgcatataatagaaggaccaagaatgccatgcacttcattaatcagtgatcaaaagctgcaaagtagatagtttaacttactaaccatggcctgtgttggtaaagcagacgaaaaaaaaacaaaggcagcagccttcagacaagttaaagcttatataaaacaatgtgtatggtacaaaggagcttggctgcattgtgtgagaaattcatggaaggaagacaacaaaatcttcacatgttgcacagctaagtaatgcacatgagcatatatacattaagtgtgcttggaagggagtggtaatagactcatagcttcagcagagaacctgattttattggaatgcttggggccattttataaagcacaggttactgccgactggatcctttctaattcataaatagccattctagcaataacgaaataaataataatagatctatgggttcatcgttattagagctccgagctcatgagcaattctacaaacagcttgtgagcactccactccactacgttacccaaatacggggatacgaatacggatacacgatatgaggatacaacacgttcttaaaaacaccgatatggggatacgtctatttatatttaaaataataaaaagatatagagcgaatacatgaattttaattattaattatgtacttaataactacaagactgtgaatagagatagatagtcatatggcatgatatcaattgatcaatacaccagtagtcaaaaaatgatcaatacaccaaaatcttttagtactatctcagatcagcctataatctgtctgctatctcaggagatgaggctaaccatgaagctcctatggatattgtgctcccatgcctggtcactagtgaatctacagactgcagccacatagccgcaagcagtatccagtagtatgtatgtgctagagatgcactgccacttaagcattcaatttcagaactaactcatcgcccatcggatctaggagaagagataacacttgtactaagatgagaagggaaaacccacaagaaaatcaatcaagacttaaatggggaagaaccagatatggcgtactaatggcgttgggcctcgcggccggtgattcctgaagacgttgcgcccggtggaggagatgaaacaaccggcgactggcggagtccctatgctcagcggcagcgacgctgcgacccttggttggcgatggtggcgccgccggcggctagcggaggccctgcgcctcggggagggatgcgacggtgggtaggatgctcgaactgcgtcgggatgggaacaatagcaggcggcgctccctctcccgtgcgtgggtttggattcgattgcagggaggagtaagaggattgagctgaccttgtgtgtgctggaggcggcgccgttgcccttgttcttgggcacgccagccacggtggagcaaggggagtaggcggccaagctcaccatcccggcaccacctcctcctctccggcgaccgccgccgccgccgccgagctgaacgggctgcaggctgcagaggaggagacgcgggagataagaagatgacaaggagattagatgggaggcgactaatcggcaattatgtttgggcctcaatagctaatgaagcccagcccaacaagctggcccgactaatggtccttctgcaactattttacatgccaaacctgtgtttgtcaggtatacattttattcagaaataacgtgttttcttctttgcggattttgcatgtccaggttcagcgaaattcaggtacatcttgttcaggcttaatctatttccacacacagattttgcagtaaaacctgcatccaatttgagacaccaccagacagtaaacttcagattctgctataaatctgagaatgaagaacaagcacagtcctattttgcaaggctttcttccatcttgtaataattccaaaatttctacaactaaattacaaagtacaatttaagcttcattcattcttcagatgtcttacaagaacacgtatacaacagcagagatgccggtcgctgcatggaatttacctgacaaatctgagtacaactagctagcaaagcactataaaatgtgcccgcgtaatttggctcttcttctgatagaaattaatcaatagtaagctattctatttctactggatttgatcaggcacttgtcaggctcccgaacaatgtaaatctcatccccgacactaccgtacagatcctggttcctgtgccatctccacaacgcatgcgtctcgttcttcacctgcaaaatccaaagatttttcatctcatctcatcaatggtgacatttctacttcatgaagcatctgaagagttttttttttttacctcaagaatgccatggccgaagctgctctcccggtaggcgctgtagtcgggctgccggtcccagcagaagctgccggcggcggggccggaggtgaagttgaagccgcagaagccgccgcccatgaaggggtccggcgtggacagcgggtcagggcagcgccccggctcgtcggcgtagctggtggccatcttctcgcggttgccgccgtcgccgacggagatgtgcacggggccgcacgggtccagcgtgtagttgaacacccggttcgaacgctcgtaagcatgcacctgagtgacacccacagttcatcagagaattcagagaagaagcaaaatgttcagaatatgttcggatgagtcgcttacatggccggtgaagacgacgtcgacggcgtaggagtagaggagctcctccatggccactcgcatgcactctgcttccctgtagtgagctttgaaggtgctgtaccatggcgcatgccagccggctatcacccagggggtcaccgacctgtccacctttgccaagtctttctccagccatttgtactgcttccctgaattcgttatgcaggtgaaggttttaaatccattcaagattcagcttcattttctgacattattatgtttctttactgaatgtttatactcagtaggtgtgtgtttctttcctgaatgtttactctgatgtcctaactgaattcaactgaatcatgtcactgaagcatataaaatcactattgtgcaattcaatcttcaaaaagatgttttcattgcatgaggtgatatctctttgttactgcaacatggtgggatgttcagatgctgaattgaatgtatacctgatttactgtaatcagcataagccgcgagcatgatgaaatggatgcctccagcatcgaaagagtagtagaatggagagaatgatccactctccgtcgatgggaacgagaatctggagctgtaagaagcgaacgtcttgttatcgatctgctcctcaatctcatggttcccttccaccaccatcatcggaatcctcgacgtcactggctccatgtaccttcagttagacatcacaaatcaatttatgaacaatcgctaaatgttaagagtttcagaaaaaaaaggttcagtgctaaatgttaagagtttcagaacaaagatccagtgctaaatgttcagagtttcaggaaaaaaaaagattcagtgctaaatgtgcagagtttcagaaaaaaaagattcagtgcaaaatgtgcagagtttcagaaaaagattcagtggtaagtgttcagagttttaggaaaaagattcaatgctaaatgtaaaaaaaaaaagattcagtttttgggttagtgactgatcactaccttccccagtaatcccagcgcggctgatacgtctcatggatgggcgtggagttggcgaaggagcaggagtagcagtctgtgccggtgccattggtgaggtacaggttggcgtagctgacgtcgccgaggaggaggaccaggtcgggctggttgctcaccatgtgctcgacggtggaggtggtgttgtacgtcagtccaaggtccccgacgatggcgatcttccccgggtagctcctcggcccgacggccggcatcgtgcggaacgcgtggatgtcgctcatcgccgccgggatcgccgggtcgccgcactggtagaagtactctgtccctggctcaagccctgcagatcgcacacttgtttgagcaaagaaatccaaagctgcaacgaaagctgaagtgaagtggatcttaccttggaggcggacatggtggatgatggcggaggtgtagttgaggaggccgtcgaaggggtagagctggctgtacacgagggcgtcgccggtggcgcggcggacgagcgagtcggcggcgaggccgtagcggacgacgctggcgaccgccgtggggtcgagcggctcgacggcggcgcccatctggaagtcccccgtgacccaggagacccaggcggaggagggcgcggcggagagcgcgacggcgatctgctccggcgcccaccccttgacccgccgctgcacccgcgggtccgtgtccggcaggtccaccgcgtggcccctgtcccgcggcggcaccgtcaccggccgcgtcggcccggccaacgtcgacgacggcgcagcctccgccgcggccgccaccgccgcggcggcgagcagcagcagtgagaccctcatccgcattgtgagatggcgcgagatcgatgggcgggtagcgtgaggaatcagtgcgaatttggagggaaatttataggagccgaattgggacaagatgggcggcggccggcgtgtccgctctgctcaccatcgcctgtttggaacgagaaagttgatgcagatatgtaaagggaaagtgattatcctctaacttcgtacaatcgtacctgcatctaaatagtcataaaaaattttaaaaaatttgacaagttaaattaatataaaatatatatcacttcacacacatacaaattaaaatttaacttctataaattataacaaaaataacaaatatagatgtgaacgtacgataactattttcaatttaatttgttctttttgttacaatttatagaagtcgaatttgatattacatgtttattatggatgatatatttcatattaatttatattgttgttttttaaaataaaattttgataactatttagatgatatacaaataatgggaggatatcccatcgaggaatgaatctatatcattttttgaattcttttcccaggtggatgaattcatctcgatttatgcgaaattcactaaatatcctcctgttttcagaaataaaagaatggattcagcagagatcacatacggtgtactccctccgacaaaccctgatttccgtgtccaacgtttgaccgtccgtcttatttaaaaaaaatttaaatgataagtcacgcataaaatattaatcatgttttatcatctaacaataatgaaaatactaattataaaaaaatttcatataagacggacagtcaaacgttgacacgggaagccacagtttgccttttttttttttgacggggacggagggagtagaagacagttgcaatttctttcatatctgaaatggataatgtcgccggtgccgttacggaagttgtgagcgcacgtcgccggacttgcgcttttggatggttgcgaggaatattccgtcgtcagcagagtagatgcctgagccgcgcggcgacggcggcgcgattggccggtcggccggtccaagtgcttgggccgtttcgggaatctcgtcatgccgacccatgggaaagcttttcttacttcgctgggcatgcgtatgcatatgcatgtgtcgctgccgccgcctaccgggatgctctagacggttgaagaatttcaacaaggatatgcagtcgtgatctctctctctgcttctttttctgcttgcgtttgcgtttgcatggctaaaaaattcagcaatggaggcgcagcgccacgttgattgtttcatcacgttgctctcctttacttcttgactagggagactgagaaatttgcagctagaatgggcagatttgaaaacttatctgaaaatttcataaaattccgtccaaaattgctcccgtcggccgatccacgagacccatgggctggatcacaagccacgttgggccgggccgtatttttatctaccaagaaaagcaccaagttgcgggcaattttttttaacgactctgaaaaatttttggatctcgtggtcgtaacaagaaaaaaaattataccaccacacacataccgacagctctaaaatacaaacacagaagaatactaccatcagactagacgctgctaagagtgacccgaccgccactagacaatgttgacggcattcctcttcctccgccgccattgttctctgctctctgcttctgcttctctctgacaatgttgacggcagttgcgggaaaaaattgttcagtccctagaaaagaaaaaggccaatttagctttcttatatatacttgctccattttgttaatatattgacaccgttaacttttcaacgcatgtttaaggggtggatcaggaacaaaaagaaaattagggagggctcaattacgtagtttcttcaacctccagccatttaggaacttttagtctatcattcatgataaaaaaatcgaaggaggtattctaagggtatccatgcgtcttgtgagtgtagggataactcaattctccctgcatccacgttggatccgcccctgcatgtttactcatttgtcttatttaaaaattttatgcaaaaaatatatgatacatgaatcatgtttaaagtattttaaatgatgaaataactcacgacaaaataaattataattacacaatttttttcaataaaacgaatgaacaagtaaaaaaattaacgatatcatcgtatattaaaatacaaaggtagtagctcgaatacgagtcatattcctcaaccgcaaaaaaagatactactccctccgtttcaaaatgtttgacgccgttgactttttagtatatgtttgactgttcgtcttattaaaaaaattatgaaatatgtaaaaatatatgtgtacatgaaagtatatttaacaatgaatcaaatgatataaaaagaataaataattatttaatttttttaaataagataaatgatcaaacacgtactaaaaagtcaatggtgtcaaacatttcgaaacggagggagtatatcactgttttgagagtggtttgcactgatatttccccggttatctgagcccttgtgttttagatgaagggcccagattaggcctaacgcaccactctgcactggtaatacttccgtggatccgcatcgtcctccttccttgtcgagccgagcagcgcatcatctccatcccgcctcaactccgccgctcgatcgcctccacccgccgccgttccgtctacctctccgacccccggcgggcgccgccgccgccgccgcgcctaccatggtaacctcctgcccccaccttatcccgttccctttctctacttacgcctctctccggatctggcctctgggccggcgccgcatttcccctttccgcccaccgcgacgaggcctcctggacccgccagatctcgcctcgaaacctgaacccttcctctggtctactccacggtatattgatggatcgacggagcccttccgataaccgatcacggattctagaaggatgggatgagattgtttgtcgctttggttcgagattgcattttttttttaaaatcagattatttgtggcgtttgctttggaagtatgggtgagtgctcatgtgtttgtgctattgtaggctaatacgctgcgattgtatctcacttgcataaggaacactctggaggctgccatgtgcctgcaggtcaaggatcaccattcctttgcattctgatcaccatgttctccatgctgaaatttgccttcatagatcattttctgtcttctgtcctccatgagtgtaatttaatttgcgtgtgtgtttgctttacctccagaatttcccttgccaagaggtcgagaggcacaacaaaccggaggtggagctaaagtaagtcgtgcttcaaactgaattttgtttattcaatgctttagttatgaccatgaccaagagaaaatgttgcactgatgttttagtttgagaaactggactttcagcatgtagtcgaaaatcaacatataattcactattgtaatgcaatataatgtattgtaaagagaacgatcttcttctcctttttttttcctgtgcatttgttgggttctgttttccaaggtgtttcctcatgaacccattctctaaacagtcataaatttttccaagttaatttcataagatgtatacaaaagaccaccaattctatcattggctccttttatcctttatatatttgtgggaaccctgtatttctatgttaccacacttagtgagaatagacactgaacttgtaattatacacgccaatgctgactaatatatttggtctaaaacatatcttgctatacaaatatttttttcctgtagggtttcatgatttccttttgtttttatacccttccttgaagttcgtatacctctattcttccctcacaatttattcttattgctttttacttcgttttgcaggactagccctgaacttctgctgaacccagtaaggaatctctcagcatcatctccaattcagtctatgattcacctgattatttaacacactagtgtagaattttgatttaatgactcattaattacactcaattcacttctaagttaaaatattttctctactggattatctagggtacgccagaaatcacatatgctagaagcaaatgctactccattaattaagtgaaaaactgacaacacatgatgacggagttctgattttatctttctaacaacacatgccattgtaccatgatggaactaatgtattttgacatttgtttcaaaaattgttgtcaatgtttgcgccacgcttatgactatgatactttatgatttaaatacatgcgtataaggaatttaggatcgaaggtgaacagtgcactttgacatagagtacatggcataaggcaggagcagtttctggtgacatgtctgatatccctcatattatgtgacccttatgaactctactaaattttttgttgaaggtgactgatttagaatgatctgctgccgtttggctgtttactggcagatatagcctacgccattctccaaattctgcttgtttggagagacattttctctagatgcctctagtctcttaagaattatgactcatagaactataatattttgcttcaaaacaggtgctcatttgccgtaatgaagcagaaaagtgtttgatagagacttcaatcaactctattcgtattagcatgaaggtaatcatgaaattatgattggatattactatgcttattgggataatatcagtcaatcatttgtcatctggtataccatcatatgtttttctctttattgtttgacaggtcaaacaggcagatgagctagaaaatattcttgcaaagaagtttcttaggtttttatcaatgagagcagaagcattccaagtgctgaggagaaaaccagttcaggtggttttccttcttgatgatctgtttcaatgctctttagccaattttatacgttttctgttatctgctgaaagtattaggagtagactgcattttgtcaagtcagagcattgcatgacatcactggtctaacttggttttgttcattttcagggttatgatatcagtttcctgataacaaactaccactgtgaggacatgcacaagcataagctcatagatttcattgttcagtttatggaggtaaggaaaaatgttttccttggctttcccatttgctacagtttgtgactttatactcatatcacatattctgatttgtgctgtaggacatcgacaaggagatcagtgagctaaagctttcggtaaatacacgtggtcggttagtggcaactgaattcctgaagcagttcatatgacacattcttggcgatctttggaaaacataaaaccctagcattgttagctatgctgtcttggcctttggcgagcaaatctggaaggatctttccaccactttgttttccttttgtaaatgcgttgacaaggatatgtgaattcttgatccaactagacctcattggcagctaaaatctgcccaggcaagagagatgaggggaaacaaagtcatggtcagtaggttgagatagattttttggccttttggttcaagaatcctgtactgtgccggccaagttttattggaatgtggaatgtcaaaattggggctgattctgattctgatatgtcaaaattggaatgtgaaaatcagagacgcttgttgtctctgattctgatttcagttccatggcaggctgccttagctgcgtaaatatatttcactgttcaatctattagcctcaacagttgccgtgaattcctggtgaagcaatctatttgtgcatacatacatgaatttgaccaagctaactgtcaacatctatgcatgaatgaacatctcgacgatgtgtcgatgtccacgaacgtcgttaacctggagaacaagatgtccatgcagagacagaggaaaaaaaggtcaaaccaccccttggccagcttatctccagctccggcttcaaaaaaaggtgtccgcttcacacgcaacggatcgaatgtgcttaacttttatgtgtgattcattagcagaaaatctgaaattttcagtgaaggaaccaggggaagaaagggctaaggttttccctatacgaagatttgtttagctgctgatgaattgatttcttcaccatatggccacattagcttcactgtgcatacatacacgcatgataaggagaagagagccattgttgttgactgagaaggagatacgcatgcattcatgtgggtggaaaaattgaggttaaatgggggtcggagttttgttctccgaccccttttgcaccttttgaaaatggcgttactccttcaagctcgctgtcgccgctgcggttcgtcaagagtgcgagctaacaatggcggcaattcaggcttgcaacatctgaaaagaaggcttgcacaataaaccagaatacatactgagtttattcagacaaattaaacaatccatcgaatcccgatttcagcaagctagcagagcattaattcatttcagtaggaaaacttatcttccgtttcagatcaacagctctgcatggtggtatgcagcatctgaaaagaaagcttttgcatagtaaaccactgaatagcaacatctgaaaagaaagcttttgcacagtaaaccagaatatattctaagttattcacacaaataaaacgatccatcctagcccggttttagcaaagctaacagagcattcatttcagtaggaaactttcctccttttcagattttcagatcaaggcctgaatagaggcatggccgcagcccacaagttcaattcagttttcagatcaacaaccctgcatggcgacatgaactgataccagattcataaccatttcaccatatatcatccctggcttttatactcctcaaaactacaaatgcacacactagtacatcaacccaacaccacaagttagagcaaggattccaagcatcacattcaccaataccttcgctctgcactgacatttggtaagtctacgagtcttggtaacgagcactttgagttgcatgccccaggttaactgtttcagcctttgtagtgaagctgagattgtagaatctggttgtcttccagcaacctgtcgtactccaggagaagctcctccgactgcttctgtagggcgttcacatgggcctccgcttccaacaccttcctctcgtgatcttcagactccgatttcagcttcttcatactctcgtttagcttagcaatctcctggtggagcttcttgatttcactggaagatttctcctccttttcacggaataaccggttctccatttgaagtttctcgacctcctctcttgatgtgttggctgctttcctcagtgtaatcagttttcggaggtagtggtgcaaccggtcaatgacaaatgcaaggaatagagtaaatcctgcagtgagagaccagctgttagaatctatcatgcctgccatatttaacaatgaacacatatcctgaattcctgattacacctagagataagtgctatacttttggttgaagataataatactaaacttgcataaagctttctgtaagagtatcccatcagttgcaaatgtactgattaaattgttcagaaaaacaacctggcataacataatgcatggaggccaacttttatcagttcaggtctgaaactcctaaccttctacaaggaaagagaccagattggacagacagcttcaaaggtcagacaacatgctatgtattttatttcagccaaactgccttaattactttatttgtgactagatgatttattggttaatagcacttagggtaggaactctagttgtgagtacagtgtgtgtacatgagtccttgtatgaacaggctgacaaagtgacagtccacctttattagttgcctgggtatagtactctgtagatccaacaaatcctccaatgcataaatccatatcaattccaaatgggtacatcatactgaccctaaggcataaacatgaaacgtgtaataggtttgtcatctcttattattctacattgacagtttgcatattagtatcatgattcctaacttgtactagtaaataaaattactaacctaagaatgatactatgtaccaaaatgaccaaataaaagcaaaaggtactacagttactgaaaatgtgattttctttcttaagctgttgcttgatataacctccatgtgacttctgaaatatgcttgcagtacaatactcactcaacttactagttcgtacaatgtgatcacatactgacatagtgacacttgccattctagttcttgaatacttccttcgcgtttgccacaatgtggtttatcagattaatagagcaaaaaagcatggaaacagaagtgatgagactgatattctaaatggccaccaaacagtagactatagttaaagaacaaatgatttctcactccatgctaccataatttttttatcacctagatggagcatgaaagcagcaaaaacctgatgcaagcctaaagcaataggagtccttattgtatccaacccagtccactacagtaacatggtactactgtttctttaccagttgaccacacaagggacctggcataaatgcaaagtgcaatttgctcattaagaattgaacatacacaacattcttcaatgataggatcataacttcctgcttctagtttaaaatgtataatgtaaactctctagcttctgtaaaccttagaagttaaaacaatatttggtttgcacaattatcgacctcctccatcattaagagcacttgctacacttcatccaagtagtagtaactagtaagttgagtagtaaagaatcaagaatgatgaaatggcgagctcaccgatgagggaggcctcgaggaggtgagtccgccatagcacctggtccatggggctgacggtgccgagcttgaggcccctgttctggatcttgaggatgctggcgacgctggacatgaggatcaccgagagcgtgcaggccagcgtcttcaccgtcgccgggcccttccccgtcttcgcctgctccacgccgcgcatcgccacctcccgcagcggccccaccttcaccatcagcagcagcgccaccgccgcctccgccaacaccaccaagaacagcagctgaatcatcctcccaaaaccaacccttcctctcctctcctctcctccaatctttttcttctactgttccgccctgagaaagctgggggttttaccaaaacgaagaccagctttgctcaatttcttcagcatcaaatcgaggaaccggtgcaggaatcgaggttgctttgcaataactccacaccccaaatgctgaagcactcctggtaaaacctcggttctgacggggaggagtggggaagaaatcgcaaatttaatgggaaaatttggagattgacaagaacctgccacctttcttggcctgcaaaagggtagctcatcagcaatcaagagaccaaacccaaaagggggaagcaaatggaaaatttcgagaggagtgaagaaacgaagaaagaaacccaccttgccttctcttgccaagaaccaacccaatagctcaatctcaaaccaatcaagagtctgtagccgtgtgggcagattatggtacgatgctaaagaagaactaattaactagtaaaggcgccgaggcattagagtagagtagagagagatggcggcggcgaaaggcgacgagcaggaaggcggcgtgcaagcagctcactcagctggaagagagagagagagagagagagagagagaggagtgtgaaagttcatggcccctgctgcctgctccgtgctctttttgtgattgataatggcgcttaacgctgctaatcctaaagttgcagggacatgcttaactttcaagagattttaaaaagctgctacgagcaatgcattagcaaactttactgaaaacaacctttctttcttccatttagataagtatatgtgtttgtgttaaagtaggtggttttttaacaacagctcacacctttgtagaatgtaaatttcatgctaggttcctctggcaaaacggcggtgggatacgaaactatgaacccataaaaacacttcgaaaatcgaaagaaatttgtgtatacaaagaaattcgtgcaagtctttctgcactagtagaagtagaactgtacaagtactgccctggctattcttttttattctttcatctgctgtatttttggacgattctgtaacgtgccagtacggggacttgcaccgtgctctgccaatttgaccaagtgtgattcctgcattgtcggcagatttctggtttacaccctgcatttctctcctctctgtaaaacgacggcttatctcatcgtcgtcatttgtgaaagaccaagaacagctatagagggggggtgaatatagcaattcaaatcttgcccccgaaaatactcatcaagccggatttctcaaaatccttactagaatcgcggctattagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacggaaactctctcaccgagcatctcaaaatgattaccaaaaggagcaacctccacccttgcatccatctctctatttatagcctaagacccctaagacattgtctcaaatacccctagggcgaaaccctaacttagaacagatctggtccatccattgttccttctactcaaaggaaaagctccagatgattgccacctcatcgacccgaaccctcacatggtcttcttgctgatgaatccgcgtgctctccgtcttgacgaatccaaacttgccacgttgcccagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccgtcgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacagtgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccttgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaagggatgcaaatgcaaatgcaagaatgctccccctatgtgccaaactccccctttcaccaagatttaaagcaagttttaattttcaataagtgcaaatttctctccccctttgtcaatgatgccatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaagaaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttatgatttttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaaacagagataaaacttgtaaagcatgattgatacaaagtatagacgcataagcatgagcattcataagcatgtactgacagttattgcgaaaagaatgtaaacatggcatgagtatgagatggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagaagtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcggaagatgcgcttgactgcttggcgatgtgatgttcttggagaagcctgaaacctcgcgcacaggcacacggagaagtggatgtccggccttgacgcagtcaggtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccagg

SEQ ID NO: 46261 - DNA, 4936 bp, Oryza sativa
cgtggaacggctggattggcttggcctccctgccaaccaatcacagcgcacatgcacagctagctagcttgacttttccaccgaggccatgctagtagcaaccagtacagtgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccttgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaatttgaactttttttttaaaaaaaaaaaatcccatcgttgtcgtcagtttgtgttctgcgacacgtagatcggatgaagatgcaggtctgtcgatgtacagtaattgtactcgaaacaaacaagactgtgtgtttagttcacacttaattctgaaagtttgtttgaaattaaaaccatgtgattgaaaaattatgtgtatgaaagatttgatgtgacgaaaaattgaaagtacagaagagcctaaagagaagagggaggatgacaaagggatacagtgcaatcctgaaataaggtacagtacacccagtgttctatcatctcatatgactgtagtctgtaatcaaattatacaacgaacaatgctatacgtatgacttgtatgtccgaccagcgtacgatcaaacggtaaaacaactcaatacgtgactgagtatggtgacaacatggcttggttatacggagattaacgtcacgagctcacggcgttaaggtcgttccaaagtcacacaagtttagtcgtacgtatagtatttttcttatacaacattagtttggaaaaaggctgtagacaatgactaggaaaagagagaaaaaaagaggttgttcagagataattatatttttcatacttttagctctcaatgactaggatagatatcagataaagttgcccccatgttagctcgagtaaatgttgtttttctaccttttaggctcacaaatatggtcctttctagcattaaatcccatctaaaccgaatcattctccggttgaaatgtagagaatttacatgaatttattcggaacccgaagaaatccaaatgatgcctgtcttattttttagatactactgaaataaaaatatacaggaataatgcatgcctcataaagaaaaagaaaagtccttttccaaaagagaaattatgataagagcttttcataatcatcacggtctggagtttggaccacagtagactccaagttagaccggtcagggcaaaccaaagctccgtgctagggcgaaagacgatgataccatgagaattccacgcaacagcaacaccaaaggaagaagtcgttgctgcaacagtatgataatcatcctaccattagagcttagataatagcaaactgtaaaccagctataaacacatttcgagaagataaaagaagatagagaagatcagcggtttacagatttgtagccagctgtaacacagactaaatatgtatgtgtgtatgacatgtgggaccaaatatgaattgtgtagtatatatttatggataactattgtataaattagctattaaattaactatagatgattaggagccagtagttgtctatactattaaacttgcttttatactactatacgtagctgcaaatatttataaaaaaaatctttgaaggagatatgcatatgcccttattacgaaggagattttactcctgagtcaaccaaggaaagaatgttcgatgacctgccgctgtgcagtgcagttcagcacttcagccttcaagccacactagcattgacagcgtcagcaacaggagcagttaagctaagctgcttaattcttaaagctgagttactgtttacagtttagcattgcagggcaaagcgtgtgtgtgtggtggtaatggataattggcgtgtggttaaccaccacgatgatggtgaaactggagttaaggcgataggtacaggcccgtgcaggaaggggccggggcagtgaccaccaccaccacatcacccaccgcattcagcatcatcagcagccggaaaggaaggggaagcaagcgaggaagcagcaagaatccgacgccataatggtcaaacgtgactcctcctcatcttcttcctcctcctaccttttcttcttcctttcaattcctcctgctcttcctagtctcttcctgctgctactgctgctgctctcgtattgggggtcacttgttcttcttcttttactgaccttgttgaattgaacgcaacaattttcttggtcggaatccaggagggagaggattagagcaaggagcagcgtcctgaggcgtgaaggacccacctttgctgctgttcttggagcttccctgccgaaatggccgtaagttcttgctcgattgactggcctgtttgtgtttcctgggttgcatcgtgcttggatcggttgggtttgctcgaatcgtcttgggcgcttctcctgccatgtgggatttctcggggttgcctctgatttgcagaaatgcttgctttgtcatttctttcttctcggtgcccaatgttaggggttccttaaattgcagtatttttgtttactggtgaggagacaggttgcatcttgtggaatcattttcttgttgcctccttctggggctattttccttgggatctttttaatttcccaagaaaatgtgccaatctgaaaccgaaattgttgccatgtccttttctgctcaattatgtagttatccaatctgccaagatccagcctttctgcattcaaggatgcaatttatgctgcggattcaatgttacaagaatgtcgacatggcatgcttgcagggctgatttgctgagtaatatattaatgcaggaatctcgtgcagagaaaagatctcagcttcgtgaatgtgataattgatacagcttgtttacttgctcgtttgagacctgtccttttaatgcatccttagtagtgttcctgcagaaaagatgcacaagtagttacattcaagttctttcaagcagtatagatagcaggatctgagtaaattctggttgatcggacaaagctgatgtcatgcatacatgattacaatagataatatctgagagtttagataatcatgcctatttaggctagaattataattcctgttacatatgaaagaaaacatgatgacaactgacaaggcaacaagctcatgtagtagattcagcaatcagcatgctgtctgctctagacttttttttttcatcagctcttttttcggagtatatgtgcttctttatttttcttagcgcatttcaataatatgatagttctttgttaaactttaccagcataaaggagttcctaaatttggaagctgggaggatgaagaccgtggtgaacacctctacacacagtatttcgaaaatgcccgcaagggtaaatctccagggaggtctgttaatccaaacaatcatcatggagatactgaagcactctctaaggcctctcccctgcacgctggatctgatccagccatgagaaagcccaaggatgacagacgctcaaaccgagaaggtgatcttcgtcagcacgaaaccactgttcgaaaaccatatgctgagtcacctaatcatagatatggggatcataccaactatgacaatgctgtgagaaaaaccggcatagagaagtcacccgttcatccccgtcaccaggcaagagctgcaaacaagggtggagtttcgtctccttcacgtgaccgtaggggttcattggaaggaaaccgtggatctgctcccactacacctggaaggtccaagttcagatcaactggccgtggtgatgagacggtaaagctctaacttatgatgcatggtattaagtaaactgccctttgattcattgactataaaaatacctttagatgaagtaattaattgcgtttgcagcctgatagaggatcagccgtgccaaagtttggagaatgggatgagaaagatccttctacaggtgaaggtttcactgacatatttgagaaggtgagggaggagaaacagtctggtaccggcaacgctcccgtcatgaccagcgaggcagattatatcaaacgctatcaacaacgcaaatatgaatccacagtaagtctacttactcaaaaaaaatatggtcagatgtgtggagcaaaactattttgttttacacattgcttcagatatatttgaacgagaaaattgttcatatgccaattgccacttgagtttgtcaatacttgagcttggtatacctctatttatttttagggatcatggcaccatgcgtagttattatgcagtaaaaattgtctaaaatctactgcttcgagtagctgcattctataatttatcggcaaagtcattgcaacaatacttctggtttttactggagtatatagtggttgcaaaaagttggtactacagcaaaaataatggttttactagaagtttggttagtgttgtttgcaaggaatcttgttctgcatgattgcttacagtatgatttggtaatattttaatgtaatccactttacaggtattgtgtaacaaatccctattttaattcagtttatcgcttccttgcagggctgctcatgcttcagttggttcaagaactgaactgacagccatccagcc

SEQ ID NO: 46262 - DNA, 7415 bp, Oryza sativa
gagatttaacgtgggaaaccctccaaaaacaggagagaaaaaaccacgtgtgccagccagcagaatatgtttactatatctgaggtgaggttacatcgccgtaaggcggcttacaagaggtatatatatggtggaactctaaaagggatgacgggcaggcctccaggcgacgctccagaccaagcctcccgacgacgggcctccgctccgctacggcagaagctggcatttattaagtgcaaataaatttggaccacaactcaacaacaccaaacagaagatcgactttagtggagtttatcttgagaaaaggtaggtaggtaatacattctaccatgagatacaatcacacaattaataacccaacaattgcagattcggtaacgatcctacaaggaagtcacaccatagagagagtaagcataaggatagtggctagaatttcattcgaaatcaatcatcaagcacgcgttacaaaccatgatgacaactctcatttggtcctgaaactgctactccaagcacagcagcctactgattgcagattgacgatgaggagactttggttctggttttgcctctgattctggcaaacaaaagaaaagaaaatttatatgtattgaatatataggggtgaatatccaatgcgactcctgaagtttctcttcgggctcaatttagtcatcgatgtttcaaatcgtccaaacaagtccttcaaattaattatttgggttaatatagtccttggacccacaaaaatgccacatgagtatgtcaagtcatcctcgcatgcagcggtatgaatgaaattaccattctacccttatataccatatagaaaagaaagaaatgtaaagacaagcgctgcgttagttagctctgcgaatttaaagtgttgtccatatcaaacgcttaaagggaaatgatcaatgagtattggttcaaagtagaagggaataagttcaccaagtggcttcgatcatgactaatacagctttgccataataattgcatgatgccacacttggcgactaaatgaagtcaattaattacatagtcgacccggcaaaaattaattacatagtccaaactagcaagcataatcacaggaagagatcatcatatataaggaatagctactggagatattactaaattcctttgtatgcgattagatacccaaatgcaactcaaagtttaaagggtttagatgacacagctgaagaagtgagttatgaatgcgcattgtactctatgtacaaataatcatattaatggttgactaggggttctagacaccacgctcgaaacttttaccactaaatcgtacacggttaagaaactgaagattaccttcatagcaggcatctagttctttattctcgatgtcatccagacgttgctgcaggctcggtggaagcaaatttataccagaacaataacgaatttcaagagatgtaagagatgagtatgcttgaggccccttcggcaaggataccaggcctgggcaattaacaagtctgaggtgttgcagcgacgggagctctcctaagcaagattccagtgatttcaagctcccgcaatagctgatatttaatgctcgaacggcatccagctttcctgagagtgactgaagtttttcacagcgtacaatatccaatttcttgatggacggaggaagatggagaaccttcaaacgattgcaatactctattactagagattctaggcgtggaaggacgcgatcgttggtctcgctggtggaccctgatattaacgatgacttgtccggctgtgcgaagctttctgcactcaccaacatcgtcgtatcctgctgctgattgaatatgatggacctcaggtcatggcagtccgtaatttgtaatagcttgagagacgtcggtaggttggggacctctacaaaagaataacaacggcgtatctgcagggactccaaacgtggcaggagttcacttggtgctagtgtagattgcccacgagcttgtgtgagtcctgtcagattcttgcattgaagaatatgtaacttcctcaaggaaaccaagccctggaacacctcttctggccagtcgacaagcgcatcgacttcccaaatattcagatctaggagctgaacaaaacatgtccacagagccaacgcacttgggtaagagaataaaaggttgcagccagttaagtccataagttccaggggagatttatgattccatttctcatcctcaatcaccaattcactcgaatcttgttgcttggccaccggtgctgtttctgtgtcatcagttgacaaatgcaggtggagactggacaatgaagtaatatatctgctggctgcctgtagggatatttgctgattgacttcatatatgtttaagtctctcagctttggtgcttcaggtagagtagtcaactctgggcaccgtctaatatctaatttgtaaagctgaggaaatgttacctcctcccttggagttccatcgactgcctcccatttctgaaagatatccaaaccatataattccatttccttcaatgctggaaatgcagaatgacacacggtgctaactccgccagacaattctgaaatcacatttgacgcttttggtaaggcagttagcctaggacaacttttgattatcagcttttcaacctcaggaaatatcagctcttctccttttacctcatttgtgtcccaccatgtctcaaaatttctcatactggccaaggtaagctccttcagtctgcaaaatgtaaaggaggtgtatatgtcacagttgaacaagcaatttaaaccatccagtccttcaaggcaaagaacttctagagctggcagctgccacagtggaggaagcttctcgagatttttgcaaccatctaacacaagcttcaccatgtcccgcagtttattcatccatgttgacatgtactgctcccacagtgaagtatactcagaaccttgagcccctcgtgaggcgtgagaccttccagcacctctttatgattattactctgtgcctccttgtacttctgaccagtccatcttaagctcaattcggtcagtttttccttctttccgagatttgctgcttttgcatcagcttttgtcacatttccagttttcttagctctagtcgaccaccaaggtccaactgccgcagctctcccaaatcactgcagccagagcaagaaccggctacaaaacatgtaagcgtctgtaggcaagtgaggtgtccgaggtccggaggcatgctttttaacctccaacatccgtgagtgtacaagtgacggagggcggtcatgtacttcattccgtttgggagttgacaaagacagtcacaaatggaaaggttcaatgtttgcagatgatataggatgcttatgtcttcaggaagtgcttcaattttactgtatgacaaatcaagatacctcaggtgatgaagatattttggtttcaggaatgaatctccccccatctttaaagctcgcaatgaactgtattttgatatttctcgcgaggaacgtatcaattcttcttgcgaggaacatatcaatgtttggatacctggatatactttctttaggaaaatgacacctgagaaaaacaagtggcgagcggaataaggaaaatcatcacttttactaagttctgtagctatagtagcgcattcttttcccatggaagattgtgcaacatcatgcataaggtcatggatcttacaagtaatcttagagcactttatatcatggaactcaaatgggatccccttcacatcctgaaaaaatgaccttgacaccaactcactgaaaattcttttaccaatgatttcagggcactctccttgtttctccgggataaaaccattggccatccataactggatcagcatttccacgtcgatctcatgatccttgggaaaaatagcacagaaggaaaaacattgccgcatatatgatggcaagcaattgtcactgagtttgagtattggtattattcccttttcctcatcgcaaattgtgcttctgctcaatatagcgtcccattctttcttggtggtcttcgtacgcagtgtagagcccaatgctgttgcagctaaaggggaaccagaacatttcttggcaatatcaccaaccatttcgagtagccaggaggaggcctttcttgttctgaattgaaagcacttctcttgataatttcctcaatgaagctttcattcaggttcttgagatcataaacttcttgagctggagccattagttgagcaactgcttgatcacgagttgttgtcaaaactgagctaccgctgccaccatgcttaaggttgtacttgagtgcttcccacttactggcatcacggttccagacatcatccaaaatgaggaggtacctctgcccactcacaacttctttaagttcatcctgtggtaactttttggcccctccattatcattcttcttattcatttctttgggagctgcttcaactattctttttgccagcgaatccacatcgaagttgtcagagacacacaaccagagcagcaactgaaaatgcttctgaatttcagggtcattgtaaacgagctgcgctaaggtggtcttgcccatcccccccattcctacaatgggaataacagtgagatccccattgctggcttgagcaagcaatcgattgacaatctcctctttgtctttctttcttgacttgttggcaatgtccatagaaaggttggagattttagaatccgtctttctccatttgatggaggacattggtggctctggtcggaacttaaaaataaaggcattcatctctgcaattaggacttcaatggcattcaggatcatcctgagcttgttgcccatcctataacgaaacagaatacggttgtgagtaggaatgagctttataacaacaatgctgccgagcttcttgtagtgccccttggccttggctttgcggcggagtgcctcgtacttgactcgtcgaagacatcattggcctggtaggccaccttccggagctcctcaagccatgctttcgccccttccctgtgttttgccgcctgctcctcggcgtcggcgatgacgtcgaggatggcgggcagcttgcgtttgagaatctcatgctgctcctccatgccctccatgaccttgtactgctccaggaggtagctggaggccttgtccttcaccatggacagcagtggcccgaccaccatggtggccatcagctctgccatcggaaggatctcctagagctaagaacacacgaacagaacacggggaagcacaataagcaaggagtgtgagcagcagctgctttttgtgggaaatggaaactgaaggaatgtgttcgactgaatgcaactagctagtattaagagttgctgcctggaatgaaagtgtttgattggaatgaagaagtaagcaagtacagtacagtgcagtaagcttccgagaactgggcgacgatagagatagaaaactggagtgcgcgggagagaagccggcggtcggcgcaagcgcaaccacgaagtactgacgatagctgagaagaagctgggatgctcaccggtgtggtgccctgtcgttcttgtgttcctccgtcgaccggaactcaacggcgaattgggcttggccggttcgtggagagcaaggttggagctgctcggacccgtctcaaattaaggcggcgcttgacggacgagctcagcagcctgcagccgcaagcgcgtcactcgccgctgtagcccgtagccttgcacttgatcagctccagtctcgaaaggagagagagcctcgcacagttgcacctgtcggtggagaaaagaagcaaacaacgttggtttgtctctgtggccttgtcgataaaatcatggagaagtatccactgcaaatagcacaagtgggataagcaatcaacaacgtcgggtacagtcgttcagacatcaggtcgctttaagctattactagcagatggcaaaaatatctccaaaatacattgtactctgtgtaccattaaaaaaacaaattttgaggaggatgactcctaaaatactgaacacccagctcgatgatttgcacaaaattaattactgaactatgaacctttttttttaggaagagatgcatctcctgtttctgttagagaaatgcagcattacaattgttcagcgaagcgaaaacaaaagacgggctacaggtcgccatccggggcgccaccaccagatgccatccctcagccaatcagttcagaacaagctaggattaagttaagcaagcacagaatttaggcatccccaggcacaacatctgggtttacaacttcagccatacaaagactttcactctaggtggtatttgattctccacattttcttataggggaattgcatgttgtgcattttcaaagccctataaaaaaacttaactgtgaacacaccattctttgttaatctccaactcagcttgtcattttcttttgttaagggcagcctattaatctcattgcaaattcttctccactttaccctctttgaaatctaacttctaagcctttttgttttagctttgcaattgttacatgtttttttagagttatattatacagctcaggaaagctttctcctagaaacttgctcctacccaccagtcttcccaaatctccattttccacttttttttctcacaaaaatttagaaacagatatttttaatctccatcagacctgaccaaaagtatgaatcacccactctatgttttccgtaagagtgttttgatttttaaatatttgtttctcaatacctcttgccataagccatctatggtttccaacttccaatgaactatgaccatagcatcagaagtagcaatttcagatcgctgtggccttatcgaggaagaaggggatacaatcatggagagagagagagagaggatgtatccactacaaatggcacaagtgggataagcaatcaacaatgtcgggttcagtcgttcagacatcaggtcgctttaagctattattactagcagatggcaaaaatgtctccaaaatacattgcactctttgtcccatgaaaaaccaaattttgaggatgaatatagacatagtatatatctatattcatctctataattttattttgttttttaagtatagagggaatacgaagaaagcttttcattatccatttccttctactcgggactcaggagtccactattcaaactgaagcggcttcagaccttaggtcactttagagtaagggcctgtttggcacagctccagctccaactccacccctcctggagctggagctcagccaaacagtttcagcttcaccaaaactgggagtggagctgggtggagctctcttacaaaatgaactggagttgt

SEQ ID NO: 46263 - DNA, 9974 bp, Oryza sativa
gttaaattgcaccggttttaagagtttgggggtcgagatacctggtttcgtggtttagaatcatgaattagatttcgattacttttaagggtcacaaagcgaacttattccaattctggttgatccaacaaagctacagctttgacataagctgatgtcatgcatacaatgattacaatagacaatatctgagagtttagataatcatacctatttaggctagaattatatttcctgttacatacgaaagatgacaactgacaagggaacaagctcatacggccctgtttagttttaaagtttttttttccaaactttcaactttccatcgcatcaaatttttcatacacacaacttttcagtcacatcgttccaatttcaaccaaacttctaaacttcagtgtgaactaaacacaaccgtagtagattcagcaatcagcatatgctatctgctctagaacattgtttttttctcattagcgctttttttgggagtataggtgtttctttattcttcctattaaactttaccagcataaaggagttcctaaatttggaagctgggaggatgaagaccgtggtgaacacctctacacacagtatttcgaaaatgcccgcaagggtaaatctcaaggaggtctgttaatccaaacaatcatggagatgcggaaacacgctctaaggcctctccagcagtgagaaaacccaaggatgacagacgctcaaaccgagaagacgatcttcgtcagcacgaaaccactgttcgaaaaccatatgctgagtcacctaatcatagatatagggatcataccaactacgacaatgccgtgagaaaaaccggcatagagaagtcacccgttcataagttcattggaaggaaaccgtggatctgctcccactacacctggaaggtccaagttcagatcaactggccgtggtgatgagacggtaaagctctaacttacgatgcatggaacttcctccgtttctaaatatttaacgccgttaaaatttttttaatgtgtttaaccgttcatcttatttaaaaaatttaagtaactattaattattttcctattatttgattcattgttaaatatacttatatgtattagaactactgttgggagcgctgtgcgctcttatattccaagcgccaaacgtgtatcagccaggcccacctcaccccacgttccatcatctcgctcccaccgttatcggagtaagcgatttacttcgataaaaacttatctggttacaatcccaccccacgccctgtcatcccactcataccattatctgagtaaacgatttacttcgataataaaaacaactttcctttcgatcccaccccatgtcccgcatcgtgctcccaccattatcggagtaaataatttactccgataaaaacaacttctctacttctagtatatattttatttttcccgtacccaaccaaccactctcgcccccacttcatttttttttccggatctcaatcgatccaccatcccagcccacagataggcgacgcaccatggaggaggacgacgacaccgtggcagttgatggcggtggccggcgagtggtgggcggcggcgcttgaggcgaaggcactgcttcaggcctcgctgccgcagcatctacttcagatcgatgctgaagagacgtctggcccatggcgaacaaggtggatgtcgtggggatggtgagttctctcagcaattcctaatgagattcttgatttcttgcgagaattgtatacaatctatgattaattaaattctttatccttcttgattctatgcagtctgacttcgattgggttgagcactcatcttggcgtgcttctctattctcccttacatggcggagatcctgtttgtgatggtcaatcgatttggtaacatcggtaagaaactgtgatttgtttcatcacctctatcgttgcccagtttatgacagtgaggcgatgacaatagcaacgacgacctccatctttggctccgtcgacggatccggctcctaccgaggtcgcagcggccaaacttggttctacctcggctccagcctgcatctccgccgcattgtcttcttgctctctctagtaggacagaaactccattcagccgtcacgaggaactggcgatggcgtgtattgttgtgtttgtgtgtaaaatttttattcttatgcttttactatgatgtgcatgtaaaatctttattttttgtcccgtgttttaggatggagtgattcattgtataaataaaaaatttattcacgtattatttggggtaaactaattaggccccagtaactccctctttatttatttttcctttttttcttgatgcacttactataagaaatcgttaaccaagactagcaataatgcaattactacaagttaatgcaccatcaattttcatttacatcgacagtatcaaccaatgttgttcataatccaactactacaagcacatgcaccatcaattttcatttatgtcgacagtaactcgattactacaagatttcaccaagtatggttgtcgttaatccaattactacaggcacatgcaccatcaattttcatttacatcgacagtaattcgattactacaagatttggtctcagtttgtattgcacaccatatcgtaactacctcgattggaaacaaagataaaccaattacagcgattattttcaaccaaccaccgattttacggatctgtaattgatttaccccgaattcaaatataactaatctacacagatcgaacgtgggcaaccgaacaccagtttttacggactctaggcacgatgtgcggcgctcggaacaatattccgcgctctagcgctcggaatagcgctaccgtatatgtatacatatagttttacatatttcacaaaaatttttgaataagacgaacggcaaacatgtgataaaaagtcaatgatgtcaaatatttagaaacggatggagtattaagtaagagttttttttaccgtccagcagtgaagcccggtaccaaatgtggaccgttggataggtatgatcggatggctgacatcaattggtaccttcaggtaccatttacttcctacgtggtactccctccattccaaatatatctacatatttgtgctcattcattaagtctattcgttatttgtgcattggagtaaatggacattgatgcatgcatccatgcacacacaagtatttataacccacatgcaatatcttgagaaacactcaggggtcttccggctagctccacaaggtggtggctagacgaccttggtttgaagcctcaccctttctaattatttgatattaggtcattccctaatattcgcggtttttacatgcaatatcttgatttgctattggctagaaaatagtggggatggtgcgtgcatcgagtttgttgctagagtaaatatagaatgagagagttattagtttttttttgtcttggtgtacttgtgaaatatgtaggtgaatttggaatagaggaatagagggagtacctgtcaaaggggaacaaggtggaggggtaaaattgtatttgcacattggaaaggagcttcgtcgatttgatccgtgttttggataaggctttgcagaggaaaatctgcggcagtggcggcgagccgacgacgcttcaggaattgcggtgcgctccaccagtcttctgcggccacaacggtgctccaggagttgttgtcagcggcgacgacggcggcattccaggagttatcggcagcgatggcggcgctccaggaatcatctgcagctgcggcggcagcgctccaataattgtcttcggcgacgacggcagcactccacgagtcattgctagtgacgacgatggttgatttggctgaacgacttttgagcatgaaagatacatacaagaataaattgagaagcaggaagttccccgcaaagaaaaaaaaaaaagagaagcatgaagttgatttgcctaaatggcttcaggttgatttgtcagacatacacaaaatcgatactcatacgaaaagctccaacacaacctccgttgcagaacatgtatgtttagatggggctaaaatttttttaagcccatgtcatatcggatgtttggacgctaatttagagtattaaacatagactaataaaaaaactaatttcataaatgagagctaatttgcgagacgaattttttaagcctaattaatctataattatcaaaagtttactgtagcatcacattattataattatggcgtaattagactcaaaacatttatctcgcgaattagtccaatgttatgaaatgggttttgtaattagtgtatgtttaatactctaaattagtgtcgaaacattcgacgtgacagggactttgaataagtccatggaaaccaaacaactacgcttgcggcgacaaagtccggtgcgtcagatacatgttgcagcagcgtcggccatcgggcgcactgtcgttgccgccagagcaaggacacgctggggctgggggaggacaggcggcagcgacggaggttgaattaggaaaagaaaaaaggcaaaatttgaattttcaagcttaattttgagatatttttaacgtaattctttttcaacattggcttttaagtcaccaagaacacatttaaaaaagttttacctacaaattcagttttatttcctaataagcctgacggagcgtgtgggctcctcaccgggagaccgcgcaggcccccctttgccggttcggccgggggcgctgagtgagattcttcaccctcgatctgtggaatgttcgcgagagaggtaatgcacaagacacgggcgatgtagacaggttcgggccgctgagaagcgtaataccctactcctgtgttctggtggatctgtgagtgaaggagttacaaagagctggagaggaagagagttcaagctctagaaaccctcttcctttgtctctcctctacaagctcagatgttctctcagttctaagctcagatgttctctcagttctcccctccttcccctctgtttctggatcctccctttgctcttctcccctgttttttttttcatcctcctcttaggtgggcaaggtcctccttttatatttcaaggggataccacatgtaccacttctacctactcttcttttgggtggggacccaccctatcttgaccaaatcttgactcgcgcctccgcctggaagctaaatcaccgcttgtccttgagtgatgcccagcgccgtcactcgtcggacacaggggatcaccctgtcatttcttcattaatgggcggagatttgcaatggccgccgtccgaatgaccctccgatgggatgggtcatacctacctccactccaccggaagcagatgcaacgtgggagcacggttgtctgccgatgacgtgaccggcgtcagtccagtcactgaccggtcattcttctccaccacgcgtcagtttagcatgccgcacatctgctcttcttcatacagtgacttccttgcaatggttgcgatgaagcctggcatgaatcgagccgggactgacgtgctaactccaggagttaccacgccggctccagctagggacgagtgccaagaggctctcatcattccgacgggacggggcgaggcgtgagacaggccgcctgctgccacctaacccgcgatctgaccggtctgcgaccggtcacacactgcgaccggccacggaccggatatgcgtgcgccgcgccgcattaaatgcggcgtggcgcgcttgtccatcccgcaataaatgcggttagatgagcgccgctgtgcccacctaacccacatacgtggcgccaataccacagggggtcggggcgccccagccctcggggccgaaacaggagcggcccgacccctcggggagacagagggaggggtggccacgtcaccctcgggcccgacccccccgagggggtcaggccacgtgggtgaccgcggctgcccaagcctctagtcatgatacccccgatcccatgtcaccgacaaagccgttttggcttattaggaaataagccaaacgaatgggacctgcgacggcagcggccactcagatatgcctgtgaagatgaggagatttagtcgtcgcacgctaactggctgctttatggattcagattgagtgacatagagtagccatgtcacaagatgacatagcgtagatctaaattttaacttgtgatgacgtggacgaatcccagccgttggatttgttttggagagctgagatctatgctatgtcaccttgtgacgatggtcccggcgatccagccgcaacagtggagagaaaggagtgaagggaggcagcgcaagggatgtgaggtaccgccgatccggccgggttcgcgcgacgacgacaacctggagcggtggttgcgcggtggaggagtgacgggggaggggggatggggcaccggcggcctgggtcgcgatggatgccggaggtggcgcgggcgcttgtacgacgggggcgagggggcgacaaatccggaggttggggcggcgtcgatggatggaggcgtcgagggcggtgacagcgggatagggctgctgttcgaggcggcggttggacgaacacggtggtggcagggcaagtggggagcggtggcggcggtgaaggaagggggtgcgggaggaatgatgcgtgagggccagggggaggagcgcgatattgcgggcgcgggcggaggggggcgtcgcgagtttggatgccgaggaagggggcgcagcgatgggggcggatcggaggagtcgcgcgatggttgttttgggttgcgagggcgccggttttttatccatagcatatccgattttctgatctacggtcacgtgtctacgtttttatgttggatcgcgtgtctacgttggcttcatcatcaccactacaatttttttaagcagtagagattacattaaactcttttgatttaacgaaattttcattaagctaattagacgaacaaaccaaatgtgaattttcgtaaacagacgaaaagaacggaaagccaaaaaagatcacgacgtgacagtacatcatgaaatggaagtgctagcagcgtttctcttagtttatcttagatgcatttgtaaatttgccaccgatttttttaattttacaaggatgccacttgaatgatagtttcagtggtattttttgtaattttctagtagcagtcttacaataacgattcaaagcagtgataaatttgcaattgcccctttctcttatggtggagcacaaacgaaatcaaacacattacacatcacagttcacaagaaaagaaaaaggatggaaaaaaacagagctggggcccctatttgctgttcttctggatgcagtctgggactagctttctggttaaagtcaaggccttgggtcggcttcatccttgtagcagctcacaccaccagacgatcgactttactggactttatcttgagaaagggtagctgggtaggtaatacattctacgacgagacacgataaccatcacttgtagttatggtcacgatcctacaatcaaggaagtcatagagagtcagcataaggatagtagctagcatttcatcatttgaaattaatcatcaaagaaagcttactctacaaaccatgatgacaactctcatctggttctgaatctgctacttcaagcacagcagcctaccaattgcatattgatgcgcctttgattctggcaaacaaaaagattagaaaattatagtattggataatatatagtagtagtaggctatagcagtcaagatttacgaaggcataataacaagacaattgaaggaaactacatatactcaactatattcaatggggctgtgaatttccagaaaaatgtcaaggcaagtattgtgttagttctgcaaatttaagctgttgtccatatcagacgcttaaagggaaagaatcatgagtattggttcgaaggaccatggaaaaaaccaccaagggacttcaatcacgactatttttttttcacgagacttcaaccacgactaatacaacaactaaaggatataggttaattgcatgatccaaactagcataatcacagtaatagatcatctaaattcccttgcaggtaccaaaatagcatatctatattttctatatagttgatatgtatccactaactcctaaagttcaacatacaaacgtgtaacattatcacctattaacaattattatctagttatattaaatctcatgcaaacatgacatgttatttataattttgttgcgtttttataactcaatatgcaagcaatgtaaaaaaaacgtgaatattagcccaccacctcgtgtagctagccggaagacccctgggcgtttctcaacatgcaagcaacgtcaaatcatcatctccacaacattttcacattatttaaatatatacatctatcatttctataatacataacatttattcatccacatctcccatagcaaagcgcggaggagacgtaactaaattcctttgtatgcgtttcaaaagtttaaagggaggtgacagctgcacgagtgagttatcaatgtgcattgtactctatgtacatataatcatatggttgccacactcgtaaactttttaccagtgaatcgtactacatttgccttttagggtacaccaaattaagcttctggttattctatagtattaaaagaaacgaagaaactggagattaccttcatagcgggcatctagttttttctcctcgaggtaatccagacgttgctgcaggctcagtggaagcaactctataccagaacaagaatcaattgtaagaaatctaagagatgagtatgcttgaggcccctcgggcaaggatactaggctcttgcaatcaaaaagatcgagttgttccagcgacgggagctctcctaagcaagattctagtgatttcaagctctcgcatgatctgattattaatgctcgaacggcatccagttttcctgaaagggactgaagattttcacatttcaaaatttccaatttcttgatggacggaggaagatggagaacctccaaacgatcacagcgctttattgctagagattctaggcatggaaggatgtgatcgttggtcccactgctggaccctgctattaatgatgacctatccggccgtgtaacactttctgcactcaccaacctcctatcatgctgctgactgaatatgatggacttcaggccaaagcagttcataatttctaatagcttgagagacgcagataagttgggcatctctacaaaagatatgcagtagcttatctctagggactccaaacatggcaagagttcacttcgtactggtgtagattgctcataagcttgtgtgtgtcctgtcagattcctgcattcacgaatctgtaacttcctcaaggaaaccaggccctggaataccttttctggccagtagtcaagtacatcgacacaccaaattgtcagatctaggagctgtacaaaacatgcccacagagccagtgcacttggatgagagaataaaaggttgcacccgtccaagtccataagttccaggggagaattatcattccatttctccttctcatacactaattcactcgaattttgtttggccaccaatgctgtttctgtgtcatcaattgagagatccagattgagactggacattgaagtaatatatctgctagctgccactagggataattgttggctgcctttatatatgtttaagtcacttagctttggtgcttcaggtagagtagtcaactctgggcagcacctgattgttaatttgtcaagctgaggaaatgttacctcctcccttggagtttcattgactgcctcccatctctgaaagacactcaaatcacataatttcatttccttcaatgctggaaatgcagaacgacacacagtgctaactctt

SEQ ID NO: 46264 - DNA, 8957 bp, Oryza sativa
gctccttcagtttacaaaatgtaaagggagtgtgttcgtcactgttgaacaaacaatttaaaccatccagtccttcaaggaaaagaacttctagagctggtaactgccacagtggaggaagcatctcgagatttttgcaaccaattaactgaagctccaccatgtaccacagtttattcatccatgttggacatgtactgctcccacagcaatgtatcctcagaaccttgagcccctcgttaggcgtgaggccttccagcacctctttatgattattctgtgcctccttggaatgatttggtgaccaatctaagctcaatttggtcagttttttcttcttcctgagatttgctgctttcgcatctgcttttgtcacattctctagttgtgatagctctagttgaccaccaaggtccaactgccgcagctctcccaaatcactgcagccatagcaagtaccagcgacaaaacatgtaagtgtctgtaggcaaatgaggcgtccgaggtcaggaggcatgctttctaagctcgaacatccgtgaaggtacaggtgacggagggtggtcaagtacctcattccctttggaagtccacgaagacagtaacagcggcaaaggttcaatgtttgcagatgatatagtatgcttatgtcttcaggaagtgctttaattttactttctgagagatcaagatacctcaggtgatgaagatattttggtttcagaaatgaacgtccccagatctttaatgctcgcactgacctgtattttgataaattctgcaaatcttcatttacagatctatcacatataaatgtttcttctttttgcgaggaacatatcaatgtttggatacctggatgtcctttctctagggaagtattcagaatagcttctgctctataacctgacaaaaacagatggcgagcggaagaaggaaaatcctcacttttactaagttttgtagctatagcagcacattcttttcccatggaagattgtgccacatcatgcataaggtcatggatcttacatgtaatcttagagtcctttatatgatggaactcaaatgggatccccttcacatcctcaaaaaatgaccttgacaccaactcactgaaaattcttttaccaatgatttcagggcattctccttgttgctctgggataaaaccattggccatccataactggattagcatttccacgtcaatctcataatccttgggaaaaattgcacagaaagcaaagcactgccgcatatatgatggcaaacaattgtaactgagcttgagtattggtaaaattccattttcctcatcgcaaatcatgcttctacttaatacagactcccattctttctcggtggtcttcgtgcgcagtgtagagcccaatgctgttgcggctaaaggagaaccagaacatctcttggcaatgtcaccaaccattttgagtagctcaggaggcctttcttgttctgaactgaaagcacttgtcttgataatttcctctatgaagctttcattcagtctcttgagatcataagctttttgagctggagccatcacttgagcaactgcttgatcacgagttgttgtcaacactgagctaccgctgccaccatgctgaaggtaggacttcagcaattcccacttactggcctcacggttccagacgtcatccaatacgaggaggtacctctgcccgctcagaacttctttgagtgcatcctgcggtgagtttttagccattacattctcattcttctctttgcgagctgcttcaactatgcctttagccagcaaatccacatcaaacttgtcagagacgcacacccagagcagcaactgaaaatgcttctggatttcagggtcattgtaaatgagctgcactaaggtggtcttgcccatcccacccatacctacaatgggaagaacggtgagatccctattgctgacttgagcaagcaatgtattgataatcttctgtttgtcttcagatcttgatctgatggcaatgttcatcgaaagattggagatcttacaatccgtctttctccatttatggaggatattggtggctctggtcggaattcaaacctaaaggcattcatctctgcaattaagacttccatttcattcacaatcttgatgagcttgtcgcccatcctgcgacggaacgcaaaacggttgtgagtaggaatgagctttattacatccatgctgccgagcttcttgtagtggcccttggctttgcggcggagggcctcgtacttgaactcgtcgaagacatcattggcctgataggccaccttccggagcgcctcaagccatgctttcaccccttccctgtgttttgccgcctgctcctcggcatcggcgatgacgtcgaggatggccggcagcttgcgtttgagaatctcatgctgctcctccatgccctccatgaccttgtactgctccaggaggtagctggaggccttgtccttcaccatggacagcagtggcccgaccaccatggtggccatcagctctgccatcggaaggatctcctagagctaagaacacacgaacataacacggggaagcacaataagcaaggagtgtgagcagcagctgctttttgtgggaaatggaaactgaaggaatgtgttcgactgaatgcaactagctagtattaacagttgctgcctggaatgattgtgtttgattggaatgaaggagtaagcaagtacagtacagtgcagtaagcttccaagaactgggcggcgatagagatagaaaactgcagtgcgcgggagagaagccggtcggtcggcgcaagcgcaaccacgaagtactgacgatagctgagtctgagaagaagcacatgcactgcgacgacttccgcaagaaaggagctaggatgctcaccgatgtggtgctccgtcgaccggaactcaacggcgaattgggcttggccggttcgtggagagcaaggttggagcagctcggacccgtcgcaaattaaggcggagctcgacggacgagctcagcagcctgcagccccgcgcgccgccgtagccagcttgcacttgatcagctcaagtcacgaaaggagagagcctcgcacagttgcacctgtctgtagagaaaagaagcaaacaacgttggtttgtcgctgtggccttgtcaaggaagaaggggatacagtcaatcatggagaagagagaagggatgtatccactgcaaatggcacaaatgggtgaagcaatcaataacgtcgatcgggtgtcggcttcaatcgttcagacttcagacctcaggtcgttttaagccagatggcaaaaatatctccaaattatattgttctctttgtttcataaaaaactaaaatttgagaataaatatagacatagtatatatttatattcatctctataattttattttttttattaaatagagggaatacgcacgaaactttccattatacatttccttctactcgggacttggggggagtccactaaatcccttattcaaattgaggcggcttcggaccttaggtcactttaagcttcgctgacttgtacgctaaacattaaaggcttgtttaggagtgttcttttctcatgtgtaaaaggaaaactactgtaaatctccatgaccaaagggaaggccaaaaatagcagtgaaagattaacctcatagtaacgggagtggattctaatccttcgaggggatgtcccctcgtatactcaagggaaggacaaaaatagcagtgaaagaagcaaacaacattggtttgtcacagcggccttgtcgaggaagaaggggatactgtcatggagaagagagatgggatgtatccactgcaaatggcacaagtgggagaagcaatcaacaacgtggatcgggtgccagcttcagtcgttcagacctcagttcgctttaagctattattagcagatggcaaaaatgtcttcaaattacattgtactatgtcccataaaaaagtaaattttgaggataaaatataggcatagtgtatatctatattcatctctataattttattttttttttaccaatttttctttctttcttgtttggcggagcgctcagcaaccgcagttttctgttttttttaaaaaaaaaatttaaagtgcaaccgctaacaggtgatgcgcgcgagcgtgagaggtggaaaggaggatgactcctaaaatactgaacacctagctcgatgatttgcacaaagttaattactgaactatgaacttattttttttagaaagagatgcattcttctcctgtttctgttagagaaacgcagcattacaattgttcagctaagcgaaaacaaaatacgggctacagggtcgccattcggagcgccaccaccagatgccatccctcagccaatcagttcagaacaagctaggatctagttaagcaaaaatagaatttaggcatcaccaggaacagcatctgggtttacaacttcagccatacaaagactttcacttttggtggtattttgattctccacattttcttataggggaattgcatgttgtgcattttcaaagccctgtaaaaagacttaactgtgaacacactattctttgttaatctccaactcagcttgtcattttcttttgttagggacagcctatcaatctcattgcaaattcttctccactttaccttcttttctccatacaggcatcttctgaatctaacttcttctcagcctttttgttttacttttgcaattgttacacgtctttttagagttattacattatacagctcaggaaagctttctgctataaacttgccccctacccagcagtcttcccaaacgtgtattttctccattttccacttttttttctcacaaaaatttagaaacagttcttttttatctccatcagacctgatcagaagtacagtatgaatcactcactctgtgtatttctgtaagagtgttttgttattttttaaaatatttgtttctcaacacctcttgccataagccatctgtggttcccaacttcaaatgaactatgagcaataacatccatcccgaaataaaatgtttgacaaccaataacaaatgcagatcgaatcaccatgaaatttgacaagagaacattcaaatagcacaatagaagaacaacaaacccattattctccttccccatcctgatatccccaaaccaccaaccaacacaatgacaaaccagagcgaggaagagagcagcagcagccgacgaaggccacgcatcctcgcctgaagctccccccgtcggcgacggcattattcgcggtctccagtctccaccgcctataggccgtcccttccgacgtcgccacgccatgggtcgtctccgtcgcccgggcgctcctctgcatgagggcctccactctccgcgccgcggctgctggtactgaggctttgagggagaagggagaaggcgacggtggcggtgggggaagggagaaggcagcggcggccggcggggattgggcatgcggcggcggagttagaggctggactggaccgaaccttcgttggattgggccagaaatgggtgtatgttacacggcccatccaagcgtgcgttggaatcattggcctgtagtttacaccagttttgggccaaatactgggcttctaaatgggccctaagtctgcttactgggaaaaaaaaggaaaaagtacaccgaaggtccctcaacttgtcattgagttacaaaatcgtcccctaaccacaaaaccatataccgggcgtccctcaactaacaaaaacgttctctttagatctttcggtggttttgaccccggttttgtccgacgtggcggctgagtcagcgtgggacccacgtgggccccacatgtcagcttggccacctcggcctcctccctctttttccctctcctttcttttcctcatctctctcttctcagcgaaatcagcagcgcgaggcggcgacgctgccgggggcggcggggggaggagccgcgctgaacctgctctcgaggaggatgaactgctgcgctgcagctcaatgaatcgctgcaactgctggcggaggagtggcgcacgactgttatcctgcctcctccctcatcgtgtgcgctcggtggcgtcagctgatctacatccccgcctcggcttcggggtatcctccggcgttggatctagtccatgggacactatcacactagagagaggagcacgagccccatagccccgccgtggatggtgctcgcggaggcggcgctgcggctgtggctggcggcggaaccacgggagctaagggtggagctgggactgctctactcccgcgccatcgcgcgcagagtggagttcgacgccacggtgctcgatgatgccgtgccggggatcttcctggccagggtcgactgtatggccgtcgccgaggtcgagcttgtcgcctcgccctggtccgcccccgggctcgacgccgtcgtgcgtggcgtgacccatcggccggcctgcccaagtcccagagaggagcagagaggagaagagtgatagagaggaggaaaggagagaagaggggagagagaggggaggctgacgtggatagtctgacatatggggcccacgtgggtcccacactaactcagctgtcacgttggacaaaactggggtcaaatccaccgaaggacctaaagcgaatggttttgttagttgagggacgtccggtatctgattttgcgattgggggatgattttgtatctcgatgataagttgagggaccttgggtgtactttttccaaaaaaaaaattatggccagatgtgtggagcatcaattttgtttaacatattgcttgagatatagtaattgaatatttgaatgagaaaattgttattgtgccagttgctaattgatctctggcatgctcatttttagggataacggccggaaacgccatgcatagattatacagtaatttaatttgtgtgaactcgactgcacagtatctttgcatgatttggttatatcatcatattctaaattaatccactttatagccattgcaaaacatatttgtattttcattcagcgtatttcattccatccttgcaggactgcccatgcttcggttacatcttgtggaatcattttcttgttgcctccttctggggctattttccttggattttttttatttccaagaaaatgtgccaatctgaaaccgaaattgttgccgtgtccttttctgctcaattatgtgcagttatccaatttgccaagatccagggcctatgtagattatagccaaaataaacattaccaaattttggcataatttcttatgtatttatcaaaatttagcaaaaaaaaactaaacatagccacatttttagtaactatgctaaaaaatggtatggttgaaaattacatcaatctaaacatgcccccactcttattgtttggtactgcggcaaaaagttgagatattgtttggtagcgagacatgacatgtatttacacgaatttgaagcttcttgttgagcattttgtgcttttttttttgtataatgagggattcgtttatcttggaaggcatgtgtttggatagaggatccaaatccatacgacaaaggctaaattttaaccaaatcatgaaaatccaggccactttcaaaaaccaagtaaaaaaatgtatgaatttcctttttcttctttggaaatgtaagttgctgaatctgaacaatcacgacacctgacatgaaaaaatcaggttcgtctattagaaatttcagagtaattgcctgaactaacattagtttgcagcgcatacagtatgggctgagatgggccatgatgggctgggccacgtaatgttacattgtgttgcattgcactaaattttgttgcagtaggccatctgaggtgttgggagatctttcggcactatagttttctgaactttagttcagcaatagcatttacagagctgaggaatttttttttaccttgcaagtcccaacgattctgtcgagaacaattcatttttttgacgtaagaaggtagagctggctctaccttatagccatctcattaatagaaatgaggtggtacaaagttttagaaagaggaaaagccaaatatgggaaagaaaaagaataagaggagcatagaaagaagaaagagccccggggggaggatttaaataatgttaaatatgtgatccgaattttgggcccacaatatattcggattatatagtttcctagtaggacttcatgtctatcctattaggtgtccttctattatctcctatatatactcttgtaaaccatatggaaaggggtgacgttcccattgtgattcccctacgtttgtaatcaactcctctatagtgattattgccggttgacgcccgtggttttttttcgcaagagttttccacgtaaaagttcgtttctctgttgtgcatctattttcatatcaagtggtatcagagtattggagatcgatccactgcagtcccggccacgggcgatttttcctaatcgaagaaatcgatctaatcgacggaacgcgtcgtcgtgttcatcgttcggtcgaatcaatctgtttggccccctacctgtcgactccgagtcggccttgtcccacgcctgcgcgagaagaaaaggcagcaccgcagcagcagccacgtcaaacggcgcacgcgacaggaggaaaaggaggagcagcagcgtccaatccatccatccagcagcacacgtcccgaggagaaagaaattagggcagccagctcttctcctgttcacgtgattttattcacgttgaattgctacggccacctaagcttgtgtaccaggagattccctgatctacgcttcgtgcacacggaaagtgcaccagaggttcacgtttttgctagatttagcctaattctttctagcaaattcaggattaat

SEQ ID NO: 46265 - DNA, 1314 bp, Oryza sativa
caatattttgcaggaggtgcttaaggaggagacagccgctgggctgtggttgaagctggaacagatatgcatgactaaggatctgaccagtaagatgcacctgaagcaaaagttatttttgcacaaattgcaagatgatggtctgtgatggaccatctctccgctttcaaggaaattgttgctgaccttgagtctatggaaataaagtatgatgaagaggatttaggtcttattctattgtgttcattgcctagctcatatgcaaacttcagggatactatactttatagtcgtgatactctaactttgaaagaagtttatgatgctttgcatgccaaagaaaagatgaagaagatggtaccctctgaaggttcaaattcacaagcagaaggcttggttgttcggggcaggcaacaggagaagaacacaaacaacaaatcaagagataaaagttcaagtagctaccgtgggagatcaaagtccagatgcaggtataagtcatgcaaatactgcaagagagatggacatgatatctctgagtgttggaagctacaggataaagacaagagaaccggaaaatatgtaccaaaaggtaagaaagaagaggaaggtaaagccgcagttgttattgatgagaagtctgatgcacaattgcttgttgcttatgctggttgtgcacaaactagtgaccagtggattcttgatactgcatgcacctatcacatgtgcccgaataggaattggtttgccacctatgaagctgtgcaaggtgatactgttttgatgggtgatgatacaccatgcgaggttgcaggtattggaatagttcagatcaagatgtttgatggctgtatcagaacattgtcatatgtgcggcatattccaaatttgaagagaagcctcatctctttatgtactcttgatcgcaaagggtacaaatattccggtggagatggaattttgaaggtaactaaaggctctcttgttgtgatgaaagctgatattaaatctgccaacctgtaccatttgcgaggtacaactatattaggtaatgttgctacaatttctgattcattatctaattccgatgctattaatctttggcatatgcgtcttgggcatatgagtgaaattggtttggcagaattgagcaagcgaggattgctagatggacaaagcatcgggatgctcaaattttgtgagcattgtatcttgagagaatccattacatgccactgactttgtcacacgtctatgatttaccactgactttatcacgttctacgatataccatcgacttttgcttaacttct

SEQ ID NO: 46266 - DNA, 4965 bp, Oryza sativa
  unsure (1)..(4965): unsure at all n locations
gggggcctgctcgtaagacatcttttgnaggtgctcgttacatgatgactatcgttgataattattcacgaaaagtttggccttatttcttgaagcacaaatatcaagcttttgatgtgtttaaagagtggaaaactatggttgaaagacaaactgaaaggaaggtgaaaatccattcgtactgacaatgggatggagttctgttctaagatatttaaatcatattgcaagtctgaaagcattgtgcgtcactacaccgttcctcacacacctcaacaaaacggcgtagctgagcgtatgaacaggacaattatatcaaaggcccattgtatgttgtttaatgcaggtttgcctaaacagttttgggcggaagccgtttccactgcttgttatcttatcaatcgatcacccagttatgccattgataagaagactccaattgaggtatggtctagttccccagcaaattattcagacttaagagtatttggttgtactacttatgctcatgttgataatggtaaattggagcctagagctattaagtgcatttttcttggttatccgtctggtgtgaaaggctataagttatggtgtcctgaaaccaaaaaggttgtgattagtagaaatgttgtcttccatgaatcagttatgttacataacaaaccttctactaatgttcctgttgagagtcaggagaaagcaagtgtgcaggtggagcacttgatcagttcagggcatgcaccagaaaaagaagatgttgctattaaccaagatgcacctgttattgaagattcatattcttctactattcagcagtctccaaaacgttctattgcaaaagaacagcccaaaagaaatattaaacctcctcgaagatatattgaagaagcgaacatagttgcttatgctttgagtgtggcagaagaaattgaaggtaatgcagaaccttctacatattttgaggctattgtttctgatgattgcaatagatggataactgctatgcatgatgaaatggagtcacttgaaaagaatcatacttggaaatagggaagntggccaaacgaaaaacactcctatccgctcaagtggatcttcaaaagacaggaaggtatatctacaagtgatgaggcaagatacaaagcaaggttagttgctaaaggttatagccagattccaggtattgatttcaatgatgtcttttcccctgttgtgaagcacagttcaattcgcactatactcagtattgttgcaatgcatgattatgaactagagcaaatggatgttaagactgcatttttatatggggagttagaagaggacatttatatggagcaactgaaggttttgatgttcctggaaaagagaacctagtctgtaggttgaagaaatctctttatgggctaaagcagtcacctagatagtggtataagagatttgactctttcatgctttctcagaagtttagaagatccaattatgatagctgtgtttatctcaaaattgttgatggttcagctatatatttgcttctttatgtcgatgatatgttgattgctgcaaaagacaaatcagagatagcaaagttgaaggcacaattgagtagtgaatttgatatgaaggatttaggtgcagcgaagaaaattctcggtatggaaattactagagaaagacattctggcaagttatatcttagtcagaaaggttatattgaaaaagttcttcgtcgtttcaatatgcatgatgcaaaaccagtgagtactcctttagctgcacatttcagattatcttcagatttatatccacagtcagattatgatattgagtacatgtctagagttccttattcaagtgcagttggttcacttatgtatgccatggtatgttctcgtcctgacttatcacatgcattgagtgttgtcagtagatacatggctaatcctggcaaagagcattggaaagctgttcaatgaattttcagatacctacgtggtacatctagtgcttgtttgtagtttgggagatctagagatggacttgttggttatgtggattcagattttgctggagatttggataggagaagatcgctcacaggttatgttttcactattggaggatgtgctgttagttggaaggcaagtttgcaagcaactgttgccttatctactactgaagcagagtatatggctatttctgaagcttgtaaaaaagctatttggcttagaggtttgtacactgagctttgtggagttacgtcttgcattaatatattttgtgatagtcaaagtgcaatatgccttacaaagtatcagatgttccatgagagaacaaagcatattgatgtgagaaatcactttattcgaggtgtgattgctgaaggtgatgtcaaggtatgcaagataagtactcatgataacccagctgatatgatgacaaagccagttcctactactaagtttgagctttgctcaagtttggttggtgttacagtatagtcttagagactatttggcgcgcggtgattttacctacatgaggtatctttggtgattgatgtttttatgctacaagaggaaattcgtctcaaggtggagattgttaaatatgtgatccgaattttgggcccacaatatattcggattagtttcctagtaggacttcatgtctatcctattatgtgtccttctattatcccctatatatactcttgtaagccatacgggaaggggtgacgttcccattgtgattcccctacgtttgtaatcaactcctcaatagtgatcattgccggtcggcgcccgtggttttttcccgcaagggttttccacgtaaaaattcgtgtctccgttgtgcatctattttcataacacacaattatatttacagatttaaggttctaactgcagcagctgacagataattacacacatgtttcaacttgagtagcgacagtttatttttcagcagcttgtaccagtctttccattttttccacaatgggaaattcattccaataagtaggaacatcaattgatcaattccattgatcaacaatgggagagataacgttgctgcaaaatgttgttgatcaatcacaagtatcctctgcagtcatgtcatgtaggaaaaacatcattgaaatggaagtgctagctgtgattctcttatgatggagcatgaacgagatcaaagacatcgcagttcacacgaaaataaaaaggattttaaaaaagtgaagcagtttaagctccagcatgttattctttagcttacaacctgggactagctttctgcttaaagtcaaggccttggatcatcggcttcatccttcttgtagcagctcacaccaaccggacgatcgactttactggagtttatcttgagaaagggtaggtaggtaatacattctaccatgagacacaaatcacacaattaataacccatcagttgcagatttggtaacgatcctgcaaggaagtcacaccacagagagagtcagcataaggatagtggttagcatttcattcgaaatcaatcatgtataatgatgttacaaaccatgatgactcatctggtcctgaatctgttactttaagcacagcagcctagcgactgcagattgatgggcctttggttctagcaaacaaaagataatagtaataaaaaatgttatgtattggttggataatatgtagaccacagcattccatagtcaagtttggcataagatgattagaaggaactacgtatactcaaactacatgcaatggagctatgagtttccagagaaatgttaatacaattcaagtaccgcgacagttagttctacaaatttaagctgctgtccatatcagacgcattaatatatatttttttatttattttagataatattataatttattatttattcgtagtaaagcacgtgcattcagcttgcataatagtaatggctacagtagatataactaaattcttttgtacccccaaatgcaattcaaaaatttgaagtgtttaggtcacaccactgcacaagtgagttatcgatgtgcattgtactctgtacatataatcgtattaatggttgactagagattctatacaccacactgcaaacttttagcaataaatcgcggtacatgcttaagccgagagttgccttttagggcacccaccaaattaaattgagctcctggctatctattatattatcaaaacagctatgaaaggaggcaccacgtttgctgtggatgctcgaaattcccatattaatcggagaaaaagaaaagaagagtcaatctaaaaataactgaaattcggaattaaaaatatgcaatattgatagatgagtccatataggaacccaatacgtgattaattaaaatttggaataataataaaataaattccaaaattagaaaaacaaaaaaagaagagttcgagtacgtaggtgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttgggggatctgtgtatgaaggagctacaaagtatgagccagcccctcccttgttctgggttccgaatctggaaaagtccagtcctcctctaagtgggcaaggtcctccttttatatcttaaggggataccacatgcaccatctccctctcttctgtggggacttactctaccttttcataaatggacggagatttgtatagttgccgtccgaatgaccttctgataggacggcccatacctacctccacttccgccggaagcaggtgcgacgtgggattatggctgtctgctgacgacatgaccagtgtcagactggtcac

SEQ ID NO: 46267 - DNA, 1021 bp, Oryza sativa
ggcactcgttgattgttaatttgtcaagctgaggaaatgctacctcctcctttagagttccatcgactgcctcccatttctgaaagatatccaaatcatctaattccatttccttcaatgctggaaatgcagaacgacacacggtgctaactccgctagacgattctgaaatcacatttgacgcttttggtaaggcagttagcctagggcaactttcgataaacagcttttcaacctcaggaaatatcagctcttctccttttacctcatttgtgtcccaccatggctccttgaaatgttaaacacagcggtgatcactctgatccccaagaaagactcccctacactgctgaaagactataggcctataagcctcatacatagcttcgccaagttagcagcaaaggtcatggcacagaggctagccccaagaatgaatgaacttgtgccctacacacagaatgcattcataagaggtcgatctattcatgaaaacttcatctttgttaaagggctcgttcagcaataccacaggcaacacaaggaaatgattctactcaaactcgacatctccaaagcctttgacacagtgtcttggtgttttctattggatatgctgaagtggagaggtttcggtgccaagtggagattatggttggtatctctgttcctcacggctgaaaccagcatccttatcaacgggaatgaatcaaacccttttaagccggctaggggattgcggcagggagaccctttatcgccactgttattcgttctggcaatggatgcactgcaagcagttgtagctcaagcgaaagcaagtggactgatatctgaaccagcaccaagacgcccagttccaagtatatcaatatatgctgatgatgcagtattatttttcaaaccaagtcaacaagaagccaaggtagtcaaggcaattctacagatttttggtgcagccagtggattaatgaccaactacaataaaagtgcaatcactccaattcaatgcagtcaggaa

SEQ ID NO: 46268 - DNA, 8456 bp, Oryza sativa
  unsure (1)..(8456): unsure at all n locations
ttcctgcagcccaggcatctgggcatagtattaaaggattaagggattatgacaagacagaataaagttcaattaaaggagccattcatacatgcatatgaagcagctgttttgtgtgagaccaaatattttacctcatcctgtgcgaagcctgaagcttccagttcagttagcagttcccttgccttctcaaagagaccacctttagaatacacctttaacaaagtggtgagtataacctgcaaatttaatttaatttacaaattagaatggcaacagtagcagaacattttcggtgaacaaccaaagagcaatatatgcaagttcagtaaagaaacaaccaatcaagataacatgtagttatagttgatatgtggagacttaagaggctttttaaaaaaaaaatttatcctggagcactacattccaccttaacccaagctatcgaaagctctattcaatacatcacgtgccaagcggcaagtaaacatggtaccacaactttgatggaatttgatgtgcaagctttctctacttagtgtgagaatgttctttccaaccatggcatttgtttagtgcttattgatggctatcatagggcagtatttgtttttcatatacatcgacaggcatcattcacagacattacgcggtgaagttagaaggcactaccgcactagtaccaaataaattatgcagctggagaaaccaacttttgcaccaaaacaccaacaccatatactatgcaagctacaacctgtatgtgctatctagcatttcaagtcatccatagcaacaaactatccaacctgtggtgtaggtatgcattatatctaatgagaaatcaattctactgccataaccaaaaagtgaaataacaagactggggtctcctgcaaatcataaaactcagcaacagagttaattaatactccctctgttctacattataagacgttttggcctctccattcttcgtctagattcactaacatccatatgcatttagacacatatgaagtacatatatgaatccatgcataaatctattagaaaacaaaatgtcttataatgtgaaacagaggaagtaaataacaagaataagaagcaaaccttgttcggtgttaaccctgaggacctcaaatctttcatcaacagatcagccttttcataattagcattttctgaatatgcattcaacagagagctataatggaatagattaggcttgtgtccttcgtccttcattttctgaaaatattcctcagccttctcgcagcagttatgtgacgcgcatatagccaggagagtgccatatattacactatccatctgaaaaccacgggaattcagctcattaactaattccatggccttagtgtaaccctgcttcaacttcatgcaccctgacagaagctagaagtgacaagagaaacaattgaaatgctacaccaaccaaagtaccaaactaaatgctaatcagagaaaaagaaaaggtcatagtcccatacggtactgtaggtgaacagatcgggtgatagaccttctcgtatcatctcatcataaagcttgaagctgctatcgaacctcccgttcttcaccaagcacccgaggaccgagttacaaacggagacatggatccttgtcgggttttctcggatagcaccgtacacttgcagcgctcgggcagggttgcggctcaacccaaggtacttgaagtaactgctgtaagacgcaatgttgagcatgtcgtgctcctgcatccacccgaagacctgaaacaaagttcagactactcatgcctcactagtcccatcaatctccactcgcctgattgaacttgacaaccactgaagactaccttagatagctcatcccagcgcctggtttcaccgtagtggcgcaggattatgttgcagtcctgtgtctgcagcacatcctcgaacctgtacagcatcaaaggtcagaattcgcagaactaacaactccaaatcgagcaacaataatcctaccccaacacctcagtttctcttgttcctccctctgaatccacgtttcgatatatccaattcgcgcgaattactactacgaagacgaaaatgtagaatgctccgatagagctacggagaagcatatagtgggcggcgcacctggtgagtgcggcgacggggtcgggggcggccttgacctccgcgacggcgctgcgccgaggcgacggccgcggtggcggcctcgaggcctgcggggcttccagcgcccggggggcggcgcgggcgcaggagatgttccgtcgggagcagcacgccgccgccgccgccgccgctggcgttggatgaggaggaggggagaggaagcggaggcggggagcggcagcgacgcggcggcctccatctcgccgccggcggggcgctgctgtgttcgcggcgcgacgcgtctcgtccgttgggaattgggatagggccccgaggcggagggaatcgggggattgttttccccttctgggcttgcttgtatttgggaagcgcgggactgggcttatggagggataccgggcccgatccacgtggaatatttccccggcccgaccttaataatattggtataaagacaacagtttttgctacagcatataagagtatttgccaatattttttctcccaaaaattcgatggatataaatatagtgcaatcgtaatgtaattacatcgtaacttgtatataactacaatatacaagttgaatgcaactttcaaaaattttgtgatatcatgctattttcgccaagcggaggtctaagagaccaaatcctctcgcttgtgtgcgtgctgtgacttttttcatctcctcttgcatgaatctttaagcaaatttaaagatttcaaaattacataaaagttatataccagttacgttgtaattatgtgtaagttataatataattacaactattattgtattgtatttacattttacaaatgtttagaagaaaatttatcaacaaatgtatagatattctaaaaaccccaaatgctgattttcacggagggcgagagctgggcgattttagggtttatggccggatccaatatgcttgatctgtgttgatccgctcgtgattggtttggtttgttttcttgagttgattaccgctacgtattgtatacgggagcggatctaattctgtttttgactgggacttgacctgtggtcttgggcctggtatcgacgttttcctgttgactctccggctgcaaaccctagtttgttgcaactcgtcttgacggtggtggtctgttttcttccacaaacttttctcttcctgacggtgggggcgactaaggggattccagtgaggtttctgcctgcccgaagccgtcgggaagtttagggttttggaggtacatactgcggcggctgttctgagtttggatcaatggcatcgaaggagaatagatccgaggctatggtttcgggggctgacgggataaaccaaggcgaaaacttggatccaattggtgagggcttggatgatcatcatggcaacctagatcagggtttgtcgagcgccatggtgcttttcaaaaagaagctaactgatggtgaagaggaagatgacgatgtcttggatgtggaccttggtgaagaggtggaggagatgaaatctaagtggctgatcattgctcgcttctactcaggacaaaggtacaatgtcaaaggcttgtttgaggagatgagtattgcttggaacctgacacaacagagaaagactcggttctttgggggataatagattcttggttgagtttgcttgcgaagctgactacaaccgagttgtgtatgggggcccttggaaacataagggtgatgctcttcttgttgtcccgtatgatggccttgctagaccttctgaaatctgtattgaatcgctccctctgtggttacggatatacgatcttcctgagattatgatgactactggtttcgctaggagtttgggtggaaagatcggggaggtactggaggtaggaggagctatacacgacttcctgcgggttaaagttgcttttccgctatcctctcctttaaaacctctgttgaggatttggattaaggataaaggtgttatgtcttttccagtgaagtatgaaaatgtgccttttttctgtttctcgtgtggacgaattggtcatgcagagcgggaatgcccggaggtgggatcgtctagcgctcaggtgcgctttgggaaggagcttcgagcttcaccgttaaagaggaaacttcagagttttgctccctcttcaatctctaccccaaaagctgccaaggtgctgaattttagtggtgcccaacgggagaaggttcttactgcctctagttcttctaaagcttctgtgcttagtaatccaaagttgaacagcggtggcgcgactatgttcttggttggggagaaagcggatcaggaagagaaggcggccagtgttgaggcagaagcctcgttgtatccattgccgaagggaatcaccgcagctctagaggaaggtgtctctcagatgaagatgcagttagacgatggtgagctgaacttggcagctcgggggccatgcagtagagagcgagtgtccatgagttcagattatgggctgtcgggggaggaaacaccgcaacatagtgccgggattgtctctggtgtggtgaaccaagatgtaaagtcccctggcgggcaatccaaaaagaagcaatgggtgccaactagggagactgatcgtgcagttaaagctaagagcctatccataggcagggatattggcaaaccaaggaagataactgtcagattatcagcagatgcagtagaagcgtacgaacgggaggccaaatcctagagatcgagttccgaacggtctggtggaaatcctcctacaggagtcccggctagtgttgacactgatatggtgatggataatggtgtgaagaaggaactgtatgcagattcgggaacagctacctggtgggcggctcacggcgagccccaccaggaacaatgaatgctctagcctggaactggtccgtcttgtgcggatgtacagcccgaggctggtgtttctctcagcaaccagacaagatcaggagagagttcagggtctcagatggaggctaggtttgaagaattgcctggccttgaaaggagaaggatcaggtggtggagtggcacttatctgggatgaaactttatctgttcatcttttgtctatgagctgcaggtatattgatgttttaataagtgaagcaaacagcggtttccaatggaggggcacctttgtgtatggggaaccaaggatgcaggaccgccaccttccaatgctccctagttggtgatgggtgatttcaacgaaacaatgtggtctttcgagcatttttcggcacgacagcgccctgagcctcagacgagggatttccgtgatgtgctgtcccagtgtgatttacacgatattggttttgtcggcctgccgtggacatacgataataagcaaaaaggggaccgaaatgttcgggtgcgactagatcgggcagtagcctctcctagttggtctgaccacttttcgggtgccaagttgacgcatttagtgtcttcgaggtccgaccactgtcctatactgcttcgggtggagagagagaaataccgacctgtcaaatgtttccgctatgaaatcatgtgggaacgagaggattctttgggggaggctattaagctggcctgggagcaggaaggtaccgctttgaatcttggggagtggagtgtcagggtttttggttctgtgtcgcaggagataaaggagatcaaagctaaggtggaggaactatcaagtttggatccaattaaccatgacggtgagattaggaagttgtatgcccgcttagatgagctgttgtatagggaagaaatgatgtggctccaacgatcgcgggtgtcttggttaaaggagggagaccgcaacacaaagttttttcaccgccaggcagcttggagagcgaagaagaataagatcgattgtcttaaagatgaggatagtagatatgtcgagaacaaaggagatatggaaaagttaacgagggatttctttcaaaagttatatgcaagagatgagggagtggatcctggtgagttagtggacttgtttgatgtccgggttgatgcaagtatgaacttggagctttgtaaacctttttcggatgaagaaatttcggatgcactcttccagattggacctctaaaggcgccgggcccggtggttttccggctagattctttcaacgcaattggggagttttgaagcaagaggttataggtgttgtccgtagttttttctccgaagtggtgatgccagttggtgtcaacaatacctccatcatcttgattccaaagatccctcaaccggagcagctgaaggatttttggccgatcagcttatgcaacgtcatatacaaagtggtttctaagtgcttggttaataggatgagaccctcttncntggtatcatctcaccaaaccagagtgcctttattccggatagaatgatcacggacaatgcgttgattgcttttgagtgcatccataacattcaacgggaatcgtcgatggggaaacaattttgtgcttataaacttgacctaagtaaggcctacgatcgtgtcgactgggaattcctaaggtgtgtccggattaaagtcggcttctgtgaaacctgggtgagatggataatgacctgtgttacaatggtgaagtattccgtctctctcaatggtaatctgctggaaccgttttcgccaacccggggcctacggcagggagacccattatcgccatacttgtttctttttgtagctgaaggcctctcgacgattctgaaccatgaagtggttgctgggcgacttgaggaactgaaagtttgtcgaagggcgccgggggtttcccatttactctttgctgatgatagcctgttgtttgtcaaagcatgcccgcagcaggttactgtggtcaaacaagctttgtcgttgtttcagcgctgcaccggatagcttctgagcccaacgaagtgctctttgctaacaagtgctcactgtcctagtgatgtgatcgaggaaatcaaactgatctttcaggttgaatctgctaccttcgagagtaattatttgggtctccctactctagaggggagaatgacggcagacaaatttaaaacaatcaaggaacgcttgatcaaaagactgaatagctgggcagaaaagttcatgtcgtcgggagcgaaggatattcttatcaagttcgtggcgcaggcaatacctacctatgtgatgggggttttcaaactttcggtgtcatcctgcgaagcttacactaaactggtgagagacttttggtggggtgacgaggaggataagaggaaggtacattggacagcctgggataatttggttctccctaagtgcatgggtggactcggatttagagatgtcagaattttcaatcaggcgctactggggagacaagcctggagattaattcagttcccggagagtctatgtgctcgcattctaaaggccaaatactttccaaactgcgatctgattgatgcagtgttcccagctgatacatcgcagacatggaaaggaattgaacatggaccgcaacttttaaaggaaggactgatctggcgcattgctgatggcaagagggtcaaattctggaaggaccgttggatcccaagggagtcctcttttagggtgtcaggtatgaaaagtcgatgtcggctccgatgggcatcacaattcatcatccctgaggggaattgttgggacgaacagctaatcaggcgggtctgtcatccttttgatgccgatgaaatgttaaagattaagttgccccaatttcctactgatgattttctggcatggcactttgagaagtatggaatgtacacagttaggagtggataccgtgctgctctgatgaagcaaatcaatacggactgtgtctcttttagctcggctaactctggtaaaaggctactctggcgagccttatgactgctcctgtaccaccaaagatcagaatttttgcttggagactagcccgtaattgtctggcaactcannnnnnnnnnnnnnnnnnnnnnnnggtgagggatggtaaatgcagcctgtgtggtgtggaagatgaggatggttttcatgccgttgtttcttgtactcgatctacagccctgcgtactgagcttcgctgtgtctgaaatttgccggatgagcaacagtttgaaatgatggtccagactggcttctgattctgcttgatagactaagccctgaagagcgagcaaagctcctccttgtcctgtggagctcctggttcttaaggaatgacagcttgtttggttcaggttcatcgactgtccatggctctg

SEQ ID NO: 46269 - DNA, 2546 bp, Oryza sativa
gagattatgatcggacgagacgtaatcagggttgcatttaccgcggtaaaccgcgcggttaccgcggttaccgcgcttaccgcgggggtacggtaaggggtaaaccgcggtaaccgcgtcaaattcaaataaatttgaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctggacgtaatatgttgagatggatggagtaattgcaaagggccctgccaggatgccagaaattcaggttcgcacaacttgagcatgaagctgagggcctgtttacctcaatttttacaccatcaagtattaaacatagttttaaaaaataactaattacacagattgcgactattttgtgagacaaatcttttaaacctaattgctccataatttgacaatgtggtgctacagtaatcatgtgctaatgacagattaattaggcttaataaattcatctcgcagtttactgaccgatactgtaattagtttttttattagtgcgcgaacaccacatgcaacaccctatataatatccgatgtgacacgccaaaattttacacccctagatctaaacactccttgaagtaggatcatgttttgatggtgcaggatgtgcaaatgagactgacggtgccagtagttgatgaatcagaccatatggatgccgttgaggatggggataggaattgcacccctgaagcactctggtgtcattgacaagcaacacaaagggcaaaaggtgacctaagggaaataagccgaagaaaaattctagatatccaaaaagtcttaactcaaggcagaaagatttctggggctctgctggtaatagagtggttaatcctgtcacagagaagagattgctcaaatgatggatgctacattaaccaaaataattccattcaaagatgaaacctgtgaatctccattgtttagcagtaaactagaagtagatgaactctaagctataccgggagttaatgaaaagtgcaaacctattacatgtatagatacaactagccatattctccacactacaaggccttgtagttatacatgtagctcctcaaggtgttgatatcttgcattgactccagcatagagtggtccacatagaggctcaatgcagaagcactgcccaacaatatagataaaacgaacaatgttattaacaagaaatgatcctcttggtctgtgaaaaacagatagaaggaagcaagaaagcatacatcaaagggccaaacgggagccatgctacatcccatcgaattctcggtaacctgtagcacaagagtaaaaccaatcaaccaatcaaattacaagttctagccgttgatggttggttagtactgtttatgtggtcatgcataaaagaccattatcataaaatggtaataacaatgcacaaagcaaatagttactagtagataatgtgatacctcaagaggtagtatgtccagaagagggctactagtatgctgacatagaatgaataccacatccacttcttccaggagtgaagtaatcctttaattgagaataaacatgctagggcagctatccaatctgcaatattcaaggtaaggtattaatcatatcacaagggaagtaattttgatttagcaggacaaattttatgcctgtaagttccacattcttttatttgttttggtataaagtaaaacaagaattacagagggaatgagtttagatgatgattaaccaacaggatcaataaatgcatcttgtgtaatactatcatgctataagtgacatgttccctaaaactccgagtagaaaatgtttgcagactgctaagtcattggaaaagaaaatagtatgataaaacaaacaagagcaaattgtagtttgcgcattgcctttgttgcaatttggaccaccccaaacttatcttttcagcacatcaacgacctcgagcgttttggctccaacgtgccaatgaactctcacccatgcacaaggcatatttttgccataggagtggttagacatgagaagagaagagagttggggtggtccaaagtgcaaaaaaatatagcaaaggcaaacttgcatttgaagttgctaacttgagcaaataagaaagacacagctggctcagtgccatcagctatttcaatccaagtaacatgtagacatttcattatctgtacttgtatctaaaacttccaccctctctctctattttttttttacttttgtaacagagagaacctctggttcatttattgtgtgcaatgcaaatatgatgtaagcataattacctgcaactacgaccatcggtgatgacaaatcttccatgaaataagcatgataccgctgtacattagagaagcatgtgtcaaacaacatgacagaagcacagcgcaatgcaatcgctagacagtcattacaaagaaaatcattaatacatggtatagcagatagcaccagtt

SEQ ID NO: 46270 - DNA, 2919 bp, Oryza sativa
aattggcaatcctcaaggaaacaattttgtaactaatccaacgcaaccgaactacggcatgtgtgctaccatatgccaattccgaatcttatgccaatcaatatcaagcaataacaatgagctcaaccaagtgatgtctaagcaaagcgccatgaaatggggaatgggggtgacggacagtaagtaaaccaaccagttcccacggggccgccgcatggtgaaagccggagtagacgaggaaggccgcgtagccgaggaggaacccggcgaagacgcgctgcacaacacaacacaaagggaacaacaggccatggccgggtccgggcgtgagcagggaggaccaccaaaccgaatcgaatcgacgaaacaaaaccctaagccgaacgagatcggggatcggcagtgggcgcgcaccctccaccggcggctctgctgcgcctgcttctgctccagcgaccggaccatctcctcctggtctgcgcgcagtccacgaacgggggtgatgacaacgagagagggttggggaaggagaacggcgcgcgcgtgagatggtgcacaccttggatgtccatcgggatgaggtcgtcgccgtcttccgcgccgtcgccgccgccgccgccgcggcgcttccaccacctcctcgtcgccgccgtcgtcgtcgtcgtcatccgctccgatcctgggttggaggtccgaggtttctgatttggaatgtgatttttgtgaagttggcgtttccttctcttggaagagatattgtccggtcgacaattcaggtcgactttggctcaaacgaattcatatcaattttagaggattttaattctatagaaatttttctaatataattttttaaatcctataaaatttctatggaatacctcttatcgtgcaagttttaggggaaatttaacatcaggtaaaattcatggaaagaatcaagtgatttttttatctctcatcaaattcctttgtttttcctatggtaattctctgttttacacatgtatttctatctgaatccgtttttcacttgtattcctatctgatcctaccctttttttatttctttgatttttttattcctgtgattcaaaatagccctcaatatacacaccgtggcaaacagtaatggtctattctcctttttttcccctcttttaataattgattaatggaaaatagctgcttctaatgcatgttttgttgtgttcacaatatagaccaccaagacagtttgtcatgcacatattttatttttttcccagtgtactactaatgcactccatcaatagaaaaatagagttttatttttatttttccgattacacggaacaagcacacgcacacatatcacatacccacgagtatccttgatcccaaatcctattaaaaacacatctgcatgtgtataatattgtccctaatatttatgagcactctgatttaaccagaatcctactggaagcccacctacgtaatattcatgggccctccttgatctcacaaataagagtatgttcggataatccccttcacaaggtgtaaaattatttccaattcaatcccctccaattcctcgctctttggattatccagacaagacaagcctttaagggggcagaaattgagatatgcaaacgcatagacaacccaacataccgccgtaactttccattaatattgagtttgtttcagctcactgctctcaacaaaaaactcatccgctgccttactgcccaatcaggcacatataaaggcaaaattggaaaaagaattgcctcactgtaatgtcgattaatacacatgccctttttcccattcggtgatgtttgcttcaagaattaacgctcaagaggggttgaaagggcaagactttcgaaatacttcatggcgcatccccttcgtgtatctctccctcttcaaatagatcatcataagcaacaagaacacgaatcctgtctgctaatggtttgcgttcagctttgttattatcaggtacatgtggtgacttctccgcgtcaattaaccgctcaggatcatccgatacttccttttcaccatgtggttcaatatcctcgtcaattagcgcacttccctgtgagcttgcatcttcatttctgcttgtttgcggcctgccttgtttgtacctgaattgcttctgaaaggagaaagcaggtaaatcaattaattagtaattaaacagtggtagtggtacaaagacgtaaacttgtgatgaattattaacagctcataatacaaaaaataccatcaataacaatttacgtaaaggaggtttagaaatgactcatgatcaacatagttggcttggataatataagtttgatggttatatttattttacgtaaaggatagtaatgaaagcactaaaagcatccaaatggaaggaatgttaagaaaaacaagcatgttcatgacagtgtcatacctcaagctcccttcccttcgccataatttccttatatgcctttggctcccgtgacttcaagatgttccacaggattccaccaccggtgcggaagcgacttccatcagcaacaatctggcctccacacttctggatggcctcaacctggaacccaatggctttaataataatagataacaacttcagaaaagtaaaactaagaatattacatactattcaccacaactgtgatttaacatcacctacaccaatttatccataactcgaatgatttttgggcaatctagacatttcatgtttttcttacatacaatctgaattatataacatatacataactatgaacagaaacttaactgcaactggatttgccaccaatcaagtacgcagattgcaaatattattcagactcttctgagaaacgccaaacttctcaagtacacttaacaaactaatccatgtaactgcaa

SEQ ID NO: 46271 - DNA, 1220 bp, Oryza sativa
ccccccatgacagtaagaagcaaatgcaattctctcagcaagagataatcataagagaagccaaaactcatgtatcttagcaagcctagccctcttaaaactccagttttttatagccctcttacaatttttaaaacaagggatagacgttttctcgcacaaaatgcaagtatcagtctgaatctattttatatcaactaaattaaaacagaaaactgcagtagtagggggcataattgagttaacgtcagtaggaagtctctttctcgcacaaaaaaattcacattaactatcatagatacaattgtggcacaagtcgatttgggtttactgctcccgacgattgtggacaagccaaagttaaaagagctcataagcatcaacccaaactaaaccctaggttagcagaaaaacgagggtttatacctgttaatgtcggcgatcttgggcggcccgtcgggcttccccttgttcttcgtcctcgcggatttcttcctcttcttcttcttcttgttcttgttcttccccgcctgccccacgccgccatcgccttctcctcctcctcctcctcctccggtggcggcggcagtgggggcggtgatggctacaggatcctcctgcgcctgcgcctcctatacggcgtcgtccgcgtccgccatctcgacgtcatcgccgtcgtagtctagggcttcctcgtcgagcaccgcgtccaggacgctgtcccctccctccatgccggcgcgggatcctccaccaccaccaccaccacgatggggcgccccgctagggcacgaggtgacccacacacgctctcggtgaccgtctcctcccgtcctctcctcgccgccgggcgtagggcgaacaacgatggcgatgaaggagagcgcagcggaagcggcggcgatggatggaggggggaggaggcgcagcgcagagtatggaggctttgctccacctttggttaggccttgtgggcctgctactgggctgctcgaccctgatatggactatggagcaggataccgacttcaagatttaagctggttccaactccctactcttgttttccacacacacgcttttcaaactaacggtgcgttttttataaaaagtttttatacgaaagttgctttaaaaaatcatattatctatttttgaaaaaaattaacaaatacttaattaatcacgtgctaatggaccgcttcgtttttcatgcgcgg

SEQ ID NO: 46272 - DNA, 1893 bp, Oryza sativa
cttcgacaccattctccttctggaagttctccaaaatacagcaaagggtcctctcagtggcagtcaatgttgagttcaacatatgaacgaattgcttggattgctcatcattctgcaatttgaacatcaaatcagtggcaataacagatgacttttaagataatttgatctaccagcatccaagtgaaaagatacctttttctggccataacctataccaagtctccttgcttgaaaatctgtgcaatttgagcaggacactaattccctataggtttttgatgcagggaaccatgcttctaaatcatacttcttagctgcagcatcattaagagcaccagacacaatggagacaagttggtacggtaggccaatctgtataatagacaatgaagaaatgattagacatcaaaagacagttccgcatgtaacaaggtgcttaagatgtgtgaagcttccgatgtctacctccttgtagaaatcttctgaattttttatcatttcttcatgcatctcccaggattcattgtcatttggacttgtaacacagaattgctcaatcttttcgaattggtggactctgaagataccagccgtgtcccttccatgtgaaccagcttctttccggaagcaggtggaatatccagcatatctaaattggcaaaactatcatcaaactgctagcgcacatcaaccaaaccaaactacctaaatttagacattacccacctaattggcattcagcaggataaattcgatcacctagatgatacgcacacagcggttgctcggatgtagcgatgagatacttttcctctccatcgcctgttagctgtcaaatgcaactatttgttatgaacttgttacattaaagaaaaaaaactgacctcataccactgaaattacacttgatcagactgaatgtatcatttccggactgcttaactataattactgcaaattcgtgaacatagaacagcaaaagaatatataaaacataatttaattcatgaaaacattagaaaccacaaccacgattctcaataccaatgatgtataaaaccagagtttcatttgacttgccttgtaaagctcttcgtcaaattgggccaactgggcacattttcccatggtttcctttctcatgaaaaaaggagtttgcattggcttgaagcctcgctttctcagaaaagcgagtccaaaatttatcaatgccaagttcagtaggacaccttcatcctttaaatagtaaccccttccacctgctacatcagcacctgcaaaaattggataggcagtaagtaacctataaatttgagagaccaggaaaaaatggcaacagtgggattctgtgaatagatcaaagatcatttttaattttaatcaaagagtgagcaattatccatatttctaaatgttggtattctactattctcccatccttggagaggtatatacctccctattgttctagtgacaaaaaaaaataaattgattaaactgattagaagataaattcatgattggtaatgacaaagcatttctgattcttgggaagagtacatagaggtatatataccacatattgttaattactccctccatcccagtttagagggcacatattacttttttgttaacatcccaaaacacaggacatgctggggctttcagccaaaagtgcccggctaatttgcatgcatgcatgcgagcgaggaggtattggtcgaattagttgcgtgtgcaatctgaccccggttaaattgacctattggtttcatgcatgaggaaaggaagtgcttgaactatctacatttaataggggtagatcaggaagaaaataaactgcatgcaagcttcttggtcttagcaaaatactaggctgcaggaatt

SEQ ID NO: 46273 - DNA, 1523 bp, Oryza sativa
tccccatgtccgtacaattaaattgttagcctacaaagaaagaatcaatctctatatctagatatataatttcagaggaattcagggcatctgtttcgaatttctacaattggacatagaaaaaccacaatcgatgaacctagcatatctcaatcaacgcaatgttgttcgtgttactaagccatactaaaatggaatagcaaaaactttttaatccacacaactatagggtttgcgctgaacagctgttctactgtctctgcattataaacaagtgccgggaaacctgcaaatctaacaaacttaacagaccaaaaactgtgctaatgatcaatagtcacgaaatctaagcattccacttttcaacacacctcgtcatcgctgacagggacggattcatgcacaatgtttccaatcgtcacgagcttggcatcgagcgtgcccttggcctcctgcacctccgtctccttggcagccaacctcttcttaatctcttccgtgctctgaatcagagccgacgcgtcctcctttttctgcacagcggcatgctcaccgtctcacacgcaaataaaaaaaaaccgcaatgtggccacgaaaatggatcggatcgagaagaacgtacagccttgagcttgccgatttccttgctggttttgttgagctcctgcggattttgtcgagctcgaattgccctgcggcgaacaagcataactagtggtcagggaagggacggcggattcgcaaggggttcgatcccgcccgggtgagtgagaagccccctctctcttactctggcgccactggtcgtcgagggcgatgacctcgtcgacgagctcgacggaggcggagcggttgctctgcgacctgcggatcagctccgggtcgccgcccttctccgtgcggaagaggttgatgtcgagcatcttcgaaggcgtgcggcggcggcggcggcggcgagcagagagggaagggtagacgaggagggttttgcagcttgtgcggctttctagggctgcacacggttttgacttttacgaggcggaggcgctcggagacggcggcgcgaggcgatggcgacggcgcgagggggaggaggcgggagagggatagggagcggcgcggggctagggtttgggtggggattttctttttctttttttaataccggctagaggaaaatgaagaaaaataattccacgtccattcatagggtatgtttacttcacactaaaattagtttggttgaaattaaaacgatgtgacggaaaagttagaagtttatgtgtagaaaaattttaatgtgatagaaaagcggaagtttgaagaaaaaatttggaactaaacttggccatagaatactactcccttcgcactttttcttcaaactttcaacttttccatcatatcaaaactttcctacacacataaacttcaacttttttcttcaaactttcaattttagtcaaactttcaattttggcgtgaaactaaacacaccctaaatacctatgatttggcctcaa

SEQ ID NO: 46274 - DNA, 958 bp, Oryza sativa
tgtgcataggatatgttgccatctccgtaacccttatctatagtgtactctagtcttttttttttacctcaccccttaatctccataaaaaaacacccgacattgctatatttcgagacgtttttatacctcaccccttaatctctgaagtagctatattttgagacggatagagtagttggcaattattttttaatttgagagtttatatgcccaaatgtatgttagaagtgcttaggtatgtttggataaaatatatttttgaaatttcataacaactttggatggagataaactttacataaaaggttgtacggctcgatgagagctacaactacaaaggttgatgccattttcatctgaaatcacttattagaatgtcaagttctcaaactattaactattgagagtctagtatagtatgccagcaagaagtgtcttacacagtgagacgataaggatattacatatggagagagggtatactggatttgaatcccatgcaccatgcgtatttcacaagattgcgtattcacctaaacgactacgaattcaatcttgcaagcaccaatttctccgtgtttactctttctttacctcgtgaaaacaggcaatcacacgccctgcttctgtctacagcatggttacccaggtagtcaggttacgacggtagacactcgcatttcgttaccgccttgcaaagtgaattcacgttcaaactgaacaaaattagcaagtatcacattaccattgaactgaacgcaatatggacatgaagtacagacagttaagactacggtaaaattgcacaagccatcaacttttgacgatgtagtcagtatcgacaggtacacgagttctgcactcagaagtcaagctactactggtctccaagagctggattgttttattagtagagctgaaggtcatcacagctgatagcagggctgcaggaatt

SEQ ID NO: 46275 - DNA, 2884 bp, Oryza sativa
aatctcgcggtttacgtccaagtccaacagatcactagctacactgaatatctggactctgaacatgaacagggtataaaacggaagatgatagaacctcacgcatcatgtaaaatagcagcaatgcatttatcatattatatatgtagctacaaactacatatagcaagctataagtatgtacagcaatgatggcaggtaatattgccatatcaattttcctgctatggtatgtacaccagagaacgagaacaatttagatgatttgggatggtggagcatctgaaataatgcacagttcttcagacttcacctacggttcaagcactactgcccccaatcgatcatcaaactacaggggcaagagaaaaagataacttgggtatattgcaggagctgagaatatttgctaagttttcttcacctatgatttaagcactaaaacccctatgggtggaactccaggggttggagggaatgctggtgcaagcctgcgcagcaacctttgccatcgcttcagcagagatgccagcattgcagatgtttgcaaaggaacgcatatgcttcattccatactgcgctagcgagccgcattgtgcttcgaaagtgcgtacctgaagaaaatgcagacccatattaggtgtgctggtacaaaatagattatcacatactaactgctgaaaatgcgagatagcacctatatattcactagttaagagctgaaataggtatgaaactgaagcaactgtctagagcatccaaaacgtgaaactgaacagtttatatgacaagccgaaagtcaaataaaggcttaccatagacttgagacaactccagtcataacaagaggttcgccagttgcacgaacagcctttagaacccttgggccttcctcagagccaaagagaaggtttccgatcagctcaacactgttgtcaacatgagatctgtgtgccatcatttcaagcaattgcttccgagcttcgtttttctcaggagaactctcaggcaatttgcggtactgcacacagtataaaaggaaatcaatcagctggtttattcatggaatgacaaaacacatactgcaacaacaatcaaggtcagtagattcctcatgatatgcagaccttctgccagaagtaaaccaggtcagcatcccgctgattaacagcccttgagaacgatggcaacgagttatcttccacaaatgtagcattgtcgttagccggattggaacccatgtacatgaacacatgatgggcattcagctctaaagaaccgtattccatcacatgtgacccagagtaatatgtgtgctgcacagatgtcctttccttgacctgctcagccattgagctacattaggcacatggtaacacgactgcgagttcaaaggaattaaggtctgaaatacttacgagattgtactgctgcttgagtgattcagttctcaggttgtggacatcgctgtcaatgttcatagtaacaaaatattagcatagaaagaagcggctaaaggttcaaacaagaagttgtttggatagaacttcaaaaattaatgtaaaacatatggtcttcatggctggatccatctcaaatgtatgcacagctggtggcatactcctattagacagtggagcagaacaaacaaatcaagcctcaaatttccaaggctatcagattcatggtaaacaggtgaaatccttgtattttggctacagcctacatgacaacagtttcaaataggcctaggtaggagcattgcttccattctactaaaaaaacctcagtcaatcttcagcagtagaacgtgtggacagttttaaggtgcgccacacctgatattaacatctggtcaagctgacaagctcacagagtggcctgtggattctaatatttgctccatgttatttctattagctttcataagtcagatagggattcagcaacagtcacatgcttttcctattctttaaaaagaagctcacaacataccccactacatgttatgcaacatcataagcaaatcagcatattgtgcccagcatgtgcacacaggagtaaacaaacacatgcatatcgttagtgtcttaaattaacacaacaggtagccaagtagtgtcatactaattagaaaatcatttcaaaagaaacgcatccgtacagaatctgaaagtactaggtgatgtgggtgcagccaaaactggttccacatgagtgaaaactggtaggataaggataggattgtatcataccataatggtagaaaagacatagagataacagaaatgaagtacctgtcttccatccaagcaacgctgtacaagtcccctaggcatgtgtcgtactccggaggtgggctcgggtactccccagggcagtatgttccccagctgctctcatcagcgtttgatgcagtggtggcataaacattgatgccatttggcaatagaccctcaaagatgcttccagattcacaggcttcaaggtaaaagacctgcaaaggagataacagattcatcaaatcaattctacaactacaagcagcagcaattatatagtgcagaatagccaaataactaatctgataccaggcttttgtacgtcccagcagcatgcttcttcttcagaacatctacaagatcatcaccgtagaggtatggataggttggcatccctgaaattttggaaaaagtcaaaacaataagaccatttcttgtttcacaagcatgaatatagcgatatctgatcctattggtttcatataattgcaggcaagtactcaccaaggacaccaggacccccatggtcactgtaaaaaatgaaaatatgatcgttggggccactgtccaggactttgccactcccacctttgacagcagtt

SEQ ID NO: 46276 - DNA, 2316 bp, Oryza sativa
caccgcgacggcggcgaggtgcgcgaagaggagcagcgccgcgagcgggggcaggacgaggcggaggcgagcgcgcgccgccatggcttcgcggcgagtcgcggcgcggcgctgttccgtgcggaggaagagaggagaattggttcgttcgcttcgctcggggggtttactgggaatttgggaaatttggttcgttcgccttctctccaacgtctcctttttattgctgccgttccggcgccggaggccctgggggtggtgggccccgccagctgtaaatgattgtttttgttagtgaaataaaatataagagattttcgctctattttttttcacgggaaatgtattttttttgtccctggaaaattgcaccttaatagttatttttcgcagtaagtaatgacttttcgaatttagttatcgatcaattatattataatttgtgaaggtgcttttgtggagcatacctttggtgcaacaacacacaagttgggcaaaggccaaggcatgtcaagtaagcagtgtatatgcatattattggtacatacaatcattttttttttcatagtggtattggaacttttaggttttataaaagagagttgagtctccaacttcatggtatgcttctattttgatgtaatatttatgcatggtgaaaccaagttattgtaattttaatagtacagtcgattgccagctgtattttttgtcgatgttatcttaaagatgtttgtacagccaactcatacaacaaattaactctaccacccttttcaatgtatttattgagagatttggctatttatacattgatcgctcctttcttcgcctcatcttacatttacagttgttctctacgctggcacacaacggtacgcactttagcatttctcaccaccagcatatgcctcgacactatctccatgatgtaactggcgcttagcctcaacgctacattgcgattgtcaccaataaggtcgatgagacaataccctcgtatagtggggcaacaccgagctcatagtcacgccatagccatagacatatatagcaacatgcatgtatcacgcgccttgctacattcacgtgggccctataaccgtggagagatagtttctaccgcttcacttaccttgtagcgcatgtataatccactatcttagctgccatctcacacacactctctctcatactatacaaataactcatcaacgaaccaatgcgaatatatatattatcatcgataaaaaaccgcttattgtttttattgtacatgctctcctaaccacatcaagtaggtaagcaaggagcttagccatatacacgcttccttcccacctcgatctcacccaactctaaacccttggtaattacaaatgatgatgatgtacgtactctttctaacagcagtcagcagcacacctatactactacagtgctacctacttttaaggggttgtatatatattatagcaaagatgcaaaaatatcttagccggtaaacaaaaaggccattgcatccaatttcatattttggaaaccgctctctctctctctactccaaggaatttttctgttgcaacggaagaggtaggaagggatggccctggactagatgagctgtaccgtggccaccctgattgcctgccctccaactaataatccgtttggtccgtcctagatttcttgtccctaagccagcttccctttgtccctaattaatctgcgtgcgtcctcccctctctctctctctctggtccagtgctagtactgtgctagccgatgtagggtttaggtgggccccacgggtcagtgagtagagggacaaccaacggcgacgacgattctgagatttcgccctctcgctgaccactgcgggcccacgcgcagccgtacgtacagccagctggctgattgccagccgccagctttataccttggccgttcgtttgttcgcggtcggatgggaagaagaatatctgacgtccgtccatttagccagctcagcgcgaacaaaatttttttctaaaattttgtttatgggctaagaaagacagatacaaatttagaattttttttgaaagactgatagaactagttttattttaaagaacacttacattacgactcctttaagcagagttaagaaaatatagaaatagaaaaatatagtaatatgatacgaatgcaagtgtaaaacaggaaataaaaactactaactccatcccaacatataacatattttgggtagatgtgacacattctattacaatgtccagattcattatagactccctgttcagattcattttg

SEQ ID NO: 46277 - DNA, 4246 bp, Oryza sativa
tttgttgtcattttaatatattttaataataaattgagaatatatatatatatatatatatatatatatatatatatatatatatatatatatattattgtatgcgagaaaatataatgatactaatcacgtaatctgcgagagccaccatgctagtttcttatacgttaggagggaggggtaccaagaaaactctaaacccgtgctcacctctctcatcaattctcttcattggtagcgcctcatgctaagcttaattttgataattatgttaattaaaaaaataaatttcgggtagcgtgtcacgcatagccagtcatcagtgtgcaacgcacctagtagtaagttctggactgtggggggtgtagatggaacgaccgattgattggctgactagctaagctagctgtccctgtgagtcatcatctgttacaactgattaattttgttactacgtgtacgtatgcaaccgcataatacaaatatattactactagtaggtcgtagaaactagccacgaaatacacacctgcaagctccgcaccaaacgtacgtatacctacctagctactttgccaatgttataacagctagccgtggcggacttgcacctattcttaatttatttttgtactaaagcagatgtatttaatcaacctgtaatagtagtacgttggaggaaagatgcaaacaacatactcttttcattttaaaatataaatatcgacatcgtcctgtcatttccgccggcgccggagctatttctcccgtcgccgatgttgtccaatcttcgccagcccgcgcactacagcgggtgagtatccaagcaccatatacccacatatgcatgcacgggtttgcactaaaacgggctagagttcgccatgcactagcatgccaaagctcaccgccgacactgatttcggttatcactgtacacgagaccaccaccattagcttcgcaatcctccactctacaaatcctctttggccgcacctcacgaaacccccactctacaaatcctcttttggccgcacctcacgaaaccccgttcaccgctggcgccgatgacaagcttgccgaccaccacttcctctgctccttctcacgccgagtcattgccatgtaggtctaagggcattcctgacatttcacatgatttctctctcctcttcaatcggaaattatttagtcagcacggtgtccactggcaaaataccatgattatgaagtgtccccccaaaaaaaagttagtattttgcgttgtcttagggttaaaaccatataatttcagcgtcctgtagcaaaatttgtcttctagtagtagagtcaaagttttcatctagggtccgtttatcatagatttcacaattcttagtttagatggttaatttgtcgatgatagccgtgttatagttttcacttttttctttaaaaaaagattaaccattttattgtaaatgttattgtaaaggctggcaaaataccacgattatagattgttttctcccaaaagttagtttttgcgttatcttagagctaaaaccacataattttagtgtcatgtagtaaaatttgccttatagtacaatcaaagttttcaactgggtatgtttatcatagatttcacaattcttagactgcatggtttggcaatgatagacgtgttatagttttcacttttttctttaaaaaagataaatcattttattgtaaatgttattgtaaagactggcaaaatacaacgattatgaagtgttttctctaaaaagttactttttatgttgtcttaaggctaaaaccacataatttcagtgttctgtagcaaaatttgtcttatagtagattcaaagttttcatttagggtccgtttatcatagatttcacaatttttagtatgtatggtttgtcaatgatagccatgttatagttttcacttttttcttaaaaaagattaactattttattgtaaagtttttaggtctgatcttacatatgaattagattatctctattcttctctcgaaatttcacaaactggaactggaagtacatccaagataatggcctcagtgatagtttcctgttcatcatggccatccactcaagtatagggatgaaaccggagcggatagtttccgtccgctccggataaaaacgaatacggatacctctcggatcggataattctcggatagttcggatacggatacgaatacggatattttctctcggatacgaatacgaatatggtatcagggtttccgtcggatacggataataattcggatatccggtgaacagtgctattcggatatccgcagaagccacaagacataccccatttctttataactctatgaccttcaatatacctttttagattttaatagtagttcatctcttaacactagtccacattattaatattatttaaaattttaaaaatatttataaattatactatattttatataaaatgatctaattatatatgttgatatttgtttctattagaagttgaattggttttcgtgttccgagaaaaatttgtttccgtattcgtgtccgatcatattcgattcttattcgtattcgagatagtccgtatttgtttccgtattcgagccatccgtattcgtttccgtatccggcaaaaaatatgaaaacgaatatggtatgagcattatccgtccgtatccgctccgttttcatccctactcaagtacccttgtaaaacagagagggcaaatcagaaatcctccattcctccccactcccactccccaccatgacatgtgggccagggtagctggcaggtaggtcccatctatccgtggagagagtcctcagtgcgctcggctgggctgaaatttctaccaagtcctcttcgcgcaatgaatgaatgaacgaaggaattaagggtgaatctttgagattactcctccccttttggatggggatcgaattagataggagaatctcaactctcgcagctctcacaaacgtcacccgcgacatcactccccgaaaccaacccatcctttttggcgacggcgactcgcatgggggttccttgcacccgtacgtgcaaccatcgcgtggatcacttggttttgcttggccggcacgaccgtattaatcacgttcctagcctcactaggaacttgggaaagtaggatcgagtaccaagttctgtgtgcagtgtctggatcaactatcaacgttttgaaaagctggcgtattaattcatacgtatcccatgatgcacacctgttaccagtcggggacgcacagatatatataatgaaacttgggctaaaaaatgttattgctgtgaaaagttaacagttaaatttaaagtagctagagtaaactacatggctagtccttaaatttgtcacgagatattttagtacttgaactatttaatccatggtttacaaatttaacaatgtgaggtacaaagtgcaattgatagagccaaagcgttggcatggccatccaccctggcagaaccttttcatttagcccattcactatataaaatcgatcatttagttgtataggccacatcagtgtcacacaaccatggtgcgccaccgataaggcactggatctcccaccagacaatctttgttatagttcaaatttaacttgaggttgtctataccttaaaacttggaggatcatagggatgaagagaccggtcgacacgttgacgccataggtaagaggggtcgagacaacttaaagcagtggtgtagccagctaggtgataccgtggtctatggaccacctaaaaatttgaaattatagtatatatgttagttaatataataaaaattgtatagtggaccaccctttaaattgacatattacatatagatgaaccacctttactttaaatcttagctacgctactgtcttaaaagaccggtcgtatatttactccttaaaatattctcatatagtcattttattttgataatgaacgttttttttaactccggttcggctcatgcatatgctatagagttggtttgcgcttgaaataatcataactgttaagcaagagaaacctagaggatgtacgtattagtaataagatgtttttgttagatggatctccctccccttgagcccaacggctcaagggggccttgacccgcgccctgatcgggggcgcccagcccaatggctggtgggcccccgtcacactgtgccatataaagaggggtggag

SEQ ID NO: 46278 - DNA, 4223 bp, Oryza sativa
tgtaaatagaaccacccgactagatctaaacctaggtgatccaatagacaaccctatcaatggtatcagagccatcctagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggaggggggaggggcaaagaggcaccgccgaggagccactcgacggccgcgcgcgcacccgcgggtgcacgcgcgcgccggtgagggggcccgcggcggcgccgccatctccgtttttcggccgccgctctctctcacacggtgggggctagagacggtggagggagcggagaagagaaaaggaagagggcgcaagggccgctggcggcggcgacgccgctccgctcggccactccgcccggcggcgcgctagagaaaaagtgggcgcgcggcagcgcgaggtcgccggccatggcgcggcggcgcaagggtcgccggcgtagatgacgccactcggcgcggccgcacccgcccgcaagagagaagaggctagggtttcggccggccggcggctggggtcgggttttttttttgtccctccgatctcagcgcccggccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgcgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaattttgaattgtttttgcatgttttagctctgtttaaatttgaaccaacgggagaattttacagagagtaaataacagagtttttgttattgtttatacgaattgtacatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgtcatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcctttatcttgggagaggtggactgggtgttgactaccccatgtcctatagaacctgctgaaattttcagaggtgaaaaagagtcagatgctaaatggcaaaagagagagagggacaatgcttgcctcatcatgtcgtatgacatagagcatgcgaaatggtcttcagccaacaagaattgtttggctgcggtaaagaacacgattgagccaaccatattgggctcaatcccagagtatgacactgtctctaaatacctcgaaagtataaagagccagtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgtaagaagacaagacattccaagaaagatcatcctgacttcctgacagtgatcatggcaaagaaaggtgagaacattattacatttgtaaagaatctcattatgattggttattctagatccacatggtggatttattctggagcaactattcatgtgtgtaattgtttaaagggattccattcaatgaggactacgcaaagaagtgaaagatctattagagttgccaatggagttgaagcaaaagttgaagctgttggagattttcgcctagaactcgcgaatggcttcacacttttacttccagatgtttttatgtccattctttgcaaagaaacttgataataagtgtatccaaattggattctgatagatatgaaatggcaaatgtgaactatggtataataatgaatgtattggtcttgtgttgcaagatcagctttatttgttatctctttctgagaatgtgaatgttgtgtcctcgttgacaaaagaaaagaaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccgtatgagctatggatcctccgtgtgtggggaagtcctgcaaaggataaagtatttaacccaaaacagtaggctgccattttattggctattctgaaagatcaaagggtcatcgtttctactgtccaaacagttatacaaagtttgtagaaacgagacacgccgtcttcttggaagacgaaatgattagggggagctcggtaattcgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgtgacttgtggcaagagttttcacgcaaagagaaggcattgattacaatgagacttttctccagtctcttgtaaagattcctttatgattataatggcactagtggcacattatgatttggaattacatcagatggatgtaaaaacggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttaaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcgtagagattcaccgaaatagaacaaagtatgcattgggattttctcaaaaggcattgtcggtgatatgggaccgggagtatcatgaccagaggcttgaggcagacacaatcgcccacgtggcctggcaccttcggggacgtcgggcccgagggtgaggtgtccgccctcctcctgatttcccccgaggg

SEQ ID NO: 46279 - DNA, 710 bp, Oryza sativa
aattcctgcagcccacgggagataaattacgggaattcatacttctttaaggtatcttaacagaaaaacaccaataagttccattgcggtcttcatattactgcctagaagtttactagagttccttttgcagccaattagaataagtgacttgaagaaggtggatccaataagagcgtgtgaatatttcaacaattgcttcaaggatccatcagcttttactgttgtaatagttggaaacatagacccatctatctcagttccactgattctgcagtacttggtatgttctgtgccttctattattgttcagaggtgacgaataacagttgtaatgctggttgagtctactttgtagggtggaatacctaacgtagggaatgcagttctgccacttactcgtgatgatctaaaaggattgccattcaagtttccggagactattattaggtttgctactgccccttttgcactagtttgcctgcattcgttttatgtccttcatgtgtatgcaggactaagaaaccatacagttttcttttttagatataaagttgggtgtgtgccgtatgggttttacccttctttaatgcaatgatacgcagctctcccgcatgttcgataaaaaaagttgccttatgatctattatagtcttactataaagtgtgtcatttttccagagaagttgttcgcagccctatggttgaag

SEQ ID NO: 46280 - DNA, 1609 bp, Oryza sativa
tggtggatttagcagagacgcaaaggttagacattcatttatcatgccatttgcttcaatttagtctttacccatggctcttcctcacctcaccattttgagatccgtctttcctgcagattttggctggcatggctggcgcaatagtgttagcggtcagtttgtggagatactcacgtagcacattgagatcatagcacgtctatcacgctctcgactgttttagtaagatccaaaaatggatctgtcaagacaatcatctgcttgactccaggtacatgagctgacgacaagattttggtttcctcctgggatgctgcttcctatctgagagtggatgtggtgattgtccgtcacagaagaaagtatacagaaattggtagctaacagattcattgccgcatgcgtgcgctaagcctgtaacacaacaccatacgattcttttgtcgcagcatacgtgccccgtaacagccactgatgtatattgacacctcccatttcatttgatcctctagactgcaagtaggaaacggcaggttgcatgctattagctgaagtagtagcggttttgtttcttggtgagctttggatgtgtgtttgtgggaaaacccagaatgataaaagaatataggagtaaggatgcagacatttgtatgcactgtatttgttaccttcacccctattctttccgtgttctgttccatgtgctctttgagtccaaagttagatttctgctttattttttttctttctgttgttgatacgatggatgataatggacttatcctgatgaatagtactccatgatttggatcgaaaaggggagacgtggcgatcgaagcaggcgcagggcctttttaccccaccgtcccacgagcagcaccgaccaaacgtgtgatttggcacccttgcgagtttttttttctttttttttggatactcctagtatatatgggcgagagatttctcaagggaagaggagaagatgtgacgagacattgaagaatccctctagaacactcgtcacgatgccgaaaaaggcgttacacggatagactagaccaagagaaacaggagagagatgcgataaaaaccagaggcaaagcaaaggaaacaacaggccgctgctatatatccgcctcctgctaatccgcgactagggagtgaagagcgaatcaaacaccaccaccatcgccagcgtcattcagatttcagagggagggagggagggagagagaaaggaaggggaagtgggggagaaggaggggagaggatggcgtgcctgcacgaccacagctgcgaggatcacaactgcgccgccgactggtcgctcttcaaccacatcgacgtccccaaggtccctctctctctctgcccctcgctcgcctggttgatcagatggattggcccccgtatcactcacttcgtttgatgttcctctttgaaattgctgttgatgttgattccctattagttcatctatatatccgcgtttaatcgtgcggatgaaaaacaaaagacgaaatctagagatggcatgttagggcaatgggtttgattttttttgtgtgtttttttgatggtgtttgcccttatactgctgcatcat

SEQ ID NO: 46281 - DNA, 1568 bp, Oryza sativa
atatatctgtgttttccccactgtttttcttactccaatcaattggtgctttgtgtacaagctcgaaaggaacacacaaccacatcctgaactattttcgtacaatcatcttctgaatgcaggactgcagtagtgtttagaccaaaactgtttgatgtttcattagtaagaacatgtagcatatggacttttagttttcatcctttgtttgtgttattgttctcagctctcactacaaggtatagcttgtgcatgttgaattgattgatatacccagcagccattaagttaaaaagatgtctgtgaaggaaatagacatccatcttgttggttagtgttattgtactcagctctcactccaggcctgttggttagtgttattgtactcagctctcactccaggctagatcttgtgcatgttgaattgatagatattcccagcagtcatttatcagtctgtttgcgcttcctttggattatttttgcacatccttctatcaattgtttgtgcgaaagcttcaatgctctttaaacatgcttgcgccaactgcaagccagcttttgcacaccatgaattgtatatatgctgtgaaagggtagtcctcaataggtaaactggatgctatagacccatccaaaacattttcccccttccattaggatattatcctggaaaaaacaagtagtgctcggtccgaattagaaaaagcagagataacgatcattcaatatgcttgtcagtgcttcttgtgctctacttttgcagaaagttcatgtccagatacatttagttttgttgatacatctatttttgctctccatagcttgctgtgtagacttgtgtatgaggtaagacttgggtttttaccccttctattctgtttataatgcctatccagaatttataaatctgtgtaatcctttgtaccctttggttgtaggtttacatcagacgtcaagatcaagagcatctctgttgttggtggtgcagatggaacaagcccttctagaatgagagcgttagtctcagagctctatcttttctgttacttgactcatctatttgtccctctaacagaatgtaatggtacaaaatttattaagaataccttgacatatgttacaggtttatcaaccgagaaggcattgacttcaatgatgctcaaaatatgcaacctgtgcaggtgtggtttttaattttcttctcgtcttatccatgccataataagaagatatcagctgtaatttgaggtggtatttgtttgattaggaatgggagctggcagagaatttgcagggagttcttgagtaccaaacaaggtttttccatttcccgtttgttctggtctagtatgctggtcttgctaacattcatgaatcgttcagtcaaattgtaattttcaagctaaaaaagtgtgtttctgaatattgttccattaggcgggcaaaatttagtgggtatacgcaatactctggtgctaggcactctgaaattcattatatgctttcattgatggtaatgtgaaccgatactagtagagttattttgcactgacggtagtgaaatt

SEQ ID NO: 46282 - DNA, 1684 bp, Oryza sativa
attcctgcagcccgataatcggttgggacggccggagcaccatccccggggccttgatagcatcaaaggccgcgggggaaagaacgttgagagccgctcctccatctatgaggacacgccccaacttcacattgcagatggtgggggaaaccaccatcgcaatctgccctcctgggcaacgcacggtgggtggtcggtctggtcaaaggtgagggccacctccgaccaccgcgcccgacgcgtcacctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgttgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacactctggacgaagaggcgccctccgttgcgcggggagtacgccggctattacgccgacgctcgatgtcgaggcgggcatccggctctccatgctgatcctcccgagtcggaggtgccgacgagggagtggcagccgaatggcgtgcaacagccgccgctcgccgcgccctccgtcttgacgacgcggaaccggtagtggcggcgccggaggtcttggtggtggcggaccgtccaccagcacccaggcgctgctgtaccgtcatgaccaagttggccacgtcgtccagccatcgc

SEQ ID NO: 46283 - DNA, 2059 bp, Oryza sativa
gtgagtggaaagttcacgagaatggaagaagcacaagacacgggcgatgtatacaggttcgggccgctgagaagcgtaataccctactcctgtgttttggtggatctgtgtatgaagaagctacaaagagctggagagccagagagctcttactctagaaaccctcttctcccttttttcctctcctgggatctactctccagatccttttctctttcagtcctccccagagtcgtccccagagtcgtccccctttctaagtgggcaaggtcctccttttatatctcaaggggataccacatgcaccatctctctcttttgtgtggggacttatcctatcttttctccaacttgacttgccttctcttcataaatggacggagatttgtatggttaccgtccgaatgaccttctgatgggacggcccatacctacctccacttccgccggaagcaggtgcgacgtgggaacatggctgtctgctgacgacatgaccagcgtcagaccggtcacaaatcggtcattcttgtccaccacgtgtcagtttagcaatctgcatgttcgcccttcttcatacaatatcttgcttgtaatggttaggatgaagcctggcatatatctgaccgggtccaacgtgccacctccaggagctaacacgccggctccggctagggacgagtgcttggaggctctcatcctgacgggatggggcgaggcgtgcgtcagaccgccagtcgccacctaacccatgatctgatcggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacaggcggatttggggggagaagcggtgccggtagggaggagaaggggcgcggggatggcgaggagaaacgacggatttattattattattattattattattattattttgggggggagcggcgcgggaatgaggagtgacgggttttttttttttttcatagaggataagcacgaaggggtaagtaaaaaaatttaactctaatttcgttcggctaggagttctggcttagtagagtactgtgggtcacgtgcactgtagggtgcgtagctttcgggccaatttcgtcgcataaatagaccataggcacgctatgcgtgtcttgcactgctcgtgccctaaggctcctgctttctgtttcacttcacttttcttggtttgctttcttcgtctttttcctaatctgtgggactccgtgaggagaaactcggcaggactgctttcaaggggaaaaaaaagcaacgatacaatccatcctattttttgaacctggtgaaacagtgagtgcaagcgtgtggcgcgacatcattttccattatactccctccgtccaaaaaaaaaaaaaacaaaccctgggtttccgtgtccaactttgactgtccgtcttatatgaaatttttttataattcgtatttttattgttgttagatgataaaacatgattaatactttgtgcgtgacttgtctttttaattttttttcataattttttcaaataagacggacggtcaaacgttgggcacggaaaccagggtttgtctttttttgacgaaggaagtactgtttagggctcctttaatttggaacaaaagattttgataatacaggaataaaaggaacataagattaaaatgttccgtagtactaaatcctgcatgaattgcaaacacctgaatttgataggcgatactatgtttgaatagctcacagaaaaataacacgcgaattcggaagaatcagggctgcaggaat

SEQ ID NO: 46284 - DNA, 939 bp, Oryza sativa
cccataaagaaggggttggttgattcttgccagatttagagcctagagcgggggagaagtgggctcacactttgtagctcattcatacacaaatccacaaaaacacaggagtagggtattacgcttcgcagcggcccgaacctgtatacatcgccatgtctcatgtgtcttgccggcgagtaatctttccacatacagagagagcttgagatctcaccctaagcccccggccgaaccggcaaaggggggcctgcgcggtctcccggtgaggagccacgagctccgtcaggcatatatatagaaaaggtgttgaagaaattcaatatgtacatatgcagtgctacacctgctcctatagtcaaaggcgaaaagtatggggcatcacaatgtcctagaaatcagtatgagctcaatgaaataaaaataaagccatatgcgtcaactgtaggaagcctacagtacgctcaagtgtgcacacgacctgacttggcatttgttaccgggttatttggcagattgcaaagtaatccaggcctagaacactggaattagtaaagattatttgcaaagaacaaaagccttatgctgtcttacagaaaatcagaatcgctccacatagtggggtattcgaattctgactttgcaaaagataatacaaagttaacatcgggatacatgtttaccctggcagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtacta

SEQ ID NO: 46285 - DNA, 3487 bp, Oryza sativa
  unsure (1)..(3487): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctgccgagctcgagctcgagctcgcgggcctcgcgccgccgccggcgagacgaaacccggccggggtgagtcgtcgtcggcgttgaggtagtgcgtgtagtttggatgaggaaacggaacggcgtggagcgaggctgcgaaaatggcggagttatcacttatcgctgggtgggcctggcggtgcgccattttctgatgcacgagcatgctgtaggatataggaaaaagtccaactgtcctccctcaacaatagcgtcaattataacctcttaaccgcaaaacgagcaaagaggtttcctcaaccaagatagtttttgacggtggttttgtcctctgtcatgcttactagcatcctaaacagaaaaagaaataaaagaagaaaatgggtctcccaaatcgtggcatttaactatttgccacttttaagatgtgatgatatccatcatcgtcttcttattctttctcctctcggttcggctggacgcaaccactacgatgattttgtgcttgggtcagagaagcatagaggagacaggccgcatgccctcctaccagcatagaggagacaggttgcatgccctcttactaaggccagcgccaaggaagaccgctagagccgagcatcaaaggcagtgtcaaggggaaggacagcgccggaggggatgaggaggatatcctgaagccatccccaactcacaaatcggcggttgcaatgctttcttcctatggatgagaagaggtcgaggtctaggttggagccaatggatgcagggttggtcgtgtctgggcgtggccgaggcggagctaggatctagaatcattgccacatcacccactattgttggtacacctgcaacgtcagtgtttaggggttccacatggtggcggtcatgggcggtgacagactgaccattgaccattcaccaccaccattgaagccttttaaaaggagtatagaagtatgtacatagttgtcttgtttctattatcaataaggtagttagtctagttgggtagtcggtctcatgcaagagtggattggttcatgggaggtttcatgtcgttgtgggtcagttttgtttgggactgttaacacatatgcatgtatgtttttgtgagttttcatttacaagtcttaaccctattgttggtaaagtaggaatgagggctcccactccattggctgctcggggcattgtggagcccaaaatagttaaagcaagagccaacgaagggatccaagcgatgcctcgagccaaagaaggtgacccgacatcaacgtcagctcggggctttagctagtgttagcttggagtcacaacgactactgcaattgggctaggaacccaaggtctaccttgggcactgatgcctccccgagtgaatctacttcattaagtagatttgaccagtccctgtgtgcagcattgccttatcattccgcatcaaatacgtgtgatatatttcatgtggatagatcatgagcgacgtggcagagcatgcctccctcgcttgcccacgtcgcctcaagggaaaagattggcgacatggcgtgtgttccgtagtccgtactcacctaacacaccccctatcagcatcggaggctgagaggtgggcccattgatagtcgggatgaagacttttgctaccctgctccacatgtcagccgataggtgaacccatcacatccacccattatttttggaaggacgatgacaggattgagcataccaacccttgtgagcggggtcctacacatgcacacttgcatgcacactgtggtaaccccttggcatatgaaaggaggaccaatgccactaagaaaagggttcggttcggttcaatttggttgggttcaactggatatgtttagcccaattagcccaagttagaccaacaatcacaaaggcaatgaacaagggttcatcctctcccacttagaacaatatccacccaacacatacattgtaagtttcatcatccatagcaagattacatgagtatggtattacacttccgacagcctgaacctatgtaaaccacctacctacatttctttcgtgcgatctaaacacgagctcggaacccgcaccttggccgaacactcaaaggagagtatgattctctctagaggaacatcccactccgacgcctaagcagtccatctttgggttcagattctaagaagttgcagttgtaaaatccagaaaatgaactaaaagctagaagctagaaaaccctacttttccatattctcggaaactaactaccaactactatatatatcagtttctcataattttaagctcccaaatagatcctacgtgtctcatatggggtagcctgcaatgctaatgccctaaggccctttatagtgcaacaccgtggatcagtgctatggggcgccacgtcggaatcaagcttgcgtggcgctaggttccgcgcccaagcaaggatgcttgcttccacggagagaagcacgattcctccttgccgcgggcccacgcgaggcgaggaaacgagcgctgtagagcgcgttgccccgtgcgccccgcccgttcgtgccctcgcgccgcccgtgtggaagggttttccccaaaatcacccaccaaaaaatcacggcaacaaatcaaggaacaacccaccaaaatcgcggcaacaaatcaaggaacacgcccaccaaaatcgcggcaacaaatcaaggaacacaaatcgcggcaacaaaatggccgctcgccgctcggccccgaggggatttggaaaaatcgccaacacaaatcgcggcaacacaaatcaaggtcgacgccaagctccgccgctcgtccccgaggccgccgccgcttgtccctgaggccgccgccgtcgccgccggtcggccccgaggccgcctccgccgccgccgccgccgccaccgccgccgccgccgccgctcggccccgaggctgccaccgccgctcgtccctgaggctgccgccagctccgccggtcggccccgaggccatcgcagacggagggccccgaggccgatcggtccctgaggccactcggcgccggcggagggaggaggggcgtcggcgccgagtggagttgggggaagtgagggcgtgattagtgatgtgaggaggggagggaggatgctgctatgatgacgaggggattggtaaagtagtatatgtgggtcccactatcgatgcttgcactgtggagaaaatgtctttgcagctcttcatcctacgtgttaccctgtggtacctcatagtggatgcttgcactgtgagaggcttaaaagcctccctgccggacct

SEQ ID NO: 46286 - DNA, 2232 bp, Oryza sativa
cccccgccccggggaggaggctgcgccggggcgtcgggttccggtcgctgaagatggtcagcgtctccatggacgagccgctccccgcggagcccgtcggcgtcgcgtacggccgcctcgccaacggcctcgcctactacgtccgctccaaccccaagccccgcatgcgcgccgccctctccctcgccgtcaaggtcgggtcagtactccctcgctcgctgcccccaacgatttcgcgagtttgctttctgatttcgcgtcgtgtgcgggcttgacgcacgcgcgcgcgcgcgcgcaggtcggtggtggaggaggaggacgagcgcggggtggcgcacatcgtcgagcacctcgccttcagcgccacgtcgcgctacaccaaccacgacatcgtcaagttcctcgagagcatcggggccgagttcggcgcctgccagaacgcgctcacctcctccgacgagaccatctacgagctgcttgtccccgtcgacaaacccggcctgctctcccaggccatatcagtcctggccgagttcagctctgaggtgagaatgtgcttcccgcttgttcacggcaatggctgtgccgtttgttcatggtttgacactggtgcgactgatgcttggtaatggtggtgaaaggttcgtgtgtcggcggaggatttggagaaagagaggggtgctgtattggaggagtataggggtggacgtaatgctactgggaggatgcaggattcccattgggcattgttgttcgaaggctccaaggtattggtcaaagtcctcgtataattgttacatcaatctcctatatgcatgaaaaaaagttatgttatgtaacttatgttcaagtctagctcaagtaatttactcctcttatgctcggttttattggtggggtaataagttgtggcttatatcttcctatcagtgttgttgtatttggaactgcaagtatctaaatggtattgcttgttaatgtcctttgtctcagtatgcagaacgcctgcctataggtactgagaaggtgatacggactgttcctcatgagactgttaggcacttttaccataagtggtaccatctaagcaacatggctgtctttgctgtaggggacttcccagatacacaggtttgtatttgctctaacttagcatgctcaaatcacaatctatctgtatgttgactttcttttgtgcatcattatttactgcaggctgttgttgaaatgataaaggagcactttggccagaaagccccaccttcatgtcctccaccagttataccagattttccagtaccatcgcatgttgaacctcggttttcatgctttgtggaatctgaagctgcaggggttggtactttatagtgcttcaaatgtgttgaatatattttgctagtgactgaatgttttcattaatacacttcttttttctgtttctcctataccccaaaacagtcagctgttgttgttagctgcaagatgcctgctgatagaattaaaacggtgacggattatcgggattctctggcagagtcaatgtttcattgtgctttgaaccaaaggctgttcaaaatatctcgcaggaatgatcctccatacttctcttgctcttcagctgcagatgctcttgtacgaccagtgaaggcatatattatgacatccagttgtcgcgaaaggggaacagtcgaggctcttgagtctatgctgcttgaggtactttaaaactttggtctctgaaggaaaaatgagaaaacgattttctagtcaatactcgtactacatttatgcaaaggtcaggttcctcaaggttacatttatttaaggagaaacatgactttgttatagcataatgacagcagatctagagtgccaccagttgattcaatgtagtacaatgaaatgtgaaattccatcacaacaatatgcaagtgcatcactcttacttgattcacatatatcttggtgtactcaatgattagcgcatcttgcgaaagcatacattttgttattgttgggaaacaaccattttctcaatcttgagatttattgggatttcaattccaagagattcagacaagttttccttttcctgtgaaagaaaaggttgctagggttcggctccatggattttctgaacgtgagatatccattgcacgtgctttaatgatgtcagatatcgagtctgcatatttggaacgtgatcagatgcagtcaacaacccttcgggat

SEQ ID NO: 46287 - DNA, 706 bp, Oryza sativa
ccaccccctactgtcttttaatagtagtatagatatagatatttcaagagtcaatgattttcatgtcttgacacatacaagggatggcaataggcatctacaccaaactagcttgtgcatttctgacgcactatctgtctagctctccttcgtatctatgtttctttggacattgaaccactgctgcactttttagctaacagttgacagtttatcaattttctttgaatctggagctattctttttctgatcggtgttgctatatatgaaagcaaaattgagggatgaagggaaaaaccgaagtcagctacaaccatgaagaaatacatcagtagtttagtgccaatttaccatttgagcgtatgaacactacaacagtactgcatagatgcttacattggaattacagtactgtgttacctttcatgacaataaccagtcaaccacctttgtcctgtgtcatttaaatcattaactatatgagatagcagtttttgtgttgcagctgtaatgtcaaatcgtctggtgattcattcatgctcttttcaatgctgaactatttgcaggttgtttttactgggtttgcctatggtggtctgtctgaattgtctgaagatgaatatacctcatgttcaatgggttcaacaatagcaggagagattggcatttttggctacagaccatctgtcctgggctgcaggaatt

SEQ ID NO: 46288 - DNA, 1225 bp, Oryza sativa
cgttcagcttagcagcatgaaaagaatatctcacattgaaagggacgtgtgaattagcagatactctggtccagtatttcatctgacaaaaaaaaaatcagctattattttacatcgctgcctgccaattcttgccttagacgcatctacgaaaatgatgtcttaatgtatgaattggccaaaactgagttttttcaagcaaaagaacaaattgacatccaagtttacctcgacaatgatacccaatgatccacacccatgaagtaattttagtttaaaactctccataatacattttacagtactattagaagttataaggtcacacacaataaaaggatcatttcacatggcaatcccctacaatagcagtgcttttaactagaaggtgttccaaaatttaatttgcatagctaatctaattgtaactagaatcctctggttctaaataggttcagtatcacatgcattgctggactccagatgaagcttagggttctttcagcaaagcaaggagaaaacagcatgttatgaacataattttctaaagaaaaggatatcagcttattgatcaattgactcattcctgatcataaaatgaaaataggaaaaaatagcagtaactggacttattctgctccaaactcaagatttctcaccgtacaccctttccataccttagtctgcctgtatggattgttgaaccttcaaagcaacaccttgcattctaagtaaaactgctagctagacaatggccacactcattatctaattgttgggtgtagcatcccatgacatgctattatagatgagttagtttttaattaaggcaatgccaaaaggacgtgtaataatgtaaatatgtttactgttaatcatatatgttggttttacaacagaatgtgattctccctgaccctttatggattttatgtggcatgcattgcatattgttaaaaaatgcttcaacacttgaagtgtatacttttcatagcaggttatacaaacatttgaaaacatttttattaaatagtagaaggtttgcatgggccatataccaaaacagtatttgtgaacccatggtccttgttctgaaccaagacttggtttcatgatgacaccaaaccgaagaaaacaaactgcgaccatatttgtccaaactgaagttctacctctgactctgagttccattgaatatttgccaatccatcttattcagcgcctt

SEQ ID NO: 46289 - DNA, 1953 bp, Oryza sativa
attcctgcagcccgccttctataaccttctctccgccgccgccgacgaccagccaccgaatcgaagtgatggccgccgggggatgtaaggccctcgccatcctcgccgtcctggcggtcgccgccatctccgccgtctccgcggccgacgcgccggcgcccagccccacctccccgccggcgcggccgcgacgcccctcgccgcggcgctcgtcgcctccgccgccgccttcctcttcgccgccatccgccactgagccccgtcccgtctctccgtcgatgggagatccggctagtgccgccttcgcctagatctactatttttctatttatcaccattattattattgttattattactgccatcgctagctagcgaaatttgttggttattattattattattattattattattcgtgtctcattttgctccagatctgccgctactagtactagctagtgcttgatctgtgttcattttgtgtgggtgtgtgcttgtagatactctcatctgagtgttcttccgctactgattactagtagtatattattactgcttcaatttcattctcagttctatcttttctgcaattagtttttttcttcttttttttttcgttttattaagtactccgtacgaatctgtgttgcgatttccgaaatttactgatgcgctctgagtgagacgagatgctcatcgtcgagatgcagttggcgaagccgccatttgtgatgagcgaatcgtcagatctacgctgtttttttagcattgtgcttattttattttatcggcaagtgcattctggaagatagtgcgcgtcttcttttctgtggaatgttgtttggggggccaattctttatttgccactgcaaatctttcaggattattgttagatttggacagtgatacccctggaacatgcgtgttggcgtgggggattaggagattttagttaggttaatatataatttaacactagaactagtagtttatcgtttccatttctgcttgttcaaatagaacatctggtgtgatactgaccaatgaccagctatatatataatgccggcacatcgatttgatcagggatttgattagtgcaaaaattctgaaggcaaagtcgaaactccaattgatgatttagacattagaccttgtgctgcagaatgaatggaatccattaatgttttgggtagagaatttgctgacttctgttgcttcactacaagctctgcctttaaaatatgggctctgctttcacaatattggcgcatgatacgttcctaaatgtaagaggagtgatctcttatttttttttaatggagggagtaatataaaaaataaaaataaaatggagtggtaagagtaaacaagaaacaaaaactagcgagtaaacaaagaacaatgatactcaattgatatgattgttgctcatgaggtgccatggattttcttctcatttggaccgactgaccggtagtttggacggacttgttgagtttgactgggccggacctgccctgcatctgcatgccccattgccccgctgtctcctcttttcatctctcgcacagtaactatgtcgccttgcatcgttgaaaagaaaacaacgttgtccttgtgctccaaggagtgcattctatggatactgagatttggagtgtgtttgcaatcccatgttaccaacccctctccctcgttttccgcgcgcacgctttttaaactgctaaacagtactttttttgcaaaaaagtttctatacgaaagttgctttaaaaaatcaaattaatctatttttttaaaaaaatcagcaaatacttaattaatcacgcgctaatggaccactctgttttccgtgatcactgttcttccggatgggaaccgcttctaacgaacacagcatgaagtggaaacggacagagcaagaaaggagaggaagcaaacacact

SEQ ID NO: 46290 - DNA, 18908 bp, Oryza sativa
  unsure (1)..(18908): unsure at all n locations
aattcctgcagccccaaaatcgccctcccaccccaccaattcttgttcttgcctcccgcgtctatatttggtcattcttgcgttcgcatcctcgctcccatgttcgaatcgtcgctcctgtccagctccgtgtgtgaggcgcgctcccttattgatgcgccaacacggattgggggagaaccggcgcggtggatggacgagaagaagtggtgtggattggggaagaagcggtgcggcggctttagagggagaaacggcttggcggaggagaagcggttggggatggggaggagaagcggcggtgacggagctcgtggctcctcaccgggagaccgtgcaggcccccctttgccagttcggccgggggcttagggtgagatctcaagctctctctgtatgtggaaagatcgcgtgccaggaagaaacgcgagacacggacgatgtatacaggttcgggccgctgggaagcgtaataccctactcctgtgtttttggtggatctgtgtaagaacaagttacaaaatatcaaccagccctctcctctcccgggaaaatcccgttctctctctttgtgggcatggtcctccttttatatcttaaggggataccacatgtaccctttcctttccaaactggacttttcttctctttatgtaaatggacggagatttgcacggttgccctccgaacgtccttctgaagggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgcagattcgtttcgtctggagatatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgccgcttcatgccggaatccgccaccggccgggagatagtgatgctgggcgaggcgcgcccagcaccagattacccggggcggtccatcttcttcctccccctcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccggtgttgaaccgctacatcccctgcgccctccgcaagaagtgggacgattggaagagcgactggttctacaccccccttgccaacgaagcgcgcctccgactcccaagccagcccccggcgccggtctccagctggcgggcgccagtagatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccgtggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgccgcccgggggaagaggaaacagggaggaacacctcccccatctcctccccgagggggcggggcggtgcgtgccagcagcaggcgcccggagggggccgcgccgacgtcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccatcttgtttgtcttccggttttttcttctgcttcagcgatgtcccgtcgcgttcctcccgccatcccaagtccggccaatccgaggccaaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagctgctcgggaggaggccgcccgggctcgtcaggctgaagaagccactcgggaggaaaccgcccgggctcgccaggctgaggcgatggcgtcttccgaggcggttcacgacaagaccgccggcgcgtcgctcgggcccactccctcgggtgacgctcaggcgacaacctccggggcggctcgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatgtggaggtggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaagctcgacgccgcccagggggtccttgacgccgccgctgcccgagagcagcgagcaacggaggctgaagcggcatcccgacggcgggaagaggcccttgaagcccgtgccatggcgctggaagatcatgccggcgccgtggagatcagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcatccgcgccgagagagccgcgctggagcagcgggctgctaacctcgaggcgcgagaaaaggagctggacgcgagggagcgcagcggcggggcggctacgggcaaaagcgacttagtcgcccgcctcgcagctgccgaacacaccgtcgcggacatgcagcgcgccctggactcatccaccggggaagcggaggccctccgcttgtcggtgagatagggcccggcatgctttgggatgcagtctcccggctggatcgcgccggtcgggaagcgggcttcttgaaaggccagacaatttcgcgctctaccaatctggaaggcctcgccccgcccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcattggaatgagcccccaggcccccgccaatctccaattttttctttttctttcttctttttgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttagaaaattgaaactgcttttattgaaatgctgaaataagaaaagtaaggctgtgcatgtgtggtagcccccggctaaccctgcacacccgaggggggtgcggggttagcccgagcccgaccccccccctcaggggtagaagcgacgaaggtgttcgatgttccacgggtttggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaactgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttttggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagagcctgggccggctgattgatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcagctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattatgcaagatttgaccgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttccctcggtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcggagggccgactccggtcgtcgggggccttaggccaccgttcgactcgggggcctctcctccctgcctgctcccgggcctagtcggcacagagtgggggtgcgcagaatgaggattgtcctcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgctccccgcagtggagtcgacgatctgatctatgcgaggcaaggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggccttccgccgcactttctgccggaccggccttgcgcccggccgcacggcgagacggtgctcaatcaccttcctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcgatgggggcggaggtgccaaggctctcgtcaccaccctcgggcttggtcgcagcagcgaggtggtccgcgcgctgctccatgcaagcgagcgtgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaatggccatgtgtgccccggcgtcacaccgataatcggttgggacggccggagcaccatccccggggccttgatagcatcaaaggccgcgggggaaagaatgttgagagccgctcctccatctatgaggacacgtcccaactcgacgttgcagatggtgggggaaaccaccatcgcaacctgccctccccgggcaatgcacggtgggtggtcggtctggtcgaaagtgagagcgacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcaatgtcaacagcgggggccttctgcttagcctcacttcgccgtttgccggaaggaaccgccggggacttgccctcacggcgttcctgcctcctgtcctcctcccacttcctcgttcgctcagccaaatttttgactgcgcgacagtccacgagatcgtggagggaggtgttgtggacggagcaccacctgccggcggggcgctccttgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacggggggtacgccggctactacgccggcgctcgatgttgaggcgggcatccggctccccatgctgatcctcccgagtcgaaggtgtcgacgagggagtagcaaccgaatgacgtgcagccgccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacacttggagagaggtcgtgcgcttttccttgctcggccattaggctgaacaagaaaaagttggcgcacacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagattactcgccggcaagacacatgagacatggcgatgtatacaggttcgggccgctgcgaagcgtaataccctactcctgtgtttttgtggatttgtgtatgaatgagctacaaagtgtgagcccacttctcccccgctctaggctctaaatctggcaagaatcaaccaaccccttctttatgggcaaggtcctccttttatacttcaaggggataccacatgcccccttctctttctaaactggacttttcttctctttatggacggagattggtgtggttgctgtccgaatgacactccgatgggacagcccacacctacctccactcccggcggagacaggcgcaacgtgggatcgtggctgcccgttgctgacgtgatcagtgccagaccggtcattcttgtccaccacgtgtcagtttaacaacatgcatgtttgcccttctttgtgtaacaccttgcctgtaatggttaggatgaagcctggtatatatcgatcggggttaacgtgccatctctgggatgtaacacgctagctccagctggggacgagtgcttagaagctcacaccttgacgtgatggggcaaggcgtgcgtcagaccgcctgtcgccacctaacttgcgatttgaccggtctgtgactggtcacagaccggataatcgagtgcactgcactgcactccgtgcggcgtgacacgcttagccgatgcgcaataaatgcggttaggtgagcccggctgtgctcacccaacctacgtacatagtgcaaacccctcagggggtcggggcacctcggccctcggggtcggggcaagcgcaccccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaaggggagcggtcaggtgtgacgccacccctaaagcctggtgacaggtgggaccggtctccatagttgggcaaaatacccaacggtctcaatccatgcatattggtattggtaactttggttgtccataatgggtggtctattcaagaccgccacatcacttgagcagcgcgcgaatctgggtgagcagatttgtctcgcttggagatacggtaacgccgcttcggttggcgagcgtaattaacgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgaggaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggtggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccagtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaagggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtagtccaaagggtgctgaatcttagctccgcggaggcgtctcgccttcctcaggagatcctccccctctgcagcgatcccgaccgcgtctccattctaaccattatgatgggggtcggggcctcagaggagagagcccctaagggccacgacggcgcgggcgagcgccgccgaggggaacaacctgccccaggagggggtcgtgcttctgggccccgcgtcgggggctcggggagcagccgccctgccgacgcccgggggaagaggaagctgggaggaacacctcccccatctcctccccgagggggcggggcggcgcgtgccagcagtcggcgcccggagggggccgcgccgacatcgcagcccgagggggtgcgcaagaagaagcggctccgcaagacgggggagacggaaccatgccggggaaacctgatttcccctccaaggtggtcattcaaccgaccccctcgcaggttcgtctcactctcattgcaaccatctttctccaaaaagaagttttttcttgctcactttgttcgtcttctggcttttccttctgcttcagcgatgtcccgtcgcattcctcccgccaccccaagtccggccagtccgaggccgaagatccagtggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccacccgggctcgccaggctgaggcgacagctgctgctggcgcgtcgcttgggcctactccctcgggcggccctcaggcgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgttgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgccgctgcccgagcgcggcgggtaacagagactgaagcggcgtctcggcggcgcgaggaggcccttgagtcccgtgccatggcgctggaagaacacgccggcaccgtggagaggggcttgacggaccgcgaggccgccgctgctctccgggaggcgacgctggcggcgcacgaggccgcctgcgccgaggaggagtgcgcgctccgcctccgcgaggacgcactcgcggagcgggagcgagctctcgaggaggctgaggccacggccaaacggctggcggacagcctgtcccttcgcgaggcggcgcaggaggagcaggcgcgccgcaatcttgaatgcgtccgcgccgagagagccgcactggagcagcgggctgctgacctcgaggcgcgggaaaaggagctggacgcgagggcgcctatcggcggggcggctgcgggcgaaagcgacttagccgctcgcctcgcggtgccgaacacaccgtcgctgacatcagcgcgcgctgattcttccatcggggaggccgaggccctccgcttggcgggcgagatggggccaacagttnggatcggtctcccgcatggatcgcgccggtcggcaagcgggcctctggaaaggccagacgaggacgcgccctagcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgcgtccgggatgctgccgaccatatcgtcgacggcttcgaggggtcggcccctctgctcgcgttcgcccccagctccgacgaggagggcgacgccagcgatgaggatgacggcggcgacgaggccggcgacccgggcgcattggaatgagcccccaggcccccgccaatcttcttttctttttctttcttctaaggccttcatgcctcttttttgtataaattaacttaatctgcaatcagaaatgacgaaaaaaaaatttttgtgttagttttattttgctatacatacacgatgaggatgatctgtgccatggtcctttcgcgccttagcttgaaataagggctcgtgcccaagtcccggtcctcgaatggctcgggtcggggctagtgcctggggagatccgcatgtcgagactggccaggccgggaacgtggtgaccgaggggtatgggtgacccgattgtgggtttttgccggttcccccccggagttcaccacgccccggggcacggctcggttctgggccccgtttggcgattttagctgaccgaaccgagcccccgagggcaaggttgagcacgagtgaccttatttcaagttaagattcttcagaaggaaaaacggcacagacacaacctctaggaaattgaaacttcttttattgaaatgctgaaataagaaaagtaaagctgtgcatgtgtggtagcccccggccaaccctgcacacccgaggggggtgcggggttggcccgagccaaaacctgacacccgcccccccccttcaggggtagaagcgacgaaggtgttcgatgttccacgggttcggcagttcagtgccgtcgcccgtggccagccgtacggagcccggccgggggacgccgatcactcgatacggaccctcccacattggtgagagcttgcacagtccagcacgcgtttggacgcggcgtaggacgaggtcgtcgacgcagagtgatcgggcccggacgtggcgctgatggtagcgccgcaggctctgctggtagccgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatcgcatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatatcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaaggggctgcaggaatt

SEQ ID NO: 46291 - DNA, 712 bp, Oryza sativa
aattcctgcagccctacagtgaaaaatagatgataataaagttaaacggaaggaaaaccatggaaagggttacttgtccattagtctttcctaagagggagttggttcagctgagagatgttgacattagttacagttgagcctatgttaattaagtatattctttccttgtgcctccaaattgtggtggaccaatcctgccttttcttattcacaacaagttgccaaaagacgtcaagatggacgaaaatttgggcattctgtccttttcaatgatgtactagctgctagtgaaatctttggtgccaaaatcttatcgtcacactgtaacatttctttagaaaggtaaccgaagaaattatagctagcatcaataattctcctgaagaatgaacatgcacggttaccttcgggaccccagcatagacatcgccaccctggggatggttgatgatgacaccaggcctcggattctccgggttgtgcgcgatgtcatcgtacatgaagacgatgatgttctcgtccttgagcccgcccctcttcatgatctggtaggcatggcagacatccgcctgcaagtttcaaaaccccaagaaacacaggacatatgttactcaagtatcaaccatgcccaatttcaagaaccatcatgctattgccagcagtaaattaccagtaattacagcaatagtaaactcaaatcatgcagaaa

SEQ ID NO: 46292 - DNA, 2274 bp, Oryza sativa
tagtacgagttttatttttaaaatggtgtatgtactcaacgttacctgttggttgatccaattgactagcatcttttgtagcatgtgtggagtagtttgtgggtgtgtggtatcccatggcagttgtgtctccccatggatggagaggcccttgtatatcctcaatggtatcaataactttcgttactgctgcccttatcgctatcttaactgccgctgtaatattagtcttgaaagctctcttgaataggttagatgtgtgaatagcagtttgcatggtgcttatgtcgacgaaatctgatatggtaggcaaaatctcatcgatgcggtcgaatccatcctgaatgtaagatttcaactcctcgtatgcctgttttatgttatcatatataccacatgttagtttaaaatcccttgatcatgtgaaaattacaacttaatgaagaaacaatcaagtaacatagcatacggatggttgacatacctgtgacccgacagttccacgtacgtctaatgaagagaagtgtgattccaggaattttattaaatttttaccgccatcaatggctctagatgggatcttcgaaccggagcataagtttaggggagatagctctggcacatgggggttgttttctcttggttccttcatcaactgaacagcatgtatatcggaaattagctaaattttgcagccagaaataggcatattacagccagggtatcgtacatacctggagtttcccataacgagggaaggggaatcctgggttatgtttactaactacatcttgttgaatcatcctagcaatttgatcatcctcaaactgagaaatgtgacatgttttaacacatgtgatcccaaccttccggaactggagatttctcaaatattttacctgcaaaaatgattcacaatgacaatatgtgtgttgattgtatgctgcattaacaagtcagttttaaatgctaaccattagaaagatgatacacccgttaatggatagttgagccttattcggaaagcaggtgggcattgattctgctgctttcttcacctcatctacaacgaattgggaccagttgtactgttttatattgtcaacatcagaaacagccataatatacctaggagatatgaagtttgcgcaggattgcggtgccaaaagcttcgttgtgacaaagcacaaaagccgccatgaaaaccctcttttcatctattgtcatgggataaccatactgcttctttaggattctctctaagagtgatattttcaggtgtgaaaagtttggtatctcaaatatttcgcacaatatttgtttcttcccatccaattcatcttgagagcaagggataataggttgacctgagcatggcaagccaaaaactgcattcacatcattaggaccgaatggcaactcctggttgacatctttaaacaatagcgcatgatttcggatcaactttgctcagtagccatgcaccaaactgcctgtttaccttagtaagcttgatatccaaaagtccatcaaacccaacttcaccaatcaactccttcttcctatcatcgaatctttaatgatattcactacgcatttgggctgacacctgcagttgataccaaaggtagtgttgtctttcttctgtctatttaaaactctgctttgccgatacctggataccacccgtgcagcagtcttatttaggctgccccttgtgccagaaaccttcaaagcctgcagataattagtttttcatttcataaatagacaatactacatggaccagtgtatttaaaaattcaacatatacttctatttttttaaaaaaaacagcatacactcatatatgtatggaaagatgaagtacaaaatactgcgtagcaaattctacctatgtgtaccctcttaattaaaaaaaatcatgtgcactgaaagaaaagtcagtatatgcaaagtttagagaatattactgtatgtaaaaaatcagcatatacctctctatgtaaaagtgcagtatatacttcttcgtaacaaggtccagtatgtaaaccactatggaaaagcctctgtatatatgtggaaaaatgcagtatatgctatcttctagaaaagttcagtatgtaccacatacaaaattcagtacatactatatgctgtcgtataacaaagctcagtacaaagcctcccatagaaaaattcagtatatctgtgaaaaattcagtaaatactggtgcgtatcaaagttcagtctatgaatcactgtggaaagat

SEQ ID NO: 46293 - DNA, 3261 bp, Oryza sativa
aaacaattaatactcaattaatcatgagctaatggctcacctcgttttgcgtatcttcccaatctcctcgatcaacttctcctcaaactcaccttaagccgagcggagcgagctgagcttccaagtgttgagatcgcacatgccatgagccgcgtggagcacgccgttggatcggggctgcgcgcgcacacacacaggtttgcacccgggatccatatccaccaaaatttttccccgggtttgcagcgtaaaagcataatatcttccttttgcaggacttgccggtccgcgcgccgcggcgaggcaaagggcgaatcctctttttgtggtttcttgcagggcttgcagcgccagatcaatggtctctctcactctctacttcatcgatgatctctcgctctctctactttatcgatattggtcttcaccaatcagcggggtgaccgggcttcagctttgtcatgcgcgcatagacccacggttgatgcactgtcatgtaccgtgtgatgcatggtctctatagccatgcacgaagaagttacacatgttggctctccggccaagtgcgtccaactgtccaagatgtagatcgcactagctaacgtttttttcttttttgggttaagtacttcagtttaatccttgctcgggttaactacgtcagcctaatcatttgttatggacaattaagtacttcaattagtttaatcacatatactttacttataccgcggtgcaagtttcttgcttaattggttgctttcgtcctactcgttcacattcttaaatgaactcaatattatttctcttgaaggagataaattacaaataagcgtgggatcgaccgaacggtaagagtgacaggaataggttttagagtacatgatgcttttacgtctgttcacgccacaaatttccttcaaaaaaactagtgatttgatgtgagcgagtgacttatttacaactttagttactttccgtaggtgttatcttccactttagtttgacatcaatcgtttgctattatgtgtgcaaaattcgatcaacataatgattcagtttgagaaagataaggactacacacaacttataagtcattaggaaaaaaggttatgcatattctcaaccattgatgaaaatagtgtatataggatgatattgtaagtagtttttgtgttttttttatcagacagtgattttgtaattcacaatcgttcatcttacaacttctataatatttggatgtagattctttaaagaaatgacctatatgtattttattatatctgtaaaacatcacaaatgtaaaattcctataggaaggacgtatccaaatttaatttttacagggctatatatttcctctgtttcatattctaacacattataacattttttcttgttccaaccttttaagttggaataagtttataggaaaacataataatattttcaatacaaaacaaatagctattacaatatattcaatgttagatgtaataaaatcaatttggtgctgtgtatgtgtgtgtgtctatatatatatatatatatatatatatatatatatatatgtgtgtgtgtgtgtgtatgtatgtacatgtatgtatctgtgtgtgtgtgtggccgaaactacggtccggttcgatcctggtgcttccggattccggtgtgttcgttagtctttgttggagtatatgcatgtggggttttctcacagtttttaaagaagtcgtgcatatgcatgcatgcatggcgagtcgatcgtcagtacgtcaaccatggccgacgtcgtcactttatacgtttgttgagatcgatcgttcctggatcaaccatggtgcaaactagaacaaaaacatacagcagcagtagtacaccgatcgaccacgcgtggatgacgtacacatagtgccaaatttatatatacttttccgaatcagtatatagatgtgtgactgtgcgcgcgcgcgtttccatgcatttcagttaagtttggtggcacgtcaactgagcatgacggggtccatcggcgcccggccggacggacgcaactaccgctaacagctgaacggattcggtcatcgttggttgatacaaagatcacgagactctcctccgttacatgcatatgcatgcatctacagtttagtaatgctgtagtgcatacgcaccagatgcatgatttgcaccgacgacggacgatcgtacgttcacctgcactgcactgcgcacacacgttccaaaaaaaagcgagcaccacctgccgatcgaccttgcattgcccagtttggcttcagacgcacgtacgcgcgcgcaaacacgtacgacgctgggacgaacgatggcgcgcgcgcccgccgctcccgcgggcgctcgcgcgcgcagggtggtggtgtagtggtgtggactgtggagtagtactacggtacttcccccactactacgggccacgttgcgacacgtacacagtctcgtcgatttgggcgggctcgcgcgcgtacacggcgcacaccgttttgctgcatagacatggacaacacgaccgaaaacgacgccttctttttcacgacgtcgatcggcgcgtaattcgcgccgtcgaaaacgtgcattggctttgggggttaactgggcccttaactccccacacatgcatggtacgtgcgcggttggggaaaactagtacactagtacactacgtcgacgtttcttgccgtctgcgtgttatgctacgtgttagcggcgccgatcgagtgtaatctatactctctataaagttttaactcattaattaactctcaaacttaacatacaaacaaacgtgtcatctcatcacccactagcaataattacatatttaacatcatacaagcatgtaacatcatgtacaatctatttaattctacaaattaacatgtaagcatatccaatcatcacctcatgttatttccacagtagttttacaaatctctctatcatgtttatatatttaatatatacttatcaatatattaaagtgcaaatttcgtttgtatgtttcatgataaattctaataagccctatgatttgattgtttttattcatttaatttttctagctcaattgtaacggaaaataatgttgaaaattacttattaattttcataacaaagcgcgagaaatcacttataattagtttaggcgccggatacatgcatacggcgtgtactatgtgattagttcgttgttgcgagtactctagtttgctagcagctgtgtgt

SEQ ID NO: 46294 - DNA, 3623 bp, Oryza sativa
attcctgcagcccctttatccgtatgtcacttattaaacttgttatgtataattgagtatcatagtcatctttaatgttaacgactgaaagataattatatcatataaactatatagacactataactgctagatccattatgcgctcggtaacccccgccggctggcagcctccgatgctcatcgacctacacaaaatgaattcatcgtcttgatttagggattgaaagtaatattttcataataaacacttagtagaggtagattttattgacgtgcaattcttttgcacgttcgcgaaaaaaaaggtagatttgcgtaggatctataatttttcagatccaccactagctgccatgtgtaccagtggttggctcattaatttgaactatgcattgtggttttacacaataaggagctaagaatgtgatgaagatctaaataggtgctataaatcatgtattacataaaaatgaatgtcatttttatcgagtttttatctttttttaaacttatttttctaagtaaatttcataaaaatacaaatactttgaccaaactatcgtaaaactgcgtattcatggtgttgtaccacaaaactatatatttaatattaagtttatcacaaaactacagatttaaaatatatgatcgcaaaactatagattaagtagcaaatttattacaaaactataggtttactgtcaatttaatcacaaaactacaacgtttatagttcaatcataatggtagtgctaaggatttcacctctaaattatgtggttttgtaataacttcgatattaaacatgcagggtgatacttggtcttaaatctatagttttctgataaatttaatgctaaatttgtagttttgtgatacaatgtattaaatatatagttttgtgattgtttgcttaacatatatgtagttttgtgaaatttactctactttttttattcatgagttttggtctccactctccagttaatattatttcccatgcattgctatcagtgtatagtacatgcacgtactactttatattgtccatctagctggtgcaatatatatttactggccagagatcgagaggatcgtcggcacagtggatttaattttgtttacaaagtctgcatggtcctaatcacacgcataactagggcctaatttagcagggggccaggtactggtgcgagataattagttgtagggttgtagtcatggtcgtacggtgtatctttgatttcctgccctcctgtcgccccacttagatatatcattacatggtccatgcatccacacacatctctgcatcatgcattcgcagtacgtactcgcctccaaatatttctccattgaattaaccataaatgatagcaaagtacgtactcgattaaactcgaattcgaatgcgcgtgcatatgtatatatatccacgtacgtaccttagtttgcgctgaaatggaaactaaacttgttgacatatgtattggattatttagaactcttaatatcatgtgggggtacatatatgtccaaatcaatggaaatatgatgtgggactcaaattaaatcttcgtctatgaactccaaatttaagtaattcagaaaaggtccaaattcagctaaaataaaaacacaggatacaacagcacgtccaagagagagctgcaattataatgcatgcgtggcccatcaagaaaagaaccgatcgacgatcgatctgctgcttaatgtcaaatatcaaattaataaagcatccatgcattaaacaacacgcattagcctttcaaagtacagaaacatgaagctctcactagactagctagcagtacactctactgtcctcttataattaaaagcactgatcgatcatgtctccagacatgcatgaatcgatcgatctgcaacttcgcaaacctctcgccatccaaacttaatttggatttactactaaccaaaccagtcatcacgatgcaaattatatcaacttacaagaaggcacagatatatcgcttcctagtagtagtactagtttgctagctagttatatatcacttaattgttctctgaaaatataaaatactccagttctgttcagcaggaggggctagtagttgagccgcaggcatgctcgatctaacggccagccacggatgcgccgagctatcggtagatgcatggtcggtggcgatcggtcacatgaggaggctcctgatgacggccgcctggtcgctggtgacgtcgggggaggcgagcagctgagcgagcgtctcgctgaggttgtccacctcctggtgcaggctcctgatgtagctgcacgtctcctgcaaaaccctcgccgccgagccctgcattcatacgcacacgcggctgtgagctcactagctacttcactcatgggggctctctctctggttgtgttcgacatggaaaggatgctatgcttaccctatgggcgccattgcgagcctgagactccgggagcagggcctgaagcttggagagaagctcggcgatctggtcctccgagatcgacgtcctcgacgacgacgacgacgacggcaccgagctcccggctcgccgtgagcgcgacctccggctgctcgacatggttgcaaattacaaccacttgcagtgcagctatctagctagcttatatagtactaatagcttagttgagctagaagagcaagctaggtgtgcgtagcttatagctagatttgatgcctgagattggcagttgcaggcgagctgagctatatataatggccgggcgccgctagcgagagcttgcttagctaggccgccgcaagaggccgggaggtggaagcggagctgggagagtaagaggagagagaggcgaggctgaggccagcagcagggagggagaaagcgagagttgtaattgtgcgacagcgagagagacgttgtgatgacttgcgagcataaatcgactaatagtcttgagcatgtgttgcggtgcgaggacgactgaggagaagctactagctgcagcctgtgtgtgcgtgtgtgtgcgtgcttctttttatttggttcgtacttgcattttggccgctggatttgtctgtactctgtactatatgtgtgtggttttctggccggccctgtgctgttctctgaatctgcactccctcccctggatctgcagatcgatgccgttcatgctagctgctgggcatcactaaatagattagtcatcgatcagtagcatcttaattattgtagcatttcctctcaaagaataaagcatccttgtagtattaatccattatctaaaaatcttgtagtactgagtaaaaaaacagttttaattttcagaacctaaaaaaacagtattgcaatttcactggcattacctagctaataatatttcgacacaatttaaatttttaacgaggctaattaagtattccatatgtacatcgcttctggttgaatttttgcaatagcgactgataagaaaatagagggatggtatggggcaagtcacagtaactgagaacgacaacagaagaatgcttagcatcgtgatgttctttttgtttccaaaatctgagagttgttttcagtacggggagagcaagtcactccgtatg

SEQ ID NO: 46295 - DNA, 1147 bp, Oryza sativa
attcctgcagcccatttgatacacgaggcttctttggattgaattattttcggaggaaaattggatgatttcaatgcgtataggatttttattcattgggaattaaggaacgggtaacggaaaaatatggtaaatctttcacttgtaattgattatccataggaaatccatagaaattaatatccattagaacctcgcttgtttctttggaaaattcagtaaagaatcagtgtatatacatgatacaacttcaaatgaacattgttctgacacaacttaagattaaaaaaaatatttatattatacgtagtttttttttctatggatagaacacacaaccaaaggttacacgagtaacattaggtcttataactaatatacaaatgaaaaaaaaaacctagactactaatttccaatcttctcctaccttgcttcaccattccccttttgttacgcagcagcaaccagaacatcattgatgttaagattttcctaacagatagcgatctttgctgcttgatgaaacctggcacgaaaatcgctctgaggcaatctatagaagcctggatttctataaaccctcgtcgctatcccatccacttgaacacccccatcaacaggcacttgccggtcctcacagagctccctgtgtttgagatgcatagttaaaaaaaaaaagggggagaacattcgatccatagtacagaaaaaaaggcggtaccaaaaatagcacaaaatctctcctctttcaattagaagcaaatggcactaatttttgttcgatttgtagcacttctatcacatatgtcattcattaggctattccatattttccatgcttcttttcctcttgtcgatctcgccaatgcgtcggtggacggccacagtgcggcacggctgtcggagctacggctgatgcggcggcgtggggaggttgcgcgcggcgcagctaccatgactaaggccggcactacaaccagcatgtgtagcgcaacaacggcgagacgcacaacacaacaatggtgaggcgtgcggcagccaacatggcttctgggcgcaacattcgatatggctgctcgtcgagataggtgcgttatttcctggcagtttgtggcgtgtagcctcattgactacgggctgcaggaat

SEQ ID NO: 46296 - DNA, 6376 bp, Oryza sativa
cccccccccccccccccgttgtccatcgggatcgaaccaagcaaaatagccaaggagtccaaattcatgtttggttagaataaaggggaaaaatcgtcttttcacgtgtctaatcatggctaaccaatcgtttattagacggaaaatatgacggaggggcaataaatcgaagaaaaactagtggcatgtgcttgtggtttaaagcggagaaattttatgatattttttggaaccaatgttttttctatgctatgaatcaaattttctcttaaaaaatgggttttactctattcctatgttccgaacaccttatcgcatcccccctctactttatacatgcatcactattttattcttgtggtttgtattcatatatgttccagatgagctcttaacttcggtttccgtcgatataattatattttgcatacagtaaatttttaaaatacaattagatctgatatacacctctattttcatggatacaattaaactttgtgtacaaacatttggtgatctacacttttataatatggacctatcatgattgaacggtgcattcgctccgtcccaaaataaataaacttttgtatataaatatagaaagttgttttattctaggatagagagtaaatctttattatttattcctactaacataaaaagtttctaagttgaccgatctctcgtgtatggatacaagacagtagacatatatttgcccacgtcacaccgacgtcaacttggtactacgaagtaaattaaggacagataccagtatcactataggcggtgcggcatatgcatgtggagttcgccatctcgcgaaaagggaaacaggtgatcgatcgagctaaagagagcaggtcgagaattgtccggccggcttccaggccatgagacaacaacggcaggcatggctcctctcctgccatcggtctctcgccactgtccatctacacgtacgcaccccatctcgtaccgtacttgtgccgctctataaaccgcgtgcgtgagctatctaagctatcgtgctcgatccgcatccatcagaccctgacgaatatacacatgcctgtacacaactgaagctgaacagctccaggagtccagctgcattcgtgcgtgcgttcttgtcgctttgtcgtcagccaccatcgtcctcgtggcaataactcgaccagctcgatcaccatttgggcggtgtggtacgtgcgggcgcctagctggattgcatggagcgaaagctgcgaaaaccccaacgacactgttaacgaaagcgcagtcgtaggttgaaccagcaggtagtgaataattgtattggcaggtgtttgtgcattgcacgcctgcacatcccatcgtcgtcgttagctcccccgcacgtacgggggagccctgttcaccattgaaacgaggtatacaacgtcggtttctgcggtctgtgcagcgcgtgtatctgcgtactgtcaggtgtttgtatcctcttggtttatctgccgattgataccgttgttattgtgtgtatacttcaggccactgttcgttcccgatggttgccataccaaccttgtcgtttgtcgattccatcccgaacgtcgtcattgcgatttgcctattggactgaaacattcttgtactaatcgataccggtgtggcggtgtattaacaattataagtttgttaatatatgttgaattgttaaatatgttatctgaattttgggcatacgataaattcggattagttttctaatagagagagactacagaacgggattccgttagaacgggatattttaagtgactcctccccgcttccacgtgcgctctctcctgatacctggtaccttggatactagttggtacctgatacctagtatctttggtatcggttgggtactggctgataccggtacttagatattttaagtgattccttgctgatacctggtaccagggtactagttgatacttggtacctagtaccacttggtacctggtaccacacctggtacctggtaccttggtattgagctggtaccaaggtctgatacctaggtaccaggcgtgataaccaaaagagagagcgaacgaaggcatctcagcttcgcttgaggcggagagacgttgcgcgccgccggccgccgcggctgctgctcgcacggggcaagaccacagcgacacagcacgtggcggcgcgacgcctggacaacaccttcgagaagctcgcgtcggcgcacctccagcttgtggtggcggcgccattggtggacgcgctgcgcgggtcgcccaccgagccgctcgcgctccccgaccacgcccaccacctcccgctccggctccaccggcgaggcgcgttcccgctctccctcatgctcatcacgcccgccgccgagctcctcgccgtcactacctcccccgcggcggcggctgccggctctagcgaggcggtggggcgacggcaacagggagagctgcacctcgagtgccatctgatttgggggaggggagtgaagtaggaggaggggatccgaatgatttgggggagaagagtgaggtaggaggaggggatcgatcgatttgggggaggagagtgaggtaggaggagggatcgatctggattagaatcccgtctccacgggataccggtgtgtagattttctctttctaatagaactcgactattaagattagtttcctagtatgactcttaagtttttccctaataggactcttatatttctcctatatatatatccctcgtaaactgcacgggaggatgcaacagcccaatgtatcctctgcgtttgtattcaactcctctatagtgattattgccggtcggagcccgtggttttttcctgcaagggtattccacgtaaaattcatgtctccgttgtgcatctattttcataacattaaattgtttatatataatattgtaatgaaactaagttcaagatttctttcaaaatttaaaagcatgttaaaatgtgcggttattcggttgtatacgtggaaccaattcaaccaagtgctaactcaattttatttgtaagtgagcataagctttgagcatcattcgtatcaaaattgatcggatgaaaatttcacaacttcacttgccgcagcaaatggatcgaccaaatgatgagggaaaatattaaccaaagaagatatttcataataacatgggttgattggatctatgtcattacaaatatatcattttagataaatgtcattaatattcgtctattcgcatcgatatcatccgaatacatacaaaatggaaactataccaccgccatcgcattttagattttcgaccccaatttcttcttgttctcctctctttggccagccacaacagcggcgccgacaccatcaccgccgcacacaccggcgatggtgaggcgtggcacggggaggagcaacgccggtcatagttggcactggccgttgccttccctatttcctccctcactatcgaaccctctattattcccttactggccgttgccttccctattacctcccatcgtcgtcgttgcattagagatgtcgcactgcaccgccatcgatgtcaccctattgtcaatccccaacacagccagatatctccttgctctcactccccaactatccacctttccaccaatcatgggtcgctgatgaccagatccacgtgaaatgcttgggcagacttcgccggcgtttgatgacgctctctctcgtggctcgatctcctggtgagggggataactctcgctttgatcgagtgcgacgtttgcgacgtggctaccaaccagaacaagtccaggacgccatgcaatcgctacaccacaaacgatgtcgtaccaaccgtgacgcgtggttgatgatccctgtaatgcaaacgagagaacactgcaagaacaagataagatgcaatctaaatattgctaataggtaactaagcacaaaggaatagttgcgattgaagtggtagatctaatcgacccggcaaatcaacacaccaactattaggggctctgaatcaatagtcgccgactaatcgagcgaggactaaagacaagatgaatggcacttggcaaaattcaactaaacaaaaaccccattattttttaggatgtacaaagctatttgtagaggaaaataaagctaggtttaagtgctaattcgtggaggtggagggagacacttccgagatgggcctagtctattacaaggcccaaggcccaagtttggtttcagcaacagcactgccttattttggcgattcccgttgactcaagatgaatttggacatgagaccagatgcgtttgaaggtagcgagataagctttccacgaagtccaagatcatccaaatcggagttggtatgaagacgataggtccgtttgaaatcagtgctgtctccggaggccgaatttgattgtaaaactcattggactttaatatcttgtagatcctccattcatccaatgtattctttggcaatgttttatatttctcatgcttggttgtatgcatatacttgatggtcacatcagcgttggtgccgaccgcaccaactcttgagctccatcaacctcggcgtcttccccaagctctcctccaagaccaagctccttctcggcaataaggccatggctacctctcagtgttcgagacaatactggcttccatggtcggtggtccctccctagtggccggtgacgtgttcgcgcctagaacaatggtagctagcagaggaggagggaaagaaggagtagccgccgtccctgccgtcattgtcagccccctcccatgcacactggaactggcctctcgaagctcactgacggggagaagaagaaaagaggaggaaataaaagggtttgtgacggaaaatgtttccaatattgtgtgtattcgatgacgtggatacgaatagacaaatagtaatatcatttacccaaattgcatatttgtaatggcatagatccaattaatccaataacataatctagctactctcagcaacgtgccattgcctcgcttcttttgctatctaggtgtctattcccacacaactcgtaccactaacatctggggctacaatttatactattcttcacatttcaacaaatcttccctctttcactatttgcttccccaaattttaaaatcacttacttgttcaacaaaagaaattatagtattacttagactaaataaatatttattatttgataagctagaaagtcaatttgttttccgttgcaacgcatggactttaggctagtagtggtataaacaactatggtcggatctgcttcttgatcatccatgccaaggaggctaactacatcgttgtttacttcattaccacttttaactctattaaattaattttgatgctatcaaattttagtagaataacaaactaaacatattcatactatctctaccatacttaaagaaaatgaaagttctataagtttcctctcataaaaatactatcaaattttgaaaagatttcaaaataaatatatccaatgctactaaaattagacaatatcaaaatataccatatgtttgtaatgttgattttataaataagtcctcagagcagccactaaacctgcaacgcttcaaagcaacaaacgaggatgtggtcgacatttgaatggcttgcctgattagcatgactagtgttgatctggagtgacctgtatttgacctgtgtcatggctggaacagtacgccacttgacatttactggttttgagtagtgaattgaaattccacgcgccggctattccggctagtactgaaacggtatcgataacctcgcactaaactttacactgtagcgagttatagtgaaaagaaaatacactgtaaatcaagggaagatgcagtcgcgcttgcctcgtttacgaacgtgagatgggaaaaaaaacagcaaggaaaatgagagtaccgagtacgtacgtactccctccatcccaaagaaaaaaaaatttagatttctatgtctaactttgactgtccgtcttatataaaatttttttataattcgtatttttattgttgttagatgataaaacatgattaacattttatacgtgacttgtctttttaattttttttataattttttcaaataagtcgcacagaaaccagggtgggtttgtcttttttttttttttttgacggagggagcaggagtaggtcgtaaaggacaaggcacgcggctgtatcgagacggcaacccgggagagagccccactttggcaatcgcgagtaggcgcggcggccgcgtcgccgacctgggcgcggaacagtgcggcggattcggggcaaatcggccgcaacagtccgccccg

SEQ ID NO: 46297 - DNA, 3369 bp, Oryza sativa
agactaattagactcaaaaattcgtcccgtggtttctaggcgagttatgaaattagtattttcattcgtgtctggaaactccttccgacctccggttaaacattcgatgacaaaaaaaattatcgtttcacgaactaaacacacccttaattgcgcgctttggctgagttacgttgccctgtgcttctgtcagcgcaggcgagcgatgcacagtaataatgcgtaaaaccgtgcagatgttccaagagtacagtatgccatgcaaacggttcatattctgaggcgcttgttgagaaaacatttcggaagcttggtttgtcacttcgtgccttgatcgtttgggccgagatttaagccgattttctttggatgggccagcttcccagaacttcggtgcgaaaaagtggcccatagataaattccgtcgcagaaatgcaatgcacggttgacgattgatagagatcgcagaaagtagcacgcacgaacagatagtggtcaggcagaggagttgcatctcaattttgaaagtagcacgaacagataggggacagacagaggaattgcatctcaattttgcatcatacgtttcaggaggaagacacatcttacaccgttccagtttaaacttaggtagatagcacaacgaccatagaagtttgccctagttatctacatcaacttaaccaccaagccacaagaagaagaagaagaagaagaagaagtgaaacaagtaaccattccaatcacaagagcaaaagacttatgtcatactaatcatcgtcaggcgtggtgttgcagctgcagcaaccgcgagtacgccccctccggcctggacacgagatcagagtggctgccgtgctcgacgatccggccatcctgcacgacggcgatgcggtccacgcctcggatcgtcgacaggcggtgcgccaccagcacggtggtccgccccttcatcagccgctccagcgcctcctgcagcacgcactccgactcggcgtccagcgcgctcgtcgcctcgtccagcagcaggatggccgggtccttgagcaccgccctggcaatggcgatccgctgcttctggccaccggacaactgcacgcctcgctcgccgaccgccgtcttgtagccgttgggtagctgactgacgaagccgtgcacatttgctgtttttgccgcctggatcacctcctcctccgttgcaccgtccttgccataggcaatgttctcaagaatgctggctgcgaaaagaacaggctcctgctgcactaggcctatcttcagccgcaaggccttcaagttcagcctcctaatgtccttgccgtcaatggtgaccttgcccccggtcggatcatagaaccgctcaatgagagcaatcacagtgctcttaccagacccactggctcccaccagagcttgactgcgcccagcttggatttttaggttgaagtccttgaagatttggatgtcagggcgagccgggtaggcgaagtcgacatgccgaagctcaatgtccccacggacattggtgacacgctctgactctggatcatcaggctcgattcttgtcgccctgttgaggatgccaaagatggagcggatggattcacctccacggacgatctctggggcaaggctgactgtctcggcaacggagttggcagtcacaacaaggacaacaaagaccttgatgaccttggagaaggtggatccatgagaccggaccagatgagaaccataccacagaatgagtgcttctgatgagtacaggcagagctgtgagaggccaaacagaaggcctgatgtctggctgcggcggaggatctgctgttcaggtatgcgcaattcataactgaacagagaaaggatcttgttctgagcattgaatgctgccactgtgcggatgttgctcactccttcaccggcaaccatgctgctcttggcatgcgcctttgctgtgtcaccagcgaagcccttcatcgaaagttgctggaagaatcataagaaacatgtcagtattaccctactgttgacgagtaataccgaattacctaaataccattaacatttacaattttccttggggatgaacatggaattataaggtaagattcagaatagatcactggaaaaggaaggccaagaaattacctgggcaaagttagcaagcacaagaagagggaaggtggccaggataagcagtgctactctccactcaataataaaaccaacgatgaacgatgtcataagggaggtcatgttctgcagaatcactgatatcctctcagctattgcagacttcacatcagctgcatcaactgctagacgagcagccacaagacttgagttgttctcttcttcatcgaaccaaccaacttcattcgtaagtattgctgcagaaagtgacggagttttacaaaaattcaagatgacacaacaaatagagcattagatttagcatagccagaaatgcataccggaaagcatcatcctcctaaccctggttgtaagattttctcccatgatgctgaagaagtaatgctgcacgagataagctacaacagcatataggccagtgccaatatagatgaacacatacaattttgttttcttttccatttcattggggtccctgtagtagaacacatcaagcatttctcccataacaatggcgaatgttggaccaatgaatccagagaggacagaaccaacagcgcccaacactgcataaggccattcaggagcattcaatttcaggagcttgaagaagtaacctcgtggtgctgggtatttacggtcattatctgcatttgaaatcatctcaatgcgaccatttgccccagtactgtactgatagctcaggttccttaaacttccagacctgaggctgagagattttgtggaaagtgaactggtcaggtgcatcgagcgtgacctgcgggtagatgcaccaccaaggtctctgttttgtgccatttcttgaaaacgaatcagggaggcatacgctccagagctcccttttgctagaagttcatcatgtgtgccagtctcaacaacttggccctgctggatgactgcgatcatgttaacatttcttatagtggagagacggtgggcaacaactaccgttgttcttccagtcatcagccggtctagagcttcttggacaatgttttctgagcctgcatctagagcacttgtagcttcatcaaggagcagtatcttagggttcttcagcatagcacgagctattgcaatacgctgtttctgaccaccagacagctgtattcctcgttcccctacctgtcaaaaatagaaataatcagtgttgagtgaattagacttgactacacatacatcccaaaaaaaggt

SEQ ID NO: 46298 - DNA, 3201 bp, Oryza sativa
ctgaattgcttcagagtaggaattgagtgctttgctctctccagcaaatgagtaaactgttctaacttgagcaattgcctgaaatgtttaaacccaattacagtcagcatgcaagtaaaaagtagcaggcaattatgtaaataaatattctttactcatttactggaagaggcaaatagagcacagtaaggaaatatgaaattgcacatcttttaaagcagctggaaattttatttccatatgacagttcaatttaataaacatagtagaatatctgtggatttatttggaaatgtgcaaaagtgatcacggatatttttgttgttgacagttgactgtccccatcctacgcctataaatggtcatggctaaccacccactacgcataattttgatactacaaaactctatccactttcagcaaaatttagtagtactgctctgtttgttaggtgtttcgcgcatgtcaatttagcagtactgctctgtttgttaggtagactatgccaacctggatgctcaagagaagtttagaaaagccttaattaattttattcattgagaaagatctctagtaaaaatcggtcactcctgatacaaatccacatgtgggatcaaatgggccactacaccaaaagttgagcacacaagtcagcttcaaagcagaaacaccataacaattcatgcagaatgttctgccccacctagttatggaatagctcataggattcccatggaataaaaatgttgaaaagcaccaaaccgcatgttggctagtcgccattcgccataagaaaacaagatttgggctcctaatcagcagacaacaccaaaaattactacctacccaccacccctaattcaagtgcaagtccaaagcacccaccacggaatgcatagattaatgcaatacagatcctaacccgaatccacttcgcactaagctgcagtggacagtacactgactagtacagggggtacagtaatagtgtaattacagtagcagtaaagttgctcacgggaatagccgtagccattattgttacctgctctgccacgacgccggcattggcataggactcccggctcttggaggtgagcccggtgagcgtgtaggcgtacaggccgccggcgaaggcgatggccgggatgacggccacgctgagcagcgcgagccgccacgccgcgacgaacccgaccaccagcccggcgaggaaggtggcgatgtagtggatgaagttgccgaccttctcgccgatggcgtcctgcacgagcagcgtgtcggtggagaccccgaacacgatgtcccccgtgcgcgcgtccgtgtcgaagaaccccacgtcctggcgcagcacggcgtccaggtacgccttcctcagcgcgatcacctgccgctccccggtgtacatccagcacgcgatctctgaaaccacgaagagataaccgcggattagatcacgaattctcagcgcccaagaaagaacgcaactcccgttgcgcgatgttactacgactttggtgcgcactgatgcggcctccacgccgccgccgccgccatgaactccggcaagcgacctcgccgccggattcggcgacacgagaaaaggacaaacatgattattgttaaatctctcctccccgtttggcctgatggcgatgggacttgtgtttgtgagtggggtggtcttcgagatgccccacaccggccatgaccggatcatgttttgcaataaagcccccgtatttcttcacaacgccccaaaagagccttggtgcgtgggagaaaacagtaacagagggtgcttgaagaaatttacggaaatacaggggtatgagaagaaacggaagctcacctgcgtatgaggaggcgcacaccaccagtccgaggtagacgaagtagagggcatactgcgagaaagagcaagaaacaggtgatgaacaccagcgatcttggacaaagaaacctcatcgaagcaacactaaaaatgattcgagagatcgcggagataagtttgataagtgggggtagtgaaactgtgaagagcacggaccttggagacctcgtcggtcatggtgcggaggtcggtctggttcttgccgaagccgttgatgaggtcaccgaacaggaggaagaagagcggcatggcggcgccgtgggcgagcgcgccaaggctccccgccgccatgagcaccaggtcccacttgtcggcgaacgtgaacagctcgtggaacgccaccgcctggtccgccctcttcttcccctcccccgccgcatcgcacccgttcacgccgccgttcgccgccttctccaccttcccgtcccccgccgccgccgccgccgactccgccattgcaatgcgtcccctcccaaccctcctgacccttcttgcagagccgagagccaacaacgcgcgcgcgcggctcacacccgcctcagcttctcacgccgccgccgcgccgccctgcggcattggagaatcacacacacacacgcacacactctccccactctccgggctccgcttcgctttcttggtggggttacagagaggaggaggaggaggaggaggggctttggttcgcctcgggcttcgtgacgtgcagggagagggtggtggtggtggtgcttttgtgttccgcgctgcggaggtcaggtcagacttcagaggaagtagggcgcggcgtcggggcgagagataaagaggaggagagagatgctggcagtgcgcggcgcggtgccagtgaaaactactcactccgtaaaaaaagagagagagagacaaacctggtttccgtgtttaatgtttgactatccgtcttatttaaaaaaattatataaaaaattaaaaaaacaagtcacgtataaagtattaatcatgttttatcatctaacaacaataaaattatgaattataaaaaaaatttatataagacagacagtcaaagttagacacggaaatctaaggtttgtcttttttttttggaacggagagactagcttgtggtgagctttacaatctcctcactgcaaatcctggattttatttacagctcaaatagcggcaggcaagcagcaagtgcagcagatcagctcttttacatgtgaccttagcagtgaccactttgtattaacaaaagaaaaaatcgagcttgagcaaaggagatgctacaactctaccatccgtaaaatatgagcagttt

SEQ ID NO: 46299 - DNA, 12232 bp, Oryza sativa
cgctgctgcgctccatgtggtgtggtctcgcctcgcctttccccttcgcctatgggcaactcggctactgaaatcagctcaactgcactgctgcacatctcgagctctcgcctttgaccgcctgtccgatgcaaagggatgggggggcgtccggccgtgacggcatccacctgcgatctgcctacggtacaagcaaggaccgcacgtttcagttttcacgatctcggcgagcttttcgggacggaggaggacggactcgctttgcttccggctacgtacatatgcgaccccgatgtcccgatggagcgtcggaccgacacgacgacgatacagtacttgacggcacgcgaccccctgaggatttcaccacacgtacgtaccggtacgggccaaaaaacttgcagctcgcacatggcgttatccagtatccacgcgaccagcatgtatggacctatgccagcaacagtaccgcctacgtgccaacagttaatattttttgcaattttacggatatattcgtagttgtagcaatgaagccattttttatcttttgttggagcaacgagcaatcagtgatgtgccgatgtgaggtagacaggtagtactagtaactttgtttggggacttaataatgtcattagcaacgcaaaagcaaggatgtgaggatttctaccctcctagcgaactagagatgatcatggaggatgggaaaagctgtgctccactagtatgcatgcgagctagaataatggtggcatcacgtgggcttaagtgttctttggacagactaatccacacattccaaaaacaaatgtgaacataacctttgatagaatgatacactctgaaaggtactcgtataatagttagcgaaactttctcagtacagaattcaccacatgtgtgttaatatatacgctagcttggattaattactacgtttgttactagtcatattgaccataaatcctttaggtagctgagcagaataattaagcagccgttttcgtaacaaatgggcatctttgaaactgacgaaagctttttttttttgacaactgacacaacattaggcctacggattgacgagctttttgaccgcccacgtacttctgatcgatcgacatccatggagttgctcatcggatttgccttgtcgatgaagatgttgacgtgttcagtgtttaacttcctccgtcccatattacttgtctttttaagtttttgtttgtcaatatttgatcattcgtcttatttaaaaattttagaattattatttattttgtttgtcatttactttattattaaaagtactttacatatgacttatctttttttatatttacactaattttttaaataaaacgaatggtcaaacgttgcaaataaaaagtcaaaaacgtcatctattataatacggagtgagtaggtagtagtgtaggagtagctactaatacacgtagtatactgtctctgttcctttctaaatgcttgttcatgttgctttccaaatgcttactgatagcatttgaaaactactccactcagtgcttcgccgcagtaaaaaataagggctacgcaaactcgggctgaaagcctgaaactcgctagcctgtaactcctaaactggattcagaatacacatcttcaaggaaaaaagattcagaacatgcacattcagggtgtgtttagttggggaaaagaaaatttttagatgtcatatcggacgtttgaccggatatcggaagaggttttcggacacggatggaaaaactaatttcagaactcgcctggaaaccgcgagacgaatcttttgagactaattaagccgtcattagcacatgtgggttactgtagcacttatggctaatcacggactaattaggcttaaaaattcatctcgcgatttcccccataactgtgcaattagtttttctttttatttatatttaatgcttcatgcatgtgtctaaagatttgatgtgatatttttaggaaaaaaaattggggaactaaacggaccctcggaaaaagggttcagaaaatttgaacaatccactgttcctgccttcctgatttgtagcatgagtagtatcaagctatcagtatcaaacatgtactaaaattcagtagactagtatttctggttgcagcaccactactgtcaaatcggaggcaaaacctcaagaaaggcagcgagtgagtgagcaaaacaacagggcctcagtgctgtgttggtgctttgaggattgctttggcagcatggccagattgcagaaatgattggagcagccgcatccatcaactggtgttttcacaaaaactccagatcacaaaaaaggagtattatactcgtacggatcggattatatattgtgtttgtcactcgaatcgccagtgcctcgcatgtttacgaggactagctcatcgtcggcacgctttacagggagaaacaggtgcctgctaaagctggtgtgttttttgatctctacctttttcttttcatttcgttcctttctttcagctcatcagaggatggagatggagtaaaaagaaaaggctgtggcagttcgtgtgcgtcctggacgacacacgccaccctgtctgctgctagcctgctactgtctgaattctgaaactatatgtgatgcgatggctgtcgtcgttgctgttacatgctgcatttcgataattcagagtttcagacattatcctgaaagttcccgtgccacaatattcaggacggtttctgttcatgctccagaacggcatcaccaggtgcagataatgaacagattacaattccttcatgatctgtttttgtttggaactttggatagctgcggaaaaaggagatgcgtttcggaacctgcagcgaaatgcgccgagatgttgggcacatgcttgaattaaagcttggtaatttttgcgcaagttggaagaatatcaggacagttttcagtgatgtatacagctatgtattctttcgtgtataatgcaagaggacagtctgcttttaagctaatcaggtccatgattagggtttgtgggaggcatgatccatcactggacctcaaaatgcatgcttagaatatattcatagctggtccctgcagattcatgtagaagattaagcttaggcaagaaagggattgtactagactgaataagaaattgcccccacgcacgctagtaccatgtacgtatcctgcctagcaatgcaaacactccaactactacctcgcatctgcttaacgagcagaaaaggttagggaaaagcaaacaaagctccgagctgtgacaccgctactaatcgcgcttttccctacccactagctaataacagtagcattgccattaactaatcaactgtattcaactgcactatctgagttagtcacacatgcagtgaagagtccagaacatgaacccaggatcagggggcaaaagttcagaaatgtcgagacaatcagtaacacaatatctctgtaatttaccctggtagtccctagctacaactgtactgtcccactattaacagtgccataatactcctagctctgtaaaattaaggaagagtgaagtgtttatttcactgtgctcgagatcactatgcatatgaggcaagtgcgtgcgtccaacttgcttggggggtccgccgtttcgtgctcgcgaggaggagctaggcgtgcctccatagttgtacttctgcttttccgatggtgcagctgagaagattgagagaggagaggagaagaaggatcagtgccctgcatgattgatggccctgtttgacgcaacatgtcaccttgtttgtcgagactcaccgtcctcggattcatgatcagttcctgtttggctcctgctgttcaggcagaaatgtactactgccactcggatctttggagcgctgtgctgtgagtgacctgtgtgagacagtgagggggtagcgagcgatgcagattctattacaatgatcatcaggatgtgatcatgcgagatgagctgctagatgcaagtgctactgatcgagtagcctgctggtactagcttactgttagtcacactactcatgtcggtgaaacggggcaaatgtgcagcagatgtaatagcggatggtagcagtcgtttttgatgtctttatcttcatgtgccttttagactgatcttgctgcagtattagttactacaggtgatgccaaatcaactgtttgatataccatgcatgcatgtacctgtgattcaataggagataccactatcctactggaaaagttcgcacgttatatcgatataaagtactgaatgcccatgtgaaattcttcagcattgcctttctgaattctctaaactgtcgaaggtagactggaggagaacgagactgataagtatgctaggatgcaaaatactaataactgaaacaacaatctgcatgatccattatcaactcatcgttagcaggtagactcactaataatgagagcatagtttcagtctttcagagacagctacaccaaagagaaaaacagaagaaacacacccatttggacatctctgaattcgtctgttcatctttaccaacttaccaaaacataatcaacgcatatatatctctctttgcatctgtactcatcgaatcttaaagatcagccaaacatatcgagtttcagtaaccaaagcagaaggaaacaacagctacaggacagtttctccaaacgaaccctattaatgcaacagcttcctgtttcagtctgtactctgtagcagatgtaaaaccgatgtaaccactcgaccgtacaaggcccagatacggtccacccccggcagttcaagtgggccccaaaatcctgactctctctctctcccagcccggcccaccagcacactaaatgcaagcccaggcagcacggccactggtccccaattaatgcgcacgcgcagatggtgggcccgcgtcatagtcaatgaccccaccggtcagcccgtggcgactcactgtacaccgcccacaggaacgggacccacctgtcggcgtgaaaggactcgtcgaaacggtgcagacggggagagccgagccagtaaaggcggctgggtcccaccgcgccatttcgaatttgcgagtagggtcacctcccaccgggtattgctccgccgtttacgctccgaaacgtttcgaatttccgaggtcgcgacgcggaaggtggatccgcggtgagagtcacgtgggtggtgaccggaatcggggtggtaaaaatccaaaagcgaacgcagcgcaacgcctagctcgtctttcgtctctgtgtgcgcgtgttgtttttttggcttctttttcgcttgccattcgcgtggaggcgtttcgaaaagtttgctcggctctccccgatcgagagagagagagagagagagagagagagagagagagagagcagcggaggagatggcggcggcggcggcggcggcgaccatagggatgatggacagcgcgtacttcgtcgggaggggggagatcctcagctggatcaatgccaccctccagctctccctcgccaaggtcgaggaggtaagggcccccccatttctttccttcccccgcattcgatttggttcctcggatgaaaccatgaaggcgtaggggtctgatccttttgcaatttaggagtgggtgtgtgtggaacttgtggttgggctgggactcggactgttgtgtgctgatttttctgggattttggtcgtgttcccctgcaggcggcgtcaggggcggtgcagtgccagttgatggatatggttcaccctggggtggtgccaatgcacaaggtcaatgcttcttcattcctgttgttttggatttgatcgatctgctttatgtaatgctgtataggtgccttaggcggttctgatgctttattgtcatggggtttgcaggtgaattttgatgctaagaccgagtatgacatgatccagaactacaagattcttcaagatgtgttcaacaagctgcggttgagcaaggtattggttctggcctcacaaatgagtgcttggcgtctttgatacatgtaggttttcatgatcacgcccttgcggctttgatggtttcttgagattctaaatttatggtatcaggagattttccattgaagcatgcctgttagtgacgttagcatagtgagatgacaaaaatattcatcatggactaaatttgttatgcaatattctgcggtactgaaatcagattgatgttgtgcttaacgacaagtggaaatgaaaactggttaagctcttttttgtgtagagctgtagtgtgtatactgcaaagattgattttgtgaggcatggatacaaaatgtctcatgattcatgatactggttatatcttagtattgtgcagcaaaaggcagcaatgtattctgtaaccgtactatcattaggatatggcaatgtgattaggttgtgttattatgtagaatgatggtggactggtgattgctttcatggtttcttatctcaaaattagtgcacgttgaagatgtactgttgttgtgtttgtcctattttcactctatgtaacaaggtcattagattagacttgtgccacaggatggcatctgattgtgaggcctttgttctaatgcttcatctgtgtccctctgcaactatttttagatcatatgccccatacaagctgtttgttctaatcaacagtggatgttccgtgcagaatattgaggtcaacaagcttgtcaagggacgtccattggataacctggagtttctgcaatggttgaaaagatattgtgattctgtaaatggtggaatcatgaatgagtatgtgccttggttatgctgaatatgtaagataattgcattctgttgctaattatggagttgagatttgagaaggcttgtgttcaattttcagaaactacaatcctgtagagaggaggtctaagggttgcaaagaacgcagtctcaaaggttccaacaagtcgtccaaatcactacaagctaatagattgtctagtgcaaattcagctgatggaggtacattgaatttgtttgatactatgtgcatcactaaagtattaataagtgagacttcaagtgtgcctttatggttcataggagtactttgctctcatactgtaatgattaaatcaattcaaggccttaagagaagctggatggtgccaccagtctctcatctacttaggagtgttttaaaatcaatgctcctttttatttggtaccatagaagcatgattcacttgtatttgatctcatttagtaatagctctatttttgcccaattaaacaggtccatgcgttggtaaagtcaatgttatctctgaagagcattacatagaacagattcagcaattatctgagaaggtatggaccatataatccaagtagctgattcatcttaataatgcgacctgcatcttttaaagtttcttctaatgtcaaaagcccaatgactattctgtttgactgttgtagctatccacttctttgaagttcagtgttctgtagactgtagttgtttacattgatattgctacctttaatccacattctaatcatcctcgctatgtagcgtgttagggtcatgttttgcatcttcaatgctaagtaaattgcaaacttatgagttttgataatgcgaatatctctattgagttgcagattgcaggcctgaaaatttctatggatagcgcggagaaagaaagagacttctacttttctaagctgcgcgacattgagatactgtgtcaaagaccagagttggagcatcttccggtaagtaattagctagggatcttccagtattgtgcctgtttgcgggcgcagattaaggctaataatttctgaggtcctatactcctattcattgaccaaatagtttcttttctttttggtttactactaacctgatgaatattgtcttgacagatgaccaaggctgtacagaagatactttatgcggctgatgcaagagattcgccattgcctgaggctaatgaaataatcacccggtcaccaagcatgttcccagatgaagcctagggagaaatggcatcaatacactcttaagctatatttagataattttgtggctatcctattttgtcgaatcgttgtaaatgagtaaataacgcttgacattagctacttgtggcaagtccaccgaagatatcttcggttctgacttgaatgtcaacttcctagaactagttgtgaactgaatatgcattagcaatgctcttctctcgtttctgatctccttggagatattttatggcattcgacagctcgtaacttgctttttttctggaatggttatgttggattatttatcttgatgctccacgtttgattttcattttctctaaaatgtggacccattatctatggtctattaacaggtgcaaattttacaaatccatgtaactatgaaacaacagaagtgaatactagtaacagctatacgaggaaggatgagtatctgtcacagctatacaggaatagcgaaaaaacaaaggtgagtatctgtaacagctatgcctatatccccatacgaggaagaaatgagtatcaacaaaggtgagtatctgtaacagctatgcctatacgaacatctggaagaaatatgagtatctcggagatcgaacatactgttgtcgctcacttgctctacatactgttgcggttcacttgctctacgtttgctgcccaattgctcctgtagtgcatcatgttaattgctgcattgcccaattgctcctgtagtgcatcatgttagttgctgcattgccggtgcctagctctagaaaacagaaaggaaacatttataattaagtaaacaggagttaataataattcatcaggagttagcaataattcaccatgagttaacaataacaaacaaaatagatataaattaaggctaataccttgtcttgagtcttcacctccttagcctgcgacttcgcctcggcctcacgaggctccggaagcttctcagattgcgtcttcacatcatgggactctagaagcttctcgaatttcttgatgagatgcgagatgatgccatctaactcttcgctagctttgaccgctttgtacagcaatgttgctacagccgcacagaacgtgaaaatggtgaggatacagggaggaatgcgcatggatcccttgatcctcctttctacagcttccttgaagtaagcagtctgccaaccaccgatcagaagaaccaataagcttgagagtaaactaggatctcctgagaatctctcctggactaatttgagaatccagcccaagagggagagccgggtgttggggaaggcgctctgggtgttggggaagccggggacgcagctacgaggactggcagtggaggcggtgcagggaagcgcggaggcggcgccgtcgatctccgggagtgccgagacatcgtcttccccgtcagtcctgcgcgcgcgcaggcgcaacacgtcgaagtgggtgaccgagttgatcggggtaaggcggatggccgcggaaggagtcgaaatctgcttccccaaaacgaaatcgcgtgacgaactcggcagaaatgagatgatggtggtggcggaagaggattggggggtttaccgaacattccaggcccggatagcggagcgataccaacgccatggccaccgtcgcggggaggcgagagggcgcggtcgccatggggacgcggtggggcatggccgcaggcaccgaggtcgcgccgcccgcggggaagcggagcgtcatcgccattgctgtcggccagcgaccacggggagttccgaaactagggcttggccagtaggtctctctccggcgcggacgcggcgaaatggcggcgcgattccgaggtagaggacgacacccacttttataggtggtgattattgattaaccagttggttattggcgaggcagcatagattacgtatcctccaagtagctgatgattaagccggtctaagttaactcttgttggttattagcgaggcagccgtgccctgaatttgcactgcggcaaatttggctatatgtactgaagtgatcagaagtttcagtgtacatgctacctcatgtagattcagtgcttcagaaatacgcaaaacaaaacaaactattatcatataactaattgagtatcaatcattttaaatttgaaaatgaactaatacgattattttaaagtaactttaccatataattttttttaaaaaaaattatactatcatttagtagttcaggaagcatgcttaaaaaacgagaggagttttcatcctaacttgtcctctcgaactcaaccttataaagaatgttatttcattcagactggagtatttaccagtgtgatgagaatgaatcagataagggttccacttgctagaaatccttaaaccagcttataacatcaaatccagacatccagattgcccaataacacattaaaattttttaagatactttcgtgattcatcaacacaggcatcatcctttttattattattattttgagcaaagagtacagccatcaaaatttgtgaaaagacaatcagttactcctgcaaaacatatatagcatgctatcttcattaaatggtcatattagatattcagatatccaaccttacatttgggtcattgagtctaccagaatactagttaccatctaaaatagaaaatagattacaatgagtgattccagtgaatctgtgaatagtgccaccagcaaaccaaaccaaacgactataacttaattatgttgttctagttttcttttttccatttgcatccatacataatgagaccctttgccacttttataagaccacctttgctttgcaatattctgtaaaccccaagccagaagagtcggatatagttggtgccaaccatctcatagtagacggttcggaagtatagttggacattaaggaacctgagataagcagataattgttagtacacaaagcaatgaagacatttttctctagggaacatcaaccacagtaaacaaggatctgtaatcagaaattggttcaatagacagggatcagcaaccctttacccatcccaaacccaattcacttatttaaagtttaaaatgaatatgtataatcctgaatagtcacaatttgcaatataaccctcaatcacaattacactaagaattagtataaaactctacaattcagaggttcatgccttctttgtcaatgaaatatacagaacaggaaaagtattccggtgatatgaatgtggtaacagaaaaaaaaagcttgattacttatatacgaggcatgcttatcgatgataatcaaggttaatatactaaaacactgaccagatcaatcctgcaaggacgccgtacgtgccctgtcataagaacaaaaaggcaaaaacgttaactagtgaggcttgaagcatatttgaatgggatttgcatgtgcctgtttgctgacgagaagtgggtattttatacctgataaccacggctatccttgaaagacaaaacaaataacagaactgcaatggaaagaaaaggatcatgcgctatcagcataggtgcaaacaaaccatacaaattaagtacgaaaaggatatacagtcgaacgttaaaagaaagtattttataaagcttaaattattgagcatatatgagtagaatgcataatcacgtatttcatgcacgtatttctttctacatgacatattctgcggacatagtaacccatggtaagaaaaagtcatggtaagacaaaaagcctttctgactcacctagttgtatccgtgcacatatgttatttgccctgccgttcctttgcaactctgctgctaagatgcttagcttgtagaacatatatccaagaacaatgtccacgaaaaggaatggtgtcatgttgcatagttggctaaaaccggcgataactaacaaagcacctgcaaacataacacccagagtaactcatgtacaaatcacctcagttcatctctggtgctgcatgcctgcattattcgtgttcatatatatattataaaagtgtctttctatgcagactgataagctaagagaaacatgaaaaacaggatcttatcccgtgtaagagactgaactaagggggtgtttagatggggctaaaactttttagcccatgtcacatcggatgtttggacgctaatttggagtattaaaca

SEQ ID NO: 46300 - DNA, 1310 bp, Oryza sativa
tttcataacagaggagaagtgcaggacttcgaacacaatggtaagagagagagagagagagagagagaataaatttcagaaaactccatgtttaatggttaaaattacagaaaacctattgtgacataaaaaaaagaatggtgctagaagagagaaattgatgggttttgtttttcttttaccggagaggatgccgatgtggaaactgcggcagcggaagaggttgccggcggcgccgatctcccgcagcacgcggaagacgggttcgagggggccggacacaagagcatgccatatagcgtccatctcctcccggcccttcccaggggggtcggaatccgcgagagaaaaatacgtggcgtcttcttcggacaagttctccgcccaccacggcgatccgggcagtgtgtacgagcctggagcaggatatggcggcagggcttccgagcagccagaagcgggagacgcggccgcgcaggacaacctcaagccaacgactccattgccacgcttgctgcatcgaagaaggccagcgctaaccctatcggggccgggccgcgtccccactggccggcggagcaaggcgccggctgatgggcagcatcggagagaagacgccattgtggcggagctcatcgccatgatgcctagggtcttagcacccggcgttctatggcgggtcgggggagttccaaaattaggcggcggcggcggcgggaagacgaaggggcgaccgccgaccgggcgagtgctcgatcaattagggccttgtgtcggggaagaggatacaactacgcgagcggagagaactgggtctggtccggcacgaccgtgcgcgcccgtgtccggtcgggttgcgccgtgcgcgcgcccgagaccaaccaaggatgagtggaccgagaccgaccgtcgaccgaggaggagtggacggctggtttcgagtccctccttccaaaagtataaaagtaccatttcattctttgattcttttaaaagtctatttcctccatccataattattgatgtaaaaacacgaggcctggaagatctaattaaactccagtgcaggttcaaaacttgcctttgggtgtgtgagcatgccagttgatttgatcctataatcaacaagaaacaaagaccaagaaaccgcggttaaatccataaacaatagtcaatcggctagttgccgatgacgtaccatttgtctttgagtcgatgtcatatgtagatcggtcggcagtcatgaataagaaagaactaaacctacttgatcggctgtagatattaatgatatataatccttatgtcga

SEQ ID NO: 46301 - DNA, 3860 bp, Oryza sativa
cagaaaggctgcagtaaacaaaattggatggacaacaaggtttaacccaacaaataatacctcctggaaacttatcaaggtaatcagtatgataacagcaaaccctcaagaataattactacttcctccgtttcacattataagattttctatcattgctcatattcatataaatattaatgaatctagacacatacatctatatgaatgtgggcaatgttataaagttttataatatgaaacggagagagtactaacttaattgcaagtgtgtgcagcagtaggaattgtgcttctacacatagttcttactgttcaaatgaggacaaggagcttgattaatgtgtgcaacaggctatgtgactcactcaccagacaaccatctcgcactagagatcctcctacgttggtattgcccaacctgaagtcccaaccatacagcctttctgttgcttactgcagaacaaaataagtacggttacatccacatatagtacggcttttgtttaatctgaactcctttaaatctcgttacctttttcacaccttgatcacggggtctctttgttaagttcctgcttcttgtcgatgttctggtggcagccactagagaaaaaaaaaagttaagcaaattaacaaaactcctcaatttcagttttaatggaggaaattcacaaacgaaaaatctacctgtacttccccgtcttggtaatcttaagaagataagaaccaagaccttcgagctccttgccggacttaatggcatcatacgtgaatgcaatggcggcagaggagaaaacaaaaacagaaagaacagatggagataatcggactcggtgcccaacttgatcggcaaccttcttccggatgctgggattcttcacagctgtgataagaagtgcagatacaacatggagaaacaggaacaaagtggatgtgcccgtgcccgacatggatgatccacctgtagaaatgtacacaaatcgctcaaacagggtagaggcggcggcgttgctgtctggaatctgcggcgtggccggtgcggagcttgtggcctcggtgtcgggcagggtggagatggcgtcgtcggccagggtgtcatcaccgtcgggcaagggggagttggtgccgtcgctcttgggccttcgtgctcgtgtgtgggagcggcgggtgacgacgggggaagccaactgctcgattaagaacacgcgaactcatcggtgggagaaaaggggatgggcggaggagcacgggcggttatggggcataccagagacggaaggcagcccgacgaagacgccggaatcacgaagacgccggagtcgccgccgcggggaacgaagacgccggagtcgccgccgcggggaacgaagacaccggagtcgccgccgctgggaacgaagtcgccggagtcgccgccgcagggaagcgggagggcggtgtcgccgatcgctgctcgattacgaacacgcgaactcattactcaatattcatcagtggagcgggctcgcggggcggcggtggagcagagccaccgaggtcggcaccgggtggaggcggagcgtcgagagcgacattgatgcggcgggggaggagcgaacctagggtttgggattagctctctctctctgtctctcctatggcgcggggcgcggcgggcggcgaaacgaattcgagaggtaccccgactcggggggaagacgatggcgccgcgacgcagaggaggaggcgagcgagggttttgtacttgtcactgactgctgggtcccacacggggacgggggcctgaccctctcgccggcgcgggcgtgcgatgcggcaccggacagcgtgttttggatcgatttgagccattttgggtcgatgtcaaaaggtataccaatttttagtagtttgaatagtaaacgggattgtttggtttaaaattaaatagttggcaatatgtttaatttggtataatcctataacttttttcatctaatatataggatataatttggcatccatttgacatcgattcaaacacactcatttacaatatcatcctatcaaaatcgaaacggtagtagtgcaaaaaacttggcttagttttaatattaccaatattttgatagggtattaaatcaaacaagtcctaaatacaattatggttgaagaacacactagaaccgggcggttaagtaccattctgcagaaaattggagtaaaaatcttgcacattaggatttgtgacccgactaacccttctccccagccttttaatcaaatcagatttgtcttagtgtagactagttgtgcacattaggatttgtgacccgaccaacccttctcctcccttagccttttaatcaaatcaggtttgagaatattcatgtcttgactagttgtgcaatagtctttttgagcatctttggtagttatatgtggtttcgttttcacgagcataaactatctcgtatacgagagactgagccaaagtgggcaccctagaatctttatgctaactacatgcgttcctcggtactccacttatataaatcatgatttgtaattggcatccatgcacggatatatcatagttgggttggtcttcgttgagcttagatacatgtggggaaatgagaaatcgacaacttcattacattgttctaggtgtcatttccatatccatacgtaaagagagactttatcacttttgtgagaccaccttttgtttgcagtaatctataaacaccaagccagaagagtctcatatgcttcaagccagtcacttcagagtagaccattgagaaatataactggacattaatgaacctgtgatcaacagataattatgagtacataaaccatgcaaatataggtcggaaccaaaagggaataatattatcaacaggcttcctaaggcatcaataaagagataaaaaatattctgctcaagggaatattaaccaaccggtaattaaagaattgtaatcagaaatagaatcaacaaagagggatcagcaatctttaccattccaaacacaattatattttacaatagaacacttaaattttaaaccagatgtcatttccctccagaaaaaaaaggaggtggctgtggagttggggggaagcctacttatgcattgcatctagagcaagattaacctatttaaagttcagaaggatttgtataataacctaaacaccacaggtttgcaatgttaaccttcaatcacaattactttgggaattaacatcaaaattttcaggtcatgctttttttcaatgatatttacagaaaaagaaaaatacaccggtgatgaattggatgttgccagaaaaaaaagacaactcaattatatatagagcagatttataatagatagtcaaagataatatgctgaaacactgaccagatcaattctgaaaggatgccatatatgccctgtcataagaaaaaagaaaggcaacaaaattaattagtgaggcatgaagccttgtttgagtaggtctgcatgtgtgagtttgttgagaagggggggtcatacctgagaagaactgttatccttgaaagacaaaataaatatcaaaactgcagtggaaagaaatggatatgtgcaatcagcgtgggagaaagaatacatagtacaaatggaatacatagtgaaacattaaaaaaagaaagtaatttgtagagtttaaactatatagtgtcaagtgttatactgtgtgtttagaggtattgtgttaacacttgtactctaacatgtggatcatatttgtgatatgtctttctacatgacatcctgcagatggcagacatggtaaccaaaagtcaaggtagataaaaagtatttttactcacctagttgtat

SEQ ID NO: 46302 - DNA, 704 bp, Oryza sativa
cgataactaacaaagcacctgtaagcataacaccttgagtaagtcatgtacaatttacctcgattcatctttggtgctgcgttatacgtacattaaaatttaaaagtatccttctgagcagactgataaactaagcaaaaacataaaagataagatcgtatttcttgtaagatactgaacttttgcttcaaaagtaaaaaaaaacgaaaagtagtatttagttagtcggtatgagagatgacacccatgaggagcagccaagcaaaccataagggcaggaagtgtagtttactatagaggaatagacaaacgcacaataatcgaacaatctaacatgcgagttggttttacttaaaaacaatggcgcgacgtgagaaattgttggatgtcttttaccggagaggatgccgatgtggaagctgcggcagcggaagaggttgccagcggcgccgatctcccgcagcgcgcgcaagacaggttggagggggccagacagaagggcgttccaaatagcatcaatctcttcctgcccctgcccagcgggatccaaatccacgagaggaaaaaacttctcatcttcctctttcaattcctttgcccaccaaggtagtgggggcaaggcttgcgatgcgggagaggcagatgcggcggcgcaagacagcttcaaaccaacgactccattgccacgcttgctgcatcgaaga

SEQ ID NO: 46303 - DNA, 1176 bp, Oryza sativa
gtggcgccggcacaccgaggccgtcgccgccgtccgcgacatggtgatgtacatggagcggacgttcattgtgacgtaccggaaggtgtcggtccaggagctcggcgtgaagctctggcgcgacggcgtggtctgctccggcgacgtcatgccgaggctggtcgaggcggtgcggcgcgagcgggcggccgccgccgagcctggcgagctgatggccggtgtggccgagatgctgacgaagcttcgcgacaaagtgttaagccaggtcatggacgcgtcgtctgtcgacgactatagtagcgccagtttggagaagtctgtatcagagtatcagtagaggacactttaacctttagtttcatcacgtcagattaatttctttttttgttaggtacgatatattctgtgttggttaagtacttcagttgaatctctttttggttataggaacatcggtttaatctttttggttaagtatatacacttcagtttaagctctactttcaactactaccaccatagaagagtttcggtagttgtaaacatatatgctctgtttgttgattcagagttgtttgttgtggttctgaaagtccgaacgcaccacaaaattggcattattgtgatgcataattctcgttcgatcactccaaatttttttcccattccattgcatagcacaaagtggcgctaagattgaactataatacagtactatacacaacttctcgcaccccgctatatttaatgaaatagcacagtcttgtgctgattccattaaaaaaaaattctcccacactctcatctagtaaaaagttattatatcggctgggcaagcataatcaacaagttaaaaaagtggacgcttcaggactgaaaaaaaaagcatccatgattccaccatgtgggatgtttttttttttggttgtctatatatcttgtgacagaaaatcccacctcctatcattcgaattttggaccactggatacgctttaagattcgtgcagaccccctaaccctaactcctctcatcccccgtttagaacgccgccaccactcctatcctcgcgccgtcgcgcgattccaccgccaccaccactgccccaccgcgccgccgcctgcctcgccgactggccggaaagagtcaacggcgccggcaagccccctccccctct

SEQ ID NO: 46304 - DNA, 9482 bp, Oryza sativa
tttccactcgggaatcggtaggggttgcagcagaccagctggcctttgatgttctgccttgactctttggcaaacgtcacacagggctacgtattctgcgacatctcgcttcattccagtccaccagaagtatgccttgatatcttggtacatcttcgtacttcctggatgaatggaataggcggactcatgagcttcctttaggatgagatctcttaactccttcttggccggtacacagatgcgtggaccgcaccaaactgtgccttggttgtctatggagaaattggtgtctttcttctcctgtattctttttattaattcttttatcccttcgtcgtctttctgagcctcccggatttgcgactctagggtaggctgtactgtcaaactggcagggacacctggctgtaccatggtcagccttaacttctccaattctctgcacaggtgatcttggtcaggccgtatttgagctacattgcaataggccttgcgacttagcgcatcagcgaccacgttggctttaccagggtgatagtggattctaagatcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgccttgatgcatcacagaagatcttgaaatcttttcggatatctggcaaggtgagaactggggcagtggtcaaccttttcttcatttcttggaagctgtcttcacaggctgcagaccattgaaatttcttttccttctttaacagctcggtcataggtctggttagcttagagaatccttcaatgaatcttcgataatatctagctaagccgaggaagctgcgaatctctgacacattcttgggcgggttccaagcaagtacagcttcaaccttgctgggatctacttcgacaccattggaggaaatcacgtgtccaagaaatgctactcggtctaaccagaattcgcatttcgagaattttgcgaatagttgatgatccctgagcttttccattatcaacctcaggtgttcagcatgttcttcctcgttcttggagtatattaggatgtcatcgatgaataccacgacaaactggtccaggtattccatgaagattttgttcattaagttcatgaagaatgctggagcattggtgagtccgaaggacattactgtgaactcatatagaccataacgcgttgagaaagcggtctttgggatatcttcagatctgattttcagttggtggtaacctgacctcaagtcaatttttgagaaaactcttgctcctttaagttggtcgaacaaatcgtcaatccgtggcaacgggtacttgttctttatagttacttcattcagggctctatagtcgattaccattctctcagagccatcctttttcttaaccaggagcactggggctccccaaggggatgagctaggtcgcacataacctttactctctaattcttcgatttgtcttttaacttctgctaactcattagctgccattcggtagggtctttttgcaattggtgcggtgcctggcgccagttctatggcgaactcaatctctcggtctggtggcattcttgttaattcttccggaaatacgtcgggatattcacaaactatgggcaccgactccaaggaggtgacttgtaaacaggttaagatagaccgacttgcggtaggagtgttaggggtaaagcggacttgcttttccccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgttaattttgggttttccaaccatttcttttcacaaaagcttgtgatatgaaagaatgggaagctcccgaatcaaacagaactattgcgggtacggagttgacagagaacatacccatcacaacgtctggagcatcctgagcggtttcagcttgaatgtgattcacacggcctcgaccaaagtggttggaagcacgtgaaccttgtccacttgcctgagtgctaggacgagactgagctgccgctggagtaggagttctggcagtgctgccattagcatgccctgagttggtgttggtaggattctgagggcactgtctagcatagtgacccatctggttgcaccggaaacactgaattgctgacggtccctgtggtgacttgaaagaggtaacactgtttggcgcagtattgccactaggggcacgctgctgtggctggggtgccgggcggttcatctgaggacgaggggcgtagcctggctggcggttagcctgagtgaccgactggtggtattgcatgggttgaccgtagcgagggcgaggtgcgcctcgggaggaattcccttggtggttagatttgcgtttcttgtattcttcggtagcctcttttctggcatcctcaagtagaagtgccttgttgatcatatgttgaaaagtggggaagtcatgtgctagcaactggagtctcattccaactgcgattcctttcaagaatttcctgatcttcttcttatctgagtccacttcctcaggggcgtaccgagccaacttgttgaacatacttaggtactcattgacactgctgttgccttgcttaagtctattgaattcctctttcttcatgtcaatggtgctttcaggcacatgagctgcacggaaagccgtggcaaactcatcccaagcaatgctagtgggttcagggtgtgcattgcagtaattctcccaccaatctgcagcaggtcctcttagctggtgagaggcgtagagcgtcttctcgactggagtacactgcactaagttgagttttctatcaacatctttcaaccaatcgtcagcctcgacgggctcgacggtctgagagaactctggcggacgtgacctcagaaaatccgtcagcttggatctattgttgcccatgtgagggtggccatttccatgagcattatgctgataaccggctacggctgcggctattccttgcaagatttgtgtctgaactgccattaagtgttgcatgttgttttccacatgaggtggggaagggaggcgttcttctccagaattgtgactggcagtgcggtgagagcggtgagactgttccatctctgcatcacgggaagctgtgcgatgcgagcggttgctacggcggggttgctcaacttctgcgttgcgggaaacagtacggtgcgaacggttgctgcggtgagactgctcattagctgattcatgatttgcttctggttcggctctaccttcttcaaaaccgaagcgggctggcgcacgagctgcacggcgggggcggctagccatctaaactcccagaagagggcggggtaagagtcagataagcacttagggggggcaaggagcaaagtaaatagcaactcatatagcacgcactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctaacacacgaacggctgctgaagactgcctcctctactcctcgtcggccgggctgcctcctgtagtcggctcctccgtcgaagaaacgtcgatcggctgacgcgaagggaccggcggaacctgtcgagggccggcagcagcgcgggccgctggcggtgggggagctgggtggtggaaacggaacacggtggaagaaccaacaacacgcttccgcgcagtgcggataaagcgtggaccacggcgggaggaagcaactggggtgtgtccgggggtgtaggaagggctaactgggtgtgggtagggggagtacactggtgagtacggcgcacgcgagctgggggagcgcgggccactgggagtgcaggcagagccgcgggagctgtgggaggacaggtggctggcgtggcagaggcggcctgagtcccaggagatagtgtcaactgaggtgacaccctcctcggccagacgggcctccaaagcggtgtagcagcgggccagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggaaaggtcctggtacgcgatctggagagtgggcctggccacggtgaagtggtgggggcgaaggccagctccgtgtataccttcacgagggtagaggtacacggagagctcacagtgagggggaacacggtccacggagtaccccgtgtactcgggacacgagaagccaaggaaacaggcgaggtcacgaagctgagcgacgtggtgaccctcactaaaaccgtgggaactgaagctggcgttcactgccatctacaattttgaaagagggagaaagatcagtaaccattttagaaacaaactattgaaaataaagaaagcagaagaaaccttagcttttcgcaagtagttttgaacttagtatccttagggtcgtcctaagcgtcgggtttcgccctagggccaagcctgtgctctgataccatctcttgtcacgccccgaactagtaccgaccggaactagcccgtgacgctccaaattaacctgttaatcgataccagtcccaggaaacagtgctggtatcacaggaagacggattatcacagctacagaagtctctttattatagagtagaggtagagtcatgttgggctgcggacagatcccgagctcacaactgcattacaaaagggaaacggaagccaggacttggaccaaacaacacaggcgcgacttgggaactaggccgaaaccctaaaattcatcgtaaccggcttgctcctggaagaactcctcatcagcaggatccgcttcatcttcttcagcaactgcgggggggttatttatatagagcaagggtgagtacgggagtactcagcaagccataggaaataagtgtttaatgcaggcttcaaagaaaggctgttgtttttgcaatttattttatttgagctcttttctaaaaacaactaagtgagtgcttctcaaacgacacggatgagacagtgctactcgtccggtcggagtatgtgcaatgtatcaatctttagatcttaaaacaaggttggcacccggccaacagcttttcaaacggccacccgggccaacaacttttcaaacggccacctgggcctagctgatcccgtcagctgctgatttttcaaacatcgaaccccttttcaccacagtaatttcacaagcagttgtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggcttaccatatgccgacgagaggggtcccagaccaacaacaggttaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgttcagatgaaattccaaggaaacggtccttaggtgcaagagcgggaaaccgtacacccggtaggttccccggtccgcggttttggaaattcatttagttcgcaagcaccgacccaggtgtcgggttttccaagtcttttgtaaaacccaagttttacccaagttgtttctcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaattttaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaaacggacttacggtttggaagatattgaatttctaagattattggatttttggtctaaaggaaaaaggatttaattaaatcctttttggaaaagaaaagaaaaaaaaagggagagggagggaatatagactttcctcgggcggctagggcgtggcccgagaggaatggggtggtccggccgagctaattgggccgaccggcccaagacggcccaagacgcgcgtacgcgcgggagggaggagagagagagccggtggaccgggctcaccacgcgcggtcccgggtgggacccgcttgtcagcggctcggctcaccgtgcggagggagcacgcggcgcggcgctagggtggaggatggacgtggtgcacgcacgcggttcgcggaggacgcaggtgcggcgggcccacgcgcagcctcacggctcgcggtggaacgcgcgcacggggagggactgaccggggtcggcccgtcccgacctcggctgagctggcgccgacgtggcgcctacgtggctgccacgtgggctggcgggaggtagacgacgacgccggccggaacggacggcggacaacagcggcgagcggcggagcgaaccacggcgatacgggcaaaagcgagcacaccgggcggttgttcgtgatgaggggagacgaaccaacggctcggatttgccgggggttgctagacggcggcggattgcggcggcggcaaccggcggcgggagaagggggaaacggcgacgaggtcactaggggctgattcccggcggcgagagcatctacgcggttacgggaatccgatgctagcgtcggatttggcggaactacgctgagcgaggccggcgacgagcggcgcttccgagctcgggcggcgacggcggcgagcactcggcgagcgacggcaacggtcggggcagcgccggctaacttcggggaggctactcgagctactaccgaaaactaaggggggggagatggagcgaggaggaagaacggagtgaggcactaccgtgcgggacgggcgcggtgacgagaggccgacggcgcgggagtgatctctccggcctcgggccgaggaagaggaagaagagggtgtgcccggagtccccttgcgcgtccacgaacgcaccggctctcccggcgcttggcgatggacggcggaggcgagacagggcacgggagcggcggcaatggcgaggaggcgaatgggagaggaaggaagggggaggctgggggtttagatgggcggcaatgtcggtttgggaaccgacttgcgtggtcaagggcgcgagctggcgctcggcggtcgcggccaaagcggcgacagggaggatgacgccggcgaggaggaaaaaggggaaaggagggggagaaaggggcttgcccttttgccgattcggaaaaaaggaggaggggagcgggggcgacgtggcagagggaggggggcgctgcctccgtcccttggcggcttgcgcgcggagtggcgggggccgggcggtcggccactcggcacgcgcgcgcggcttgcaacgggaggcgatgacggcgggcggtttggagcggcgcgacgacacgggcgacagacgcgtgcagaggctgacggcggcggcgaccgggcggtcggccactcggcacgcgcgcgcggcttgcaacgggaggcgcggcggatggagtggcgcggctcgggcgcgggcggctcacgcgcacgcgaacacggcgcgcgggaagcggcagcggggaagcggggagaagggctcggctcggcgcgggcggcgcacgcgcgcgggcagagcggaggggcgcagggcgcggctctcgcgcttgcgcgcggcacgcgagggaggggcactcggcgcggcgacgcgcgctcgcgcgcgcggcgcggggcggagcggagggagagagggagagagagagcgggagcgcgccgggggagagagcgagagagagagagagagggggggatcagggagagaggggagagagaggggaaagggctgggggagaggggaagatgggccgagagaaaatcggcccatcgaccccgggggaggcaaactagacttttgcggagggatttgatttggaaggatttggattcggaattgaactcgacgatagatcggggattgagatcttgagatggcacggacactaggcaacaagcaaagaaacaggtttcgcaattagggtttttaggagataattttcccgctaggcgccacgacggaacgggtgctacatcaacgtagaagttgaccttaacgggcgtttgtgaaatgtcatgtaacaacatgtgttggggagggcgagccggttaagctgagcggagtgagccgggagttgcaaaagatcaagcgagccgacgtggagcgcggcattggaatattggattggtaaagtctccacgcgtcatgctcatccatctataccagagctgcacagcacatgggcgtgggtttgcacccggatccacaccaaccctgcattaacttaacgcctacggaagtggtattttgggcttctggcacacacactgtgccacgcatagtacacacgcccagaacctgttccccacgacagtagactaggcatatgcatcgctgggctatataaaggaccttaggtgtgtttagttcacgccaaaattagaagtttgattgaaattggaacgatgtg

SEQ ID NO: 46305 - DNA, 1993 bp, Oryza sativa
tgcggtatctacctattagtggatcgtggatggtattttgttttaaaaattgaattaattgactgctcgtgtataactaatccctgaagaatcggtctgtacgcaggtagtgggcggtgaggaatggtatttaaatcatcaaaccacatactgcttcatttgttcagggctgcaggaacttggtttggacctccgtagtccagctcgaggatacgccgccgcgcggcggtgctgatttaggatggataaacaagtgaagaaccacagaccttctgatggtacggatggatcaaggtatgttgttctgtttcagtgatttatttcagtatgtgccgctggttttttttctctgaatttcgccgtgtgaacttgagcaattctaaatcatcaattcagggaaattcttatggacgagcgcaaccctaccatggacatagtagatggtattagtcaatctgtccatgattcacaaccggatggtggtcagtcaaggttggatcgtagcttccgtgaatttaaaactctgtaaatggtagccagatactgacacatcttgattgtgttatgaagccgtgtagcaatggaggaggacgtgccgtcgcgggttggatcacatgattcagggcatggaattccagagacaaggtatgtgcatggctaggtgtcagctgagcattcactttaaagcagtatatactacatagaaatgttcagtatgtgtcacatgagaaagttcagtatatgctatcttctaggaaagttcagtatgtatcacatagaaaagttcagtatgtgctatattgcagaggagttcagtatgttgcacagaaaattcagaacatactatatgctgtcgtataacaaagttcagtacatagcctcccatagaaaaattcagtatatatgtgaaaaattcagtaaatactggtgcgtatcaaagttcagactacgaatcactatggaaagatttagtatacgtgtggaaaatgcagtatatgctatcgtctagaaaaattcagtacgtaacccatagaaaaattcagtacatactatcattcaacataaatcagaaagaacccctccattttaaaaaatgagtatatacaatcatctaacaaagttcagaacaaagctccccatatttttttgttagtagtacaacatatattttttttaaatttgcagtaagtactgattataaattaggttgttttttgtaaactacattttcagttagtagtagtatatgctatttttaaatatagtgtctccaatacagaaatttggtcccttcactggattggacagaaggaaacccatatgaaaaagaaggagctgggataccgatggaaaggtttgtatcagcatgttacggatttttacgattttttttttagccaggatattggtggtattttctgaaaactgattgtacattttcttttcagaatggtggtagataatgttgatagcagtgctgtcatacctcctgagtatgctgatcctcaaattcttactccgatgctgggacaaagatttaagactgagagggatgcctataatttttataatgtttatgctgttagtaaaggatttgggatacgactggacaaagatcgcatgaatactaaaaagcagagaacaatgcggcaaatatgttgttctcaccaggtacatacattatgtaacaatatcttagtagcagaaatttacctaaataaagacttgacgtactatgtgttaatttcgaaatcttttatgcaggggaggaacccaaaaaccaagaagccttccgttcgaattgggtgcccagcaatgatgaagataaatatgtctggagctggtagtggctggtcagtaacaaaggttgtttctgcgcacaaccatcctatgaaaaaaagtgtaggagttactaagcattaccagtcgcacaatcaaatagatgaggggactcgtggtattattgaagagatggtagacagtagtatggggc

SEQ ID NO: 46306 - DNA, 703 bp, Oryza sativa
ttataatttggaatgaattcgttatactttacttattttaagtatatgatgggttattcattggatgcttattattgtcattaattttgcagacaattgtccttccatggcagctgccattagaacagtatttcccaatacaatccatcgtgtgtgcaagtggcatgtactgaagaaagcaaaggaatttatggggaacatatactccaagcgtcatacattcaagaaagtatttcataaggttcttacgcagacactaacagaggaggagtttgttgcggcttggcacaaactgattagagattataatctggaaaaaagtgttaacttgcgtcacatatgggacataaggcgtaaatgggcatttgatatttttcccataggttctttgctgggatgactactacacagagaagtgagtctgcaaaccatgtgtttaagatgtttgtgtcaccctctagctctatgaatggctttgttaagaggtacgaccggtttttcaatgagaagctgcaaaaagaggactcggaggaattccaaaccagtaatgtaagtatccactgtgataggtttgttgacctctttttatggatatgtgtaatcaacatttggtgtcgcttggtgcaggacaaggttgaaattaaaacaaggtcaccgatagagattcacgcatcccaagtatatactagggctgttttccggg

SEQ ID NO: 46307 - DNA, 1426 bp, Oryza sativa
accaattaaatttatcgccaaaacccaatattgccgatctatatgtgcacataagtacggacgtttagtaggtattaaaaaaaaggtacgtacatgtattccaagataaaaaagtacgtacgtatgtacataagaaggccgggttaacgacatatttttatcttctttttttctcactcggatagaaaaaccaaactgcccatattaactatgctctacttacgctgtaaaaatataggcacatgtcatcgaaacaccaatgaaaagcataaattaattaaagtatatattatgtaatagttaaattagacttgcattttttaaaataaaaacaattctaactgtgactagcaattctcaaaagttacctattccttacttaaaaaaataatgatatgtcaaaatgatatcactaaatttatcatgaatattctgttttctctattcgtataatatttaaatatcaaagattgtatatattattttcacaccgtactgatctcctttatcttctacttaggattcatttgatctagctggatggctgagcttattcaggatacatgaaaagacacatatcattagtgcaagattaattaaatattaaatataataaagccaaaatagatttatttaatttttaaacttttatataaaatatattttaataatacacaagttgcttttaaatatatacgatgtaggttatggttgtcaatttaattatagtgcataaaatggttcagatggatttagatattattatcaaaagatatgtcttttgtaataattcctatatcaatgggtagataactaggaaaacatgcttacgacaaacaaggagcaaccaatccgataattactctagaacttattgcttatttactaaaacgtttaatatgtagtatgtaatatactttatgaataaaaaatatcctaatatatcaatcatatgccaccaaggatccataagtacataagttttatctgtcaacatttgatgtcgcgattccggtatttgcataatatggggatcattggtactagggtatacgtgagactgaggtaaaaaagatggagacagagatttttatacaggttcaggcccctgaattgtcaggtaataaccctacatcctgttggccgaagccggtattgctcttattcaccataatcacaccagtacaatatttggggtagtctatctaactgttgtcgacatggtggtctgtagttctgactcgtagtcgacaacaggatagtcttccttctcgaattcatgcccgacgagatcagagatagcgctttcgtctctcctgacagtatccggagacaccgtaggggactagccatgcttatccctgaagttgatatccagcgtcttgtcttggcgtatgttggcttctgttgttccgtgtgtgttgat

SEQ ID NO: 46308 - DNA, 2338 bp, Oryza sativa
taatgatcctattccgtgatataagaaaatatgttgtcttctttctttctttgttttggatttttttttcataataattctgggtttactgtatattctagtgtagttttttataataattatgggtttactatataatctagagttatatgagtagcactgagtaggcgtatgatatttagttaaagaaaatgaatgcaaattcgttgttttggattttttttcttaataattttaggtttactatatattttagagttataggagtagtactgagtaggtgtggtatatttatagaaggcaaaggagtagaagttcgtgtggttggaaagggaagatagttttggaagcctctagaatctatatgtgatatttttctctatatttttccttacatatgattgttaggtgtttttttctttatgattttttcttcaaagtaagagacgccaagtgaaccaatcaaaagctagtaaaagagctagctttaccttctgcaatgtgtgagtctgtaagacctatctagtgttactgtattatttttttttcttttcttctttaccatctttacaagagggaggctagaggaggcaactgcaatgtgtgaatgtaagacctatctagtgttactgtgttattttttttcttttcttcttaccatctttacaagagggaggctattctttcttttcttttttttaaggggaggcaagacgccaaacgctatccagtgttactgtgttattttttttcttttcttctttacaagagggaggccaagacgccaaacctaccccaatttctattaatagaaatggtaagttgctataaagtttaactacagccgagtttagttctaaactttttcttcaaactttcaacttttccatcacatcaaaactttcctacacacataaactttcaacttttccgtcacattgttccaatttcaaccaaattttcaattttaacgtgaactaaacacaccctacaataaagaatagaaaacaccagacaggaggtcttttctgtgagagtggcgccacccatctagtgttagtacaaatatgcagtgctttgctgaagaagagcttgtaaagaattctgaaaaatttaaagtcggaatgacacaatgtggaggaatgttgtagcagagggaaaataaaaaaaaagagggaaaaaacatttgcaagttggtaggaattatagcactgtactaaatgaaaacaaacaggaccatgactactccctgttgtcaccgccgcccggccggccctcccccccccccccctctctctctccagggtattttggacacaaaaatctctaaaatggcatttcattcgataagcaatgtattgagtggcattttatccggttcattgtattgagtggcattttatccgaactcaccttagagagtagcgtatcgtcagttttctcgctgatatgttatacttccctcccctttcctttcggcttgtttggtaactcgagggaaagggattgggagtttagatgatgaaaataatggtgagattatgatgagaatttgatttttaattctaatatttttatttatgtcaggttattaatgaaaatagatggttgagatttgtttaagtagagttaatgaggaattctctcccaattaccacccctatccatgtattgaaaaggagaaaactcctttctcaattccccatcccatcctaccaaaattctcatgtctcccaactaaatagttaatatctccatccctctaaacttctaatcccttctaaaaactctccccaaccaaacggatcgtttatatacaccgcttctcccctttcgagcctttgaggtcccgatttctccatttgctgcacaggagaatatgtgcaagaactgaactattgtattctccctgcaatcgtcgatgcagaaattgttaaattcgacttgattggttctgcaatcgtcgatgcggaaattgttaaattcgattcgattggttatgcactcacatccatggataacaacctactatctctctctttttttttttgaagacaaacaacatgctcattgtccacatcccacaatctaatatattgacgtgcaatccttaacctgcttattatccacatcccacattctgatatattgacgtgcaatccttttacgcgttcgaaaaaaaaggggattgccatatatcattcgactgaaatatggggatgaaatcttacagattttggaccattggatccatgccaagattcgtgcaccaccttctcttctccaactccgacgggctccccttcttctccggcgccggcgacaccccaactccagc

SEQ ID NO: 46309 - DNA, 1775 bp, Oryza sativa
caatcaggcacaaaaaaaaaaactatctgaacattaattcggtcttacacctaaaactaaggtttagggtttaagaaggatacaggaattaatcgaaaaaaacctgtagagctgctcgaagttgagcttttccatgtcttgagcgtagatgtcgcggattgcgtccgtcaccgcctgacacgagctggcggcgagggcagcgtccatcctcgtcctgcggaaggggagaggttggatctgcgagcgcgtcgtcatctcgtgccgtggccgcgccgccgctgcagaaaaacgtacgggtttcgatcgggggtcggtgtataaagtgtatttataccgtctcaaactatcctatttaatttgcctctcaattccaataccgagtagaaaacacccctggagaccggggagacctcagcttggttgggctgggccatccgtgagtggagaggccggcttgaccggctgcgtgtggctgcgccgctaaacgagccgaaccgggccgtttttgatgagaacgaggcgagacaagccgggtctgagtattcgcgagagcccaaccaagccgggtctcaggccttgtctggtgagcttgtcccagctgcagcttttcctaaaaactgtttctgttagaagctgtcccaaacagtcaacagcttctgagaatctgcagttatagattctaaaaaatgaagaagccagaagctgggtttcagagcttttccagattctcagaagctggctaccaaacagctgcttctcagaatttaaagctcccccaaacaggcccttagtattcgctcgttgacttgatgagatttgctccggtccacctcgagatacagatatctcacggtaccaaatcattttttattgcttggtataataatgtcaatcctgtctagctagattcaacaatcggaaacgatattgatgtgaggtatcgatacctcgagatactttttgttggaacggagcaaatcttggactttatatgttcttcagccatatgcaacagacaacaacatgttcatgctcccatcacatctcttctttcttaaagctaatgcccactacactcctaaagctcaatatacaaacatagtatttattagcactactaagacctacatgcaagcatgccgcatcacccaattaagctcacaaaactcaacatgcaaacacatagtaattatatctacaatttattttattttaaaactaaacatacatatgctaaattatcattctcaaatcattttcataatatttcaatgcaaatcatttatcatttctccattatctaacatatatcccgcagaaaaacgcggggcatcaactagtatgaggttaggggtggagccagccaaaaataacgctgggttcactgaaaaaaaaaataactctaaaatttgggaatgaaatcttatatattttgtatcacaagtagaagtgaaatagtgttgaatgtagttttcacggacgtgcaacattgacctgttccatcctgctgagttagcatgtgatgcccacgtatcattatctccttctttcccttcttccttcctcccttctctctatctctctctctattcggcccttcctccccggccggcttctcccaagctaggggcacacctactccagcgccaccctgctcactaccacggcctacgtcgacatcattgagccaatgcaagctatctccagtcacggtcgtcgttgagacgttgactcttcgctcgcggcctcctgctctagcaccaccccactcgacg

SEQ ID NO: 46310 - DNA, 1571 bp, Oryza sativa
  unsure (1)..(1571): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtggagtggaattgaactggcatgtttgataggtctgtttaagtttcagcaatcaagtcaaatgtcagctactggcatttggaagagttggaaactatgctactgttcaaattcaaacagggatggtggctcgccggttcgttcaaaaaaaaattcaaacaaggcaatattcggattagcataccctgtattcaatttcctcctctgtataccaatttggtgtgtcccagaaattgtatggttcattaggctgtccccagcgagctatacaaactggctgatccacaatagtagccccctgtaatgatgcaaagtgacatcaaatgaacaatagagaaagttggtgtttgacaatgtaaaagagatatgatgacatattagtaatctaagtagttccaagagcagattagtaatctaagtagttccaagagagtatgtgggcatatggtagcttcctaagtgactgaatttggaatatatcaaattgaaagagcctctgatacctaaaatcgttttttccaactgacacctaaaatagtgaacagtggacatattatatactccctccgtcccctaatataagggattttaatattttgcttgcattgtttgaccactcttcttattcaaaaaaattgtgcaaatataaaaaacgaaaaatttgtgcttaaagtactttggataataaagtaagtcacaaaaaaaaataatttcaaatttttttgaataagacgaatgccaaacaatgcaagtaaaatgtcaaaatcccttatattaggggacggagggagtacttgatactgaaaatagaagtactgttttcactatttgtttagtggtaacagttataaatttccaggatttcaccattgtgaaaccagagttcaaccgcatagttgagagcggaatatggtagtccaggaccgtgatcagtgatcatttgtgtaaatagatttaagatggataagtgtagaactcaaaaggaagaattaaagaatttatagttaggtaggaaagaattagtgataggaatcagacacgcattgaaaaaaaaattgatccaggcatctgctttgaaagatactgctaccaaaaaaacttacactgagcaatactgcagtttccaaggaatagggttccttgaatgtcacataagcagtagaaccatattctcctgatctgttgaaaattgttaaattcgtcataaaatgataagatggatgatgagaggatccatacatccaaataagctgaattcttaaattgctaaatcaggttacagttaaagggctgcagg

SEQ ID NO: 46311 - DNA, 2659 bp, Oryza sativa
  unsure (1)..(2659): unsure at all n locations
attcctgcagcccatatatatatatatatatatatatatatatatataaatataagttggtcaaatgattttaaagaagttaaatcgtcttataataaaatgaagggactaataaataaagtctcaaaagataacataatttacacaaaaattttgtctaacagattgaaagtaagtttgaagtgggatttttcacggcacgcaaaatgaacaaaccattagagtgtgattaacggtgtgtttatcactaacttaaaaattagattatttgattttttttaagaaaaacttccatataaaaagcttttaaaagtacaccttttagaagtttaaaaagcatcctactttaaaacttaccacccataactcactaccgaatccgcaacctaaatggctaaatctctgtttggatttcaggagaaaaatgtggataattttaaggtaaacatggttgtcacgtgaagctttacaaaaatgagtcatcgttaaggtctgcctttgtttgacacaagagtccggttttaaccgataagagatcaaaacaacctctaatacttgctatgtgaagatttacaaagagttatagtagatcatcacgctctgcctttgtttaacatatatatgtgtccagttttaacaggttagagataaaaaaaaccctaatgaagaacatatcacaatatcaaactcccaaaaagaaaaaaaaacagaagaaaagaaaaagaaagccacccccggacggaaaacgaagatccaaatatagagcaggcccgtataatcagaaggaaaccaaaaaagaaaaaaaataggagaattaaacgagcaagatatatcgtcgacgaggcccatcgcgtgcgcttcccctcccctctcgcctccccaaattcgcgttcgccaccgtcgcgtcccccctcgcctctgcctcgccggaaccctagggagatcgccggagcacggcgctggctcacgggcggcggcggagatgaactcgcagaagaagcgcagccccaagatcgagcccttccggcaccgcgtggatgcggacccaaagtccttcgacaaatcgtggaagaagctcgaggacgccatccgcgagatttacaaccacaacgccagcggcctctccttcgaggagctgtacaggttgatagatctacgccgcatcccctgccctgatttttttctgttttatgctaggttgattttggcgcggcgtcccatgtggggggcgggggatacggggaatcgagttttgtatgaaacgccagctcgattagtagatttagtttctcacactgtcatcgttggagtcatttttttttccttaggttttgctgtatgatcatctatgtatatagattggatattaggcgatgtgcagggagtttcaaacgattttaatcgatcggatatatgctacatgcatgcctattaggtagttctgtgtatgctacatgcatgcctacatgcagtacatatgtcggaatttgcaaccctagttcatgatttgcatccattgtacagtagagaaaaggaattcccttatttatgatcgataatagtggttctctggaaattgtaacgctttggggtcatgggctgtggtgtagtgatattatccgacatatgtactgcacagtgcacatgccgtctatttcatgaaggccacatctatgtattaccctatggtaggattttgttccctctcttaagcttcaatggattcgaaattttctttaagcctgaaatattgaatataagtcggtcatatctgctttgctcctatgatgtttctagaatagtgctggataattttgtctcctcataagttattctgggttggaagtttgataccctttgcatatgcccttttaatcaatatgatattttatagcttaaaggtaatctatttactctctactagtgagcatgctggttaatcattatttcaaaacatatttcattgttttctatatgctacatttcatcgtggtgttgtacgcatatgtgtccttatcttaacaaacactatcttacctggttttaaccatcataatctacccatttattattgtgtaactacttagcaagtagaaataatagtaaccactagaaaaggaaaaatttgctatacttaataatgtttcatattctaaagattttcccactctgctaaagattttccctgccaaaatatagtattattgtagatttattaattcattagttttggttgagataagacatagtgaggtcctttcttttgagagtttggtgtatatattcaaggaacttgatcttcctggcagtgcattgtagtgctctctttacctgcgtaagttacagctgataaaaatatcccttctttgtttggtcctcttcattttattagacaccaaagaccaaagatagaaattagctgataagcacctttcatgcattgctcttgttggccttttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46312 - DNA, 68582 bp, Oryza sativa
  unsure (1)..(68582): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactgaatagaaacactgttcatgatcaaaactttgaataaacaaagaaccatgtaaaagatcagataatcttcagggtcagggcagatagtagatcagattattgcgataaagttgtcgaaaatgtggttaatcatgaaaatttcttgcagttacagatggttttagagaattgttcagacttaccaattccttggcagtaaggttcctctgcaaagctttaacatcaccttgaaatccagatgaggccaaaacacatttatccgctctaattgaaggtttagggaaacggcattagcactttattcagaaaaaaaaagagagagagctttccaacaaatatgttatgcgcagctgcgtcgtgattatttggtagcaatattttaagggatagtttgcagaagttactataggaaagtttgtgcactgaaacagaggatttgggctgaaccttcatccaacgatacattcagattcaatttactcctcacgtataatttcgggtgcagaaaatcaacatcagtaatactacccaataaattcatgcgcactccacaaaatttcagctaggcctattttatttttttcaaattcacaacatatgcagtctcttcccttcccttctaaaaagaaaacatgtgaaatctctgtctctctggtaattaaaaaccacaaattcatccctagcaacgcatccatgattgactaactgactaactaacaaactaactataagcgggggattaatcagaatcgccgaatccaaccgagtccaattcgcaaatcggaccacacatcatcaaacgtgagtaggtaggtaggaaggagggtttggaaaacatacaggtgggcgatcttggagctgtcgcggctgaggatgctgtatccgacggagaggcgcgtgtcggcggcgaccacgcagtagtcggcgccggcgacggccacgcacgtgccgccgttgttctcgtacacctcgaacctcgccatcgatctctctccctcgctctcgctcctcctccttctcccgccgcctcagctccctcaccaacctcaaacctcggcgtctctctctctccctcaggctggcgcggcgcggtggcgcggtgcgttgcggcgaggcggacgggcggcgagtgcggcggcgatcgggcggggcggggcggcgcggcgtcgcggggaggctagttttatttcggctcggcttcttcttcttcttcttcttgtgctgcaagaagagggagaccggctcggaggttgcttcgccagtgggccgagtccgagtcgcggaagaagctaagagaggctcggtccggcccggaacggcccgtcttggagttggctggaaaactgggggccgtaagagatgtttgggcttaaaagcccggcctacaattgggccggtttatatgctcttcatcggcctaggggaagctagcttagcccatggccatagatgaacgtttttgcttgtttgtttttactcttttaacattaaccgattttgctatcgatcactagcgtgatttttttttgctgacatttcacgttttttttgcagcctcgtcagctggcgtgtcggacaccagcacgtcagccttcgtgtctgtgtctagctagcccaagcgcacacgataatggagattggagaagcacggtaacacagtggcctctgaccggcgagccagccgccggtagcacggccaatactgatcagcgagagacaccgttcctctcgtcatagtcatgaaatataaaattacagtcctatataactaaaattacatttgtaaatttagttgatttgataggtaagtgtactgtaattttgataaaaaataatgtgtaagtaaatatgtacttattattttctttaaaatataaaattacagtcctatataactaaaattacatttgtaaatttagttgatttaacatgtaagtgcattgtaattttgataataataatatgtaagtaaatatgtacttattattttctttaaaatataaaattacagtcttatataactaaaattacatttgtaaatttagttgcactgtaattttgataataatattgtgtaaataaatttgcattagttattttatttcaaatataaaattacagtcctatataactaaaattacatatgtaaatttcgttgatatgacatataagtgcactgtaattttgaaaaaaatgttgtgtaagtaaatttgtattagttattttattttgtaattcgttggatgcaaatccaaggaaagaaaaaatctgggtgattttatctcaaaaatcacccgagtgatgcataggcggtcccaacattaacattttattatctcggttttcattagcatactctttaaactgctaaacgatgtatttcatgcgaaaattttctatacataagatactttaaaatattagataattcaatttcatgtttaaaataattaaaactcaactaactatacggtaatgactttcccttatgtgcccatagttcatctttatctgacatgaattcgaatggggctaagttactaaagtttaatagtagtagtagcttattgataccattcgtgtaagttgcaagattaatatagtcccactttcctagggcaaagacaatataaggtcccttattagttgtatcgttttgggacaattaaattttgcaagaatttcacatgaaaaccttgatttttttttggtatgtacgatatgaagtttagattggataacccagattaatctgagagcctcatcggttgcctgtattacctaataagccaaaacagtttactaggaaataaaaattaatttataggtaatttttttaatatatttgttcataacgatttaaaagtcaatgctaaaaatagtttgcattgaaaacatcttaaaatcaacttcagaattaagtttgaaaattcaaattttaatttttgctttggcttattatgccaaccgatgaggctctgaaataggggcttttaactatttgccacttttagatttggcaaaaaactacttgtcacccctatctcaatgacatgtgggtccacatgtgtctatgacatgtgggcacagtggcaaaaagttaattgctgcatctaaatgtggcaaaaagttaattgctgcatctaaatgtggcaaatggttaaatatctcctgaaatacgtgcaactcagtgaattttatgtaaaccagctgggatgttttcatttgatcagccaaggcgtccaccttggtacgcacacagcgatcattttcttttctaaagtgtatatgactctatgagcaactgggttgaggtccgcgtcacatcgagtgggcagaacggtggaacagctcagctcccctgcagccaaaaacaaattcagttcaccagcaaaagaacacctgggtttaaacaactccgttctttaacgtcaaaggagatttactagtctatttctcgagccatgacgccaactgctttcttttgctttagttgccaggttttaatcttgtccgtgaatggaaagatcaaagtttgtgctaaatttggtttagaggagccaccactgttaagttagtgcgctgacctacctgcaggctagctcctctttaaaattctctccctttttcattgccatccaacatgttttgatcagacttctcttgtttcaggatgaaaagattgtttgccaaagcagtagccgtctatatatgtgctagcttacttgtttccgttcatcttttcattcttttcgcttcacagaatctctgagttgagtctcattgtaaagtcaccatgcttcatactagtttatagccctcattttaaaaaaaatctcttggtatggtaaaaaacagctagagccgttgtttgcatcttgtctttctctctctgttctttttttaaatctcccatggcggcctagttgcaatttccttttttctttcacttttcacagcttatgtcaaaaccattagcaacagaggtagtaggagcttgcaaatggcagatgaactaaatgatcagaattcagagcataaattcttgcgtgtgggatcaaatttttcttcaggtggatgctcggatatgttggggtagtagtactagtttctttggagtttgtaggacaagttgatcgaagccactcatcaatggtaagcatgtgctgatctgctctcggatagtggagttctgacgcaggaaaacatattcgtagggctattttgaaacgtaggaaaaaaacatataagaataggaaaattgtagaaataaaataattcacggctcatttaatactactggaggtgaattcacaagtatttgtaaaaaatgttgttacctagcactacatgaaaacataggaattttaagagaaaacatgtggtcatgtctctttctaatttttttttaaagataagcctcgaaagagcacagagagcacatgtttttattcaagaataaaatgttttgtctagtttttagggaaaattgggcccaaaaatctcacgtctgacgtctctttctaattttcctttaaaatacttatgaaattagctatcccatagaaatttcaaaatattttgtggaggtcatttcttcgttttaaaggggcatgtagaaattatttccaatggatttcaatcctccaaaatccctccattttttcccatgttcccaagcagccaacattctctcaaatgctacaatgaaatcaacatcgcagttctgaacatcaatgcgtccgtgcgtgcgtctctgtcgttcacgtttcccaggttaactattaccaacctcccgacttcgattcgatcactccctgtctctgtagcactaatgcgaaaatgctaagcttagctttgtcagatcagaatcaaattcgcatgtaaatatgtgagttcaatccgatcgctcaccgtgtctctaccacaagtgcgaaatgctttgctagcttgtcagatcagaatcaaattcgcacgtaatatattcaggtctacgtcgagcgtaatcaatcgaactatcggtctagcgcagcgcttgtttgtcgttccctgggttgaaggtgtcgtttcaagctttttgaatgaaaaatctagctctggctgcattacattcaccggatcttcataaatgtgttgtttaagagtagtcttagacttggtgtactcgtcctggatgtacgagagtgagctgccgcgagtgatttgcatctttgtgttagcttctttttctctctctttttgcgcatgatagatgcagagcagcagaggcacggtgtaaatttatcttttaattgaaatatatcctacgattaaaaaatctattaattgatttgtacttgcatcatccccttcttgcatccattcatttcacctaaataattatatatttttataaaaaaataacaagataaatttatatgatatatatcacttcacagatactcttgaacaaattctttaagttataacaaatataactgtggatatgtatactagtttcagtttattttattccttttattacaacttacatattttaaacttacatatttatggagcggtatgtataatattaatctattttatcaatttattttttatgaccatggcataaaaaaataagtggatgtcctgttgaggatgaaattccatctccaacgcattgcttatatatatgagatgttttacggtgtttgcgaggtacatagaggtacttggagggggaacaacgtgcaccgttgatcaagagaggggcaaggtacggaacaaattttgtaacatgatggcagttgagtaattaacttgtaaaacatgggcattatactttaattgaatactaaaatccatcgatcggtatgccatcagaaaaaagagtaaatctaacatccatcgatcggtatgccataaaaaaagagtaaatcacggatatccgatcgatctataccagatcgcatcgtcttctttccctgctttgttcttgttctagggtttgaacgtttcaccgaaaggagacagggttcaccaaaaggagacaagagggaaaaatgtaggcatggttgagggttgaataggagactagatcgcctggtcgacgactagctaggctcaaactagcgcaatataacaatataacacaatataaatctcttgctggaaataaaatataattttcaacagaattaaggtaggagtttttacgtattcattggaataaaatgtaaatgtagaaaaaatcacataattaggccaataatgtgttataagaacacaatataaatctagacttcaatacaacgtaaatttacaaaaaaaccatgcaaaatggaaaattaaatcctagtgccgcggtaaacgacttaactccaatacaacgtaaatctacaagaaaccacgcaaaacaaaaaattaaatcatgcagatagaggttttacggtgttaacgcgtaccgttatacctatgcggtaccttttataatttgagagacgattctacccttttctctctactagtaaaattatgtttttatccttagtacctaagtacctatatcaatacttaaatatctttaacatggtacctgtgattgaggagcgttggatctttacctcttttggaatgcaaacaccataaaacctctctatatatattcagctagaaatctgtaccagtgtgcaccaccattcattcgagtagaggtggaaaaaaaaactcgaagcttgtgacttggatcaattcaaactcatagtcttaatgagtcgatccgagctccgtttagctcgtgagcttaatgagctagcttgaactactcaagcttgagtttagctcgtttgtaaatgatatcatcatatctttgtatacttagtgcttgttaactagtccttcatttttttaattacatcaaaactatttgtatttagtgagtttaatgtttattatgttaatatattacaaaatcataattttgaaattattaacatgatataaatgagatagagctcgttaaccaggctaacgagcttaacgagccatctcgcaagtcaagccgagctagcctcttagctccgaggaattttgcgattcctcgaggtacttaaattttacactattacttttagtatcttaaggtacttactatctatactatctagaggtatcgaattttacacgtatctctgtaaaaattacctttcagctcatcaaaattaacaaactgagacgaactagctcattaaaataactgagttcaaacgagccaagctggcctaaattccatggtaaaagctattagctagcaatgtctccaccacgtcgatatcgatcgagtgcaccctccatttactaattacttccatattaaagctatcatcaatccatccaatatccatcgtgcactgacgaaaccagctgcattctgctcccagtaagaatcagaactcaattcctccacatatatgctctgcaaactgcaactctgcaactgcatccatcgattgatagatacatgcacatagctgcatctgcatttgtttgttcctgtcacctttgtaccatccaattccaaccccacatttcatcctcgatctttctggtttgccgagccaaacagagcaagcacagctagtagctagccaatattcagataagagagtggagtcaggaactcattagaagagacatctttaatttgctcatggccattgggacccaatcacccaacacatttgataattgatactccattttgattcctcttcttccccagctctagctatatataaaccactccaatggcagcacacaaattcatgaattcccagttcagagtttcaggtactctcaatctgaaacatatagaggagctagtagcaaagagaagtaattagagtgagcttaagtagtaattaattagaggaggttaattaattagggaagatgataggatggggagatgtgtacaaggtggtgggggcaatggcgccgctgtacttcgcgctggggctagggtacgggtcggtgaggtggtggaggttcttcacggcggagcagtgcgccgccatcaacaccatggtggtctacttctccatgcccttcttcaccttcgacttcgtcgtccgcaccgacccgttcgccatgaactaccgcgtcatcgccgccgacgcggtgtccaaggcgatcgccatcgccgccatggcggcgtgggcgcgcacgcgctgcggctgcgccgccgccaaggccggggcgcagtcgtggtccatcaccgggttctccctcgccgcgctcaacaacacgctcgtcgtcggcgtgccgctgctcgacgccatgtacgggaggtgggcgcaggacctcgtggtgcagatcgccgtcgtgcagtccatggtgtggttcccgctcctgctcatggcgttcgagctccgcaaggcctgggtcgtcggcggcggcggcggcgtcgggccggcggtgatgtcgtcgtcgtcgccgccggagaagcagagcgacgtcgagatgaacggcgccgtcgtcgcggcgccgggcggcggcggcggcgtccggctaccgttctgggcgacggcgaggacggtggggctgaagctggcgaggaacccgaacgtgtacgccagcgttctcggcgtcgtgtgggcgtgcatcgcgtacaggtatatacgcgtcagccatgcattgcatgcgccatcgccatcgccatcgccgtgaagtgaaactcaagtttctactagcttcttgacgtcgccgtcgccggtgaacatgcatgcaggtggcacctgagcttgccggggatcgtgacggggtcgctgcaggtgatgtccaggactggcacggggatgtccatgttcagcatgggtaagctagcatcggcataaagtttttctttttctgaatagccgaataattttgcgttataaagttggaaaataggtttaaagctgttgcaaaaatcgcaccatttaggaggccagttgcagggttcaaaatcccgataccagatcgaagtccactcacgggcggtttctttggatttcacataatccataaaaagggataaaaactgatgaaatccgaataaattttaccaaaagaattaaaacttagtttaatttttttaaaacttagatcgaaaaaccgagcggtatgtgttttcgacccagttcgaaaagttcagatttcacgtaattcgaactagattctactggatttatgtttgatgattcaagttgttagagaaatgttgttgcaataatggttgttgttgcatatgctgaataattgctgatggatatcatatgtagtgattggatatgatatatgatgagatgcagggttgttcatggggcagcaggagagggtgatagcgtgcggggcggggctgacggcgctggggatggcgctgcggttcgtcgccggtccgctcgccacgctcgtcggcgccgccgccctcggcctccgcggcgacgtcctgcacctcgccatcatacaggtacacctccttaattttgccttgtcgggaacacaaactgttcacgtcacatcgccggcgcttttcgccgtgtacttagatacatgcaggggaaagtgatttcgtgtacacaatttagcttgatagactaatataaaatataccactccacaaatatacaaattgaattttttttatttacaagttgtaaaaaaacaaatatagatgcggatgtacgataaatattttaagtttaatttgttttttttctaatttgtaaaagtcgaatttagtcttgtttgtcttgaaatgatatattttatattaatctatattattaatttttttataactatttagatgatatgaaaaaacaacgagatattttctcgacagtggtaatttagtttcgccttttgctttcactagtttatctcttctccgatctcaattaaataaactatatatatccggcttcctagagaaaacaaatgagctcgagaggtcggcagctagtgcatgctaactgcagatcacttcgatttgtcgcttttctgaaactcttgtttcgtgctaaccagtgagcaactaagcaacttggtgagtggtatatacgtacccaacttttcacattggggatgtgtatgtgtagtgcatcagcagcagtaaacgaactagctagtgtgccatgcatgcatggatacaccagataagtcacaagtatatatcgtggcttgcatttcaggagtttggaaattttcaaaaatcagtcatcactctcttcttgtccatatattggatgatattttcaatggttctcatctcccctgtattactaatttaaacaaagttaatcccttctttagataaaatgataaaaggttgaacaataaattattctaactgataaaaataatacaaaattacattttcttttactgtaatgcaaaattacatttataattcaatataacaccgagattccagataaattaaactaaaattgcacatcgcataacaatgcaattttaggctttagcaatgtgtaattgcaagcgacaaattttaacgcccctgaaatctaacaaatatgtaaggtgcttaaagttttaaaatttcagccacctttttcatctcttaaatgataatcctcatcactcctaagtcactactccttaaaagaggtttaatactcctacttctttgaacttttttaaaatgatgtaaactatttttttctttttcgaaatggcttgtgggttcatgacttcattctactccatatatatggtgaaatttaactgctagtgctaaaaagagaggtatttagaggttctatgcatacacacgcatgtataagacattagcatgcattccgatcttaattaatactgatcatgtaatcaattttcatgtacatatatgcaggccgcactgcctcaatcgattgcttccttcgttttcgcaaaggagtatgggcttcatgccgatgtactcagcacggcgtaagttaattaattttcattaatttagtatcaacctgatgattaattatgccgtacgagttttccttaactgcgttggattatagattaattacagtatcagtctgccgttgaagtactaataacttgattaatcactaacgaaaatctaattttgaatgcagggttatattcggaacattgatctctctgccgattctgattgcatattacgcggttctgggctttgtctaacatgcatttacagcacggcatgcttacttatattagatttgcttcggtccaacaaaaattatctcgagataccgatacctcacggtaccgataactcatctgctcagctagatccaacgatcgaaaataatttggtaccgtgaggtaccggtatttcgagatactttttgttggacgataacaaacctctaattacattggatgctgagatctaaaccaatgtggagcgtcaatgacgcaacagaaggatgttaattaatcagagtacttcagcaatagagagtttcagtgttgcaagctctgattaatgatctaatattccaattagtcgatattgtatttcgagcaaagtaaataataaagttttcaacagttttgctacctaatattactgtacgttggagcaccagggaaattaccatacacgtcgagatcgctttgtgagcatgtgtgcaaaattcgtgtgtttaaggtctccccaatttaaaatgaaagaatttcatgggattttcattggaaacgaactaaaatcctgtattcagaaagccttatttttctattataggaaattcggtatttgcttcaaaagaagctgtttacaaagtcaccagctcatcaaatgactacaaataacagtacacgtgatgacaaaagaaaaaaaaaggttaattatgtctctagccttttttttatttttgaagaaaaattctctagctttcattaggaagaaggacgatggaaaaagctcaatttattggtacaaagttcccattgcctccaaagcagaggcggattacgtagacaactagccatgcacactctttttttttagggaaagtcattcagcgagctttattcattagacaaaatggttacattgttcactaacaaattcaggataaagctaggtgattcatcaacccaaatatcagaatactagctatgcacacttggtttaacactatcaagctacatttggtaaaacaggtttttagctctatccaacaaaccggtttcatggttgcctatcgaccactccatcaaagattacacagttacactccttttttccaaaataaataattttttatatacaaatctagacatatactccatattcagattcatatacaaaagttaacttattttaaaacagaggagtgagtcattccacaacgcaagttcaccatttccccgtcaagaggaaaaataaatgcagtcacatcaatcgctccaccaaaaatcaagctcaaaattagtctgtacataaaagaaaaaaacaaattcagacgtgaataataccggcctcgtttacatatacgctaggtttgtttttcttatctttatgtgtgaattgagtttaaatgaaataattttgtggagtggtatatacatattgttaaattttttaaagattttttatatatactggaaaaaaatgcccgtgcgttatattggatgaaggctattttagttttattattaatgttatccagtttaactagggtgaaaattattgtaggaattggcttggatattttttaaaaaaaaatcatgagttgtaattaggagttcaactctttcaagttagcatgtgagtttttttaaatgattccttatacgactatttttgtatttccaaaagcgtcccaagttggcatgcgagttttttttaaagagatttcacgtcttttttatttcctaaagcaaacgaatctgcaaaccgactcaaacacatatatgtattttcaaaagcgaatgagcattaaaaaccaagtcaaacacgaatgacctatcaaattatcggtaaaaatatcttcaatttttataatagtagagatttagatggtaaggatgatccactcgagcgattaaaatagtttaccatacattctcaaataaaaaaatcacataaagaaactgaatttgctcaaagtgattcacatttgttccgaccgatctgcaggaggcacacagctcaccgatagatatatgatcctattggctactatctgaaaatgcggcagattaaagtaggcatgttcttcagtggtgcgatgcgtacagcttagtacgtaccaactcgatcgatcgatcagcttcagaccggccattggtgccactcccgtcgacggtgactcactcattatccatccatccatatctcgtcgatcggtcgaccatcttgatccgtagcgtacttgtgtttctactgggaaatcatcacggcgcgcactacacgtacttcctctatctcacttaaaacaaatctagaactgagcttatctcatgttcgttgtaatatatcatacctaatcatagatttttttttatgacgaaggggtacgtatcagtagtatcacacgacggcaaactgaagaggtggatacgttctaagagttttgtggttggttacttgctcgattttcatcatcacgcttttcgaacggttaaacaggctgggtgtttcggatgaaaccttttctagaaattattttagaaaattaaataaatccatttttaggtttataataatcaatgcttaattaataatatactaatctttttttttgttttgcgtgcatctgctaaacatccgttttagaacgcactttagacacgcggccgtagtgtagtgcgttcctggcgtgaaatgcacaacgtacgtacgcgagcgcgtacgacgctggctgatcatggcctttgcactttgcaggcacaagtgcaccacctcatccatacacgaaacacggtacaacatctatacgggctgtttttttttttctaaaactgtttggtgatcaacaccgtcgtgtcgtgggctcgtggcctggtccatcaacttggctagcttgacgagaacagtagaccgaacgagaacagtagctcctgatgctacagaccgatcagtccagactccagagccgaccacagctggtgcagcgtgcttccgaattcagatgatcggtataccttgcttccgaatgtttgattcctcgagaaatccaagtggattatccacccatcgatcgagtacagtacagacagattccagaagaatttggcgccgacgggccagctttccctcaactcatcactcgccggctcccatcggttgcccatttgacctaaaatggcttattagaaaattaaaattaatttataagtaaaacttttgtagatttgttcgtagcgacttaaaagtcaacattaaccaaaaaaaaagttacgttaaaagcatttcaaaatcaacctcaaaatcaagtttaaaaattgaaattttgactcattctttggctatttagcccaaacgatggggctagccgagtcgccgtgccaggtcagcgagcgagctagcgagagatcaatctccactagggttccccaaacagttttggatgagattaccgtcaccccacaatttagtggttatcgcggtaaccgctcggttaccacgaaaactatgcgattaccacaaggtatactgtaatttcaaaaactgagaaaattacctcacgtgataactacacagttttataaaccctgatccccacccaggccgcgcgccagaccaccagtgcatcgacgagcatcaacttgtcggagctagggagcatccatgaccaaacatttgcagagcactcattcagttttcttctgtccaaggtttcaccctgcagcatgtagatttcagaacatatatatgaaggatgaacaactacacttcttcgagtacggcaaagtttcaaaatcttccaatcagcaaaatgctgtgaactttcgcgcttccagtctcaacaacactagacatacattctcaccccacacaacagtgagacatgaacccagctactaacataagttaaaatcctgtttccctatgtatttctccggattacatagctaagggtaaacacaggccagtaaagtacaacaggcttcaattcagttcagcgattgaagatgcgaatcattcttcagcagggccagaacggtgagaacagattatgccacggtccaggttacctctaggagagcaaagagaccagcgagacgaactccgatgttaccctgcctttcgatcttgtgttgatgacaaaatgttccggatacttcctcagcaatgcaaggagaccgtaccatggcctaccttttgtttcagttggcgaccagtcctctggtgaaaggtacttccggaccctgctgtggtgccacacattgccaaactgttcaagaagctgcaagtaaccaaacgagttagttacttagtttgcataccaagaaagaggaaacatgcttgagtgtaaaggtagcaagaaaaaagagatggctaggtgaaacgaagatctctccacaagtgcacatatgctaatgaaaatacatacaccaactgtgccagttgaacaaataagattgccatcgtagcattactgtactcatgatttatgctaattttttagatcactggttgaaggcaaagaggagaatcagaaaagatgacactatatgagagttctgacatttataggtacaacaacaaatggttaacgacaagcacaagagccaaacatttcaatctctccgggtgctggtgcaatccaagaaatgcccactgtggcaaatcgaaaaatctgagcttttccaagtaacagaaaacttttatcttttatttcttttccatatatttggactttggatgcaagctactactaataataacttagcagaagtaaacacattttaacactagttttcctcatgcatctgtccttgtttgttttgttagaataacaaagcctaactactgtgtttacatttaggcatcccatcactagcagaagcaactctctgagtatcagtacaaggttaagtgcaaaacatgttcaaagtgataagttgtatgtaatcatactattgtctagagtatgtctctggtgcttgtattggcaaacacatgcatttgaaatcctaacagtcctgtagctgagaggaccaaagttacatgtctatataattgttttgtctcctgactatcaacttatacacaccggcagaacaagatgcactataacccgtgttttagacaagacaccagattttacatggatatttgggatgctgtgtgttgatgacctgaatcatctggttcagattgcaggatcagctactatgatgattgacacggcagggatgctgtcatccaatttttatccccagacgacatcagccaacaagtccccttactgatcaagttttctcattgactgtgacggctccatttaatctttcgaatatatgttcattttatcatgcatttcaataaaataccattttcttcttgttttagcttgttttagttcacaaggcccattcctcaattttcgaaattatctaccccaaaacttgctttttccaagccaaaaggcagtgaagtttcacagaagacagggactaaaaagacatgccagagtataatctagcctctacctatactgtatagaaattggatgaaatatttaagttcatccgtgacaaacctctgtgtggagttttgccataggcatccattctccaggaccacagaggtcagataacactgttgcaacagatgacactacatccttttcttctgcttgcaggatgtgctggttatccatatccctgtcaccccttgatcttatttctgatctgctgtctgcacaaacaattaacaaaggaaggtggttaagatcagatcaaactataagatgtttcttcaatggcacagctatgaataaccagaacacacactaacagtccccaaagttgaatattcggagttggaaactggaaagggatagcaggggtgatccaaacttattccacaccatctagtaattcttagagtgaaatagaatatctcattctctccggctgataggagtagcacaggtaatgcatttaacttattgctgaacattcacattcatttacaaaaaatgagagatgtattacatttgctaattgaaagacgcacaccataaaatagtcttgttatactcaacttagacaacttagagaaaatacttattggcacaggctatgcaattgcatctaaaattggtatagtcttgttatactctatcttgcttatagtgtaaactgtacaatcttcattctgcccagtacagaaggttgaaataaccttatcttacattgatgaccctgagtttcattttcacaatgtaaatgaactgagcaaaaagtacagctatatttagtgatcgtctgattgatcaagcaaaatcgcatataatttatatcgaaacagcaacgccatcaatgcagaatcaacatgtactatcttttacaagaaaacaatgacaccaggataaaatggaaaggatatctagtaagagtggagagcaacgattaccaccttcaccgagtgtcccgattgcttcaacattgatccggtgcccgccatacatctccgactccgcggacagcttcttgttcctcttaatcaacttccccctcatcccaccactctcactgataccattcccaatctcatcaccctcccggccatagtcaccctcaaaggacctgtcatgaaattcagacagacgagggcggcctgtccgcacataggatggtggaggcatctgctgcgggatgataggcggatgccgagcagcggcggcggacgcgaagatggaccgggtgggcagcaagaagtagaacttcttgtccccaatctggagcagatcctgggaatccagcttcacggggtggttcccggggaggtggaggacgccctcgacgaggcacccgttcttgccgatcacgtcgagcgcgaagcggcggcgctggaagtcgtagaagatccgggcgtggtggcgcgagatgttcatcccgccgccgaggctggagaggtccacgtccaccgtcgacttcttgctgttgcgccccagcatgatcgagtaggtctgcatgtagtactcgaaatcctccccctggagcttcgcgaacccggcctccacctcgccgtcgccgcccgaggatcccgccggcatcgcgccaccgccaaggttggccatccaatccacgaaatcgacgaaatgatcctgagcttggcgtggcgttcgggcgcgggcaaggcggccggcggaggaggggaggctcaccggggtctggagtgtccggcggagggggcgcggctgcgtggcggcggagggaggcggccggccgccggcggcggcggcggaggatcgcctgggttggggaagtggggaattgggggacagacaggtagatggagaaggggaacactcacaggacaatcggattatgttttactacctctgtcttaaaaaaaaatctccaaccctaatttttcgaggtgaatataaaagaaccaaaatacccctaattaatagcaaagttatattatgagtgggtaggtgagggttactgaagataattttccaaggtgaatataaaagaaccaaaatacccctaattaatagcaaagttatattatggggtgggtaggtgaggggtattaaagattattttccaaggtgaatataaaaggaccaaaatacccctaattaatagcaaagttatattataggtgggtaggtgagagatattgaaaagataaaattctcgatttacagatcgatgataggcaaaaaggtagaaattggtttatttgaaaatgttataaaatatttatttaaaacagacggcaatcttgcttaacagacgacaatcttgcttaatcacttaatcatttaatcattttgtaatacaacgaatctgaataaaaagtatctcatacttcatccgtttcatattataagactttctagcattgcccacattcatatagatgttaatgaacctagacatatacatctatatgaatgtgagtaatgctagaaagttttatgatatgaaaccgagggagtatatctctaaggtttttttttctgagattgagggaagtgtctcatcaatttctaagttgattttgttagaccaagggaataattagcacgatatcctatgcaatctattatatactagtataatttttgcatgtcaaatataatcttgaatatcctatgtaatctattaggctctatttgagactgctgaaattgaaatgatctaatttttctagttgtctgaggagtcgaaatgttgttttagaataccatatagtttcttttacatgaggcataagcttagaagcgtgtaaacgaaaattcaaagtcgagaacacaaaaaacacgaccataattgaatacattgtatatttatcccgctgaagtcaaagcaacgaattgtcccctataaaatgaaacaaaaaataattataagtggtaaaattgcttgcaaccgcacaccctaacaccatattcgcacacatgtgagtgcgctctaataagaacatgtagttataatgacgaagaccaatgataactctcttatctcagtaaaatcttattagcaaaaaggcatatattttcttaaaaaacattggacaaacacatgtattcacaacacacacgtactcatccatacgaacgtatatatgcacactttacctcccaagcacaacaactatactgatatatattaagatttaagattgacgaactcattgcatatatctctgtattgacgggtacatcgtttaccgctaaaaattaattagccataaatacaaacaaccgtgggcaggtttcaccgccataactactcccttcgtcacataatatgagggattttagagggatgtgatacatccagtacatgtttagatttttagtaatatgatgtgttacatctcttcaaaatcttttatattttgggacggaggaagtaataagtatcttctgaatggatttattttaagtgtatttttaaggaaatgatgcgttgaaaaatgccaagcatttcatacagagtaacacccctattgggaaaaaaacgtttttcgccaaacatcccctctctctctctaatgtaatccaagagaaaaattggataaacaaaacgacgataaaataccataatgggattgagagggaacatgcagccctatcatatcgaaggaaaaaagagaaacaatatactatttgcaaatgaaaaaaaaaaatctgtgtataaaacttatatacatgttcttggcgatataaaattaaggcccctttgattcaaaggaaattcataggaattttagaggatttcattcttataggaatttttcctacaaagtcctttgaatcaaaggaatgaaccctatgaaatcctatgaaattcctatgaaatgcctcttcccatataagttttggaggaattttaacaagaggtagaacctcagggaaaaaatcctttgagtctttatctctcctaaaattcctgtgttttttctgtggtacaatcaaacggtcattcctacgtttttcctgtgttttgcaatcctctgttttacaattacattcctgtcaaaaccctatgtttttcctattcctccgttttttcattcttgtgatttaaagatgccctaaaggttaaaaaataaactacgatgagaaaatttcttaaattaacttcaaatttaacattaataatttaaattttaaccgacaagtataagtataaatgaaaaaaaagtgagtccggtaaaatgtggttatcaaatcataattggaagcgcaacgcgaaggagagacccgttgccatcggtgtgtatcccacgaaggaacaagacgaacgccaaggctcacatgcgacgcgacattgcctacactgtgtcacgttcgttgctactcctccttgctagtgcttaccacccctctccctcctcctcctcctcctcctcctctccccttctctcctctcctccctctccgccgcgcgccggtcgccggagtagcagggtgactgggagggattcagcgaggcaaaaccaatgggggtgctgggggacgggtcggggtggtgcttctgctccggcggggcgaagctggagcggatcaagaactccgtcctcgccgccaagggcgccgccgtcgccgccgtctccttccccgccggaggtggaggagggggcagaggtgggagtgggttcctcatccaccgcgccctcctgctcaccacgcacggcaccatcccctccgccgccgccgccgccgccgccgaggtccgcctcagccacggccgcctcccggctcgcctcgtgccgcagaggtattgaaccccctctccgccatttcttggatttcttcctccgcttcctataataatcctattgggttgttcaaatgcggtgcccaaatgattttacattttttttgtggtgggtttgcgggtttcgaatggaatcgattggtgctgcattgcgccatgagaggattcggttttgaaacctaatgcgacgcctttagcattttttcttttcccttttgggttgcacgcccgcaaggattgctagatgtttgtttgcactatggtgtagagagatctaattttcatcattcgatgtaaagctgctgcaattttgttcaaaatcaaatgaatctagtctttaggggagttcatgagatagtcattttgggcttctgaattacaagaaaaagaaaacttttgcttgctcgaaagttcaggacttggggacattgtggtggggtggggttgacttccatatggttcatgatactatcatttggggcttgttaccatgggacctagacaatcttgatgttattaatgcattctgttattgtagcatccgtacttttgtagtggggataatatatttcctttgtttggtcgttcaggatcaaatgcaactatgtacaaataaatttatttatcttcttcatacgattttggtggatcaccgaacagatttatgagccagcagatgtatgtcaggaagcattattgccattggctgagtaaagtcaattttgtgcaatagctgcgagaagcagatatagcatcgaggattacttcacatctttgtacaagtagacataaactctattgaattctggatgcctgactagaaaatttaaaatgggaggcaatatttgctgaaagtggtccatggttcaatttattcacttgattgctgggcataggacatgttttaaatgcattctttgtttctttacacaaaatcaatgtagggtcaatctggatttctttttgaacactttatttattgggcaaccacccaacattcgaaacttaattgtaataacaagaaatgaaaaggtgaccgtatagaactggaatataaataaatgtgctgtgcatctctattgcttttagagcgggaaacttagcaagtttttactctgaaattttggagtactgaaacatttatttgcccaagtgggccttttatttccatcttttactatgaaaatttacagttatttgttttgtttcattattccagattctttatcactagccccattttggaccttacaatagtgggtcttgatgtggtgaacgatgaattaaattcacacgggcaacagcctcatttcctaaagacctgcctgaaccccagcttggaccttggcagtacagttttgctcctgggccacacaaagagaaaagacctgacaataggcgaggggaaggttataattacaacagacaaccttataaagttctcaactgatgaagtcgcatggtatcctggatctgctggttttgatatgcacggaaatttagctttcatggtttgtgatccaatgaagcttgcaccttctacacctactggatacgcttctgcatcttcagccgcactcctttcagcaaagaaggatgtgccaacacagtttgggatgcccattcctgcagtctgtggttggttgaagcagcattggaatggtaacttagaagatgttagcaagccaatgatgcctcctgcacgattaatatccactgggcaacgaagtgagtgttcttctgttggtcgtcttaactacatcaagaccatggagcgagagggtggtgatgggatgtcatcatcacaaataccacctaggctgacacagcatcatggatcatgcagttcagcttctgcgaagatttcatgcggtgaaaatgattctgttgactcgcactctattcatgaacaacaagatctgacctcacaaatgcatgaatctaagattgagcaatctgcttcacttatggataataactttcctccagggcatccaagatcaattcgcctgccacttcctctaaagcacatgatgtcccatgagaataagataaaaccgaacccatcattttcacatgaagcacagctagctaatgtgaggatcaattgtggcactcttcacaatgttgcttaccaggaaaattgctggagtgaggctcagtccagttcctctccaccagatatatcagagttgggggatgagaggggcggttttagcagtggagaggagacaatgtactctgctgaaactagggaaagcagaaacatccctagcccaaaggaaaagaatcccaagatggttgggagatcacagagttttgtgaatcatagcaagtgggattccccaaaaagtgttgaatcttcgaaaggggccccctcaaagtcacacaccttcattcctttgagaaaaccacatttgcaggctgcagccatttcgcagaaaagccaagattttttcagtcctactgtctcctcaagcatgaaaaagaggaatttatcacaaattcccatgaaacctcggcaaagtgctcaagttacctccaagtggatcatctgatctcaccaactttcctcaaaccatacaaagatagcaacatcttttggttcaaccggttccacaaaatacttcctttttagttctgtaactgtatggtgtaaatgtattctagtcaaactatattctctagtgattcttttcagtgtaacataatctagcttatattcttttctctctaccgtgcatttgcccaatgaagggtaaaaccaatcatcatacaaaatgtagttttttgtccgacaggtagccatggaggatggactgagcattctttatttttcccaacaatgaactgggattcattggcacaagaagcaggactgggctactcatgaagctgcataattggataagtagtgttccatttctgtgaggagaataattggataagccaatgcctctgcagcagtgcagctttctcttcatatacagaagcacagaactccttgaaaattgacttttttctacatctattcagaaaaatcaaatgcaaggacattccagtgctataggagttccttttttttttgccctgtttcttctgcactcattttttgtccagttttggcaggaacaccatttgaaactgtttggtatggttcactttttgaaatgtcaagtgccaaagcaatcagcagttctctcgatgacagtgagtatttgatgcacatgcaacaatatgctcatcatgacatggcagatcataattgtatgcacatattcaggaaaaaaatactaccaggatgagaacaaatgtcatatgatttaaaattttcttcaagagttaaggtacaaccgatccctaaacttgttcgattggtaacatattctcgaaacacacaaattacccacattagcgtctgtgtgacataccacgtaaaattttggaagatcgtggtaattcaggatttgaatgaaacattttaatgagtttatgagatatagatatgtgttttgagagtacgatgagcgaacaaatttagggatcaatcgtgcactttatttattttttttataaaatttcataatacgagtagacaacactactttctccatcccactactaaatgagagaatgaaaataagatggagagaaaatcacccaaacatcccctattaaatgagcgatgatatgaagtgagagggtagttgagagtaagacggagagaaatttgaatgggatctgattgatgtgatagtaaatagtatagtaggattgtattattttgggaaaaaaataaatctagaattgtattatagtgggatgaagtgagtattgttttggcactttactcttaacacattggcattgccagaaatttaaggcctatttagtttagtgtttaaataaacgcttccaaaaattagcaatgaccaaattttgataaattgataacattatcaagttttatagaataggttaaatgtgctattgttaaaattctctaggattggtaacaaataggctgacttctttctgtaacttttccaactcaccttcctcgcttcccacgcgcacgttttttaaattgttaaaggacgtgtttttttggtaagaaaatgtgtcgcgcgccaaccatacctcccgacacagccttaatccatctacatatttatcaattttttttaaaaaaataagatagtttgaaatatgatatcaatccgaacagggcttaaaacctagctcatagcctagccgacggcggcctcgcactcgccggcgccggcgccggcgccgccatgctccgcctccagaaccacctcctcccacttctccgcgcttcctcctcctcctcccctgtacacctccgccgcctaatcccatccaccgccgccgcatcctcttcctcctctgtgcaccccaaccgccgcctccactccaccgccgccgccaggtccaccaccaccgcgacacccttctccatggaggactacctcgtcgacacctgcggcctcaccgccgcccaggcgctcaaagcctccaagaacgtctcccacctcaagtccgccaccaagccggacgcggtgctcgccatcctctccggggtcggcctctccggcgcggacctcgccgcggtcttcgcccgccgagccacggctcctctgcaccaaggcgcccagcgtcgccctccgcgtcgcctccctccgccaccgcgtcggcttgtccgacccccagatcgccagcctcctcctcntgcccggcggcgccaagggcttccacacatgcgacatggccccgaggctcgagttctggatccccttcttgggatccttcgagatgctcgatcttgaagaggaacaacgcgatcgtcagctcgagcctcgagaaggttatcaagcccaacatcgcgctgctccgggagtgcgggctaaagtgtttgtgatattgtccagatgtcccagacgtccgcgcgggtcctcacgttcagcccagagagattgaaggttatcgtgcagcaagctgagaaactccgcatgccgggttgctcatgggcattcaagaacgctgtgggcgccgttgcccgtagcaatgaaggcattgtcaatgcgaggatggagttcttgagcagttctcttggttgctccatggaaaagctccgctctgcggtctgcaagtgtccacaaattctgggattatctgagagcaaacttcacagtaaaatagagttcttggttggcaaagtcggattggagcctgactacattttgcagaggcctgtactgcttacgtacagcctggagaagcggttgctgccgaggcattatgttgtagaagtccttctggtgaagggattgataaaaaaaactgttgatttttacggttgtgtatgtgtgagcaacgaagattttgtagcaaggtacattgatcaccatgagaatgctgttccagggctcgcagatgcctatgctgcagtttgttctgggaaattgcctgcgttggtctaactctacatcttcagacagagatattggaggttcatcagtggaagtgccttcaaagtataactattagcctattttgatgggcatattggagatcaattatctttcaagcctagagctattgcaccaatttgttctctgaggctcattagttgatgttaattcctggtaatgtctgttttgaaattctggtttcaacagtaccactaccaataatttgatcgctcataatggtaggcaagtttcaatcatcgatattatgcagcaactggactgttttaatgttgcggcccttacttctcatttcatggatcggtacttcaacagctatttccctgttcaggtactttgagcaaacatgattttggtctcattacctgcatgttgaggtttacattgctcggtaggattattggaaagtataacgcagacatcaaactgcatatgctatgatatagtgtacagttgttgtccaagttcagtctaaaccattcttgaatggtgaaataccatgatggattgaactgtagtaattatagacgagaaatatcatgacatgctggcaaaatgaagggtgtggggatatgataattgataagggtgatttttcaagtgtctttttcagtctctggttcatttttcattggctatcactgaaaaagcatctatgcatgtcatattgtctctaatcgtactgtcatttatttaccactaataagccttctaattatctacttcaaaattacaatatgttaaatttgatgcttacaaggttcgctgaacgctaaagctaactaagtgttcattggatgcctaccacaattacacctagacaattgatcaggaacaggtgtggaagatggaacaaggtgatattgccttggttgctgcaacagatggctgccactccttgtgttgaagcctgaaggcaagccaaaaaataggccaggccttctgcggagatgcctgaagcatcgaactgcagtgtctcacactggttttgcagtactagcaggttaaaacaaatcttccatcctgcagccggtaggattgaaaaggtctcataagtaatgatgagaagttttgaaatagcgtaaacatattaaggggtggcgattatgtgatgttgtcagactctaggaaatcagtagaacatcaaggctttatggttgatttgaagtcgatgtggttcaacttctatccagatcaagtgaagggctttctgcagcattctgagaaacaaccacagattctactctctcttttttttttcctgatgagaaactccacagaaagataaagagttcttggttaccgaagttgggctgcatggtgaggcctgcaatgctcttgttcagcctggagatgatgctcttgttcagcctagagaagtggttggtgccaaggcataatgttgtggagttgttgatggaaaagatgttgacttgaactataatctcttctggtgagaacgatttcttagcaagatacattgaccatcgcaagggtagtactgttcatggactagcagatggtcatgctgcagtttgtgctgggaaagtgcctacaaaagccctagcttagcatatctggacctagatactggaggttcattccatctttctggctcataggctcatagctaagacctcgctgtaaacctggttgagttaatgtaattccttgtaatgtcttccaaatcttgatttagtattatagtaacaactaactatcttatccttcttagtgctatgcaagttcaattcgtggagtatgcagcaactttattatcttaattttgatgctctgctgctcctgtgaatatgtgaggtcttattgcttctgccattttgttcttgttctgataattttccaaatgtcattttcgcttcatttccctgttctctctagattatttactggattgtttgctctgtgctttgaaaaactatgttttatctaaaaaaattctactatattgcttagctcatttcttttaagctagtacttattaagtttgtttctcaaaatatttaatttatccttacgatcgttcactggaaagggattatgtgtgtgtaagatatttgtgactagtttattgaatatattttgataatatgtttgtttgatgaaaaaatattacatatttttctataaacttggtcaaacttaaagaagttcgactaggaaaaagtcaaatgagtccacgtatcctaattgagccaggccaacacaacatgaccaaacatctcactagaccgtgtatgggctctggtattagcacgtgggccaacacggcatagtccgttcggtgagtcgtgcctaatcgggcagcgcacaaacgtacctattatttatccctatactatatatagaaaaaaagataaaaattcaccgtctcaaaattccagccacatgagctctatttgaaaaatgggattaggacaaatattagaaacgcccagtagtgttccggttagctctatatgatggtgggctagctagcctagattcgaagcctcacaacttcaattcattttatattgggccattctatagtatattcgcgttttttaaagttattattttcatttttcagattttcaccaaacatgtttgggacctttgggtaggggtggggatggggcgaaattactaaagtaccctcgattttttgacgcctctgtcgtctcgtcagtttgcccctgcccagttgcccaccgcctccggctccggcgatccccatccatccggcgagcgagcagggncgccgtcgttcatcctgctgcttccgccgatccatcctggtgagcacatcctccgccaccgccgcctgcgccgatccccatccatcgcgcgagcgatcgagcagggtcgccgtcgttcgtcctgctgtgctgctggtggtggtggtagaggaggagttgacggcgaggggatcgagagggagggagggatgcggcagcagcggggcaggggcgtggggcgtggggatcccgggctgctgacgagggcggtggagaaggtgttccgcctcgtccgcctcgccgagttcgagatcctcttcgtcctcttcttcctcatcgccttcgtcctcttcaaggatctcgtaagtgcgcaccccccctcgtctctcttctcgcttacacattcacctctagtaacaacaggttatgtttagttatagagataggttggttcgtgaccgatttgcatggctttgatcaatttggtacagcatggccttgatgaactgaaaatattagaagatttgggtattttagttgaaggtgaactgaaaatatagaagattgggtattttagtagatgcaaaacactactgttcgatacataattttaaatcttgtttgatgttgccgactactgttcgacacataacttttgttttatgttgctgtatgacaagtagattaatggtgtttttgtcgttggtagatgatttctctataaaaatgtaaagataacctttcatgtgtatcagcgcaggggcggaatcaggcatggggcagctagggcttgggccccatgcctagctccataatccctattataatcttgaaaaatgctatgtaatttatgaaaatatttgagatcccattagctcagccctaggcgtggaaattttctggcaacgccactgtatcagcgtgatattttagttgttgccttgatatgcccgaatagcaaatcatgtccattttgttaaaccttgacatcaagtgtactttggatcatagtcttttaggtcttttttgggctggagttatgtcttctttaactattgaatgaatgaatttacctgcagatgtcacgaccagagtacaactcgatctttgtcaagaagcctgatctagatgggagatggccaggactcatgtaatgtttgtgtagtgtgatcaatgttgttctttttcctcttgcccaaagtacacttttgaggtgcttctttgacttcagttcttatgactactaatgttatctttcaagatgatgaatatagtttttgatgaattgccttctttggttttctgaaagaatcatttgcttaatgctattggcatggtttcttggtatgggtcttgattcttcttgtttgcaagcttaccgctggaattttgttaagtgtcatgctgaagttactgccaacagcccttgtttgcaccatgttgctgtccaattttatgggtgaattgtgatagccatacccatcagtcctgagagaagcttggtgtttgatgttttgataaccttgcttcttttgttaaggccctgtttaaatcccaccccaaaatttttcaccctttcacatcgaatgtttgaagacatgcatggagtattaaatgtggacagaaaaaaaaaccaattacactgtttgcgtgtaaattgcgagacgaatcttttaaggctaattgcgccatgatttgacaatgtgttgctacagtaaacatttgctaatgacggattaattaggcttaataaatttgtctcgcagtttacaggcggattatgtaatttgttttgttattagactatgtttaatacttcaaatgtgtctccgtatatccgatgtgacacgccaaaactttacaccctgaatctaaacaccccctaagtcagtcattttggttctgagactaattttgtcatgaaacctgtcctgttaggcttatagttgttgggtcagctattcaatgttgcctatttcaatctttgcacctcctctcaagttataactgtactgtaagtttatatggttcactgtaaatcttgccttctcgaccacctcttaagaatggtaaatttctatatgtatgtaattcctgtgaaaagaacagaaattttcatcttagtcataggctcatattgtcattgtagtgtggtactggatggttattcaagtcccaatacttgtattggaagtttgatatccatttctatacataattaaatagacatacaagtgaaactgggtcatcttaatattatgcagttccttgactgtcaaattcttcagttttgctcaaaactctgaaatgcattggctaaatgagatggctcatgcagacctgcaccatgtcaggcttcaagttctatacctgaatcaattccgtttatgagggacagctatttataaataaggatggcgaaatggcaactgatcctctagtaaatgaaccattcaaattcgtatgaattcatgtaaaatccctacattggtttcaaacccagctttgccttcatggatatatggacagcagatggattaatttgtttaggtgaagtgggattccatcaccttgcagttgttgtcttcgaaattcgtatggtctttgcgtcaaactgcgtgtatgttaaagaggtcttctaatacagattctagttgacggtgcactatcattgaagaaaacacatgatcaaaccatcgcatgtgcggacgcgttaatgtcgttattacgtgagatccaacctaatggaactggaaagtggcaaatagaaacaaataaattactattagagtaggatgttcggcaaagttgggctcaatccaactcacatgcagcgagtgctcgacttgcgacagctaaagaaaacgagctaagattttagtcactttaatccagtcaactcaatggtgggagtataaaactattcatatcaaaagtataaaagaagttctaaatttttcatattaacgcagaaattcgcaaggttttccctacaaactggagaaattcatttttggtaggaattccaagaatttctcttgtagccatgtttttttttctaattaagatgcagatgattttatctcgatttttgttaacacatttttcaaactactgtttctggtaaaaactttatatttagaagtgactttaaaatatcaaataaatctaacttttaaaatatataatagtaaaatttaataaattatgcgataataagggggtgttcggcacaactccaactcgaatatttttttctagtgccgagcatttctagctccataaattcatagagctggatctataattatatatataacatttgaatcaatcgttttgttttcattttaggtgaaatataaaattttgaatcactataatttaacataggaatttcaaatacagtgtataaacatgtggctgactttcttttttaaaattttaatccatctcaaacactggcgcgtcggcggtcagtggcccgtccactcggcccctcctctttttaactctctctctctctctctccggccgccaccccctcgccgcgccgacgtctcgcctccgccgcctcgttctcgttccgatggctagacgcgtcagcaccacccgcctcctcctcctcctcctcctcgtcgccgccgcggcggcggcggcggcggccggagaccaggtcagcattccaccctcgcctctcctcgcgccccgcgcaccacctcttgtctctcgcactctatctaaaccctgcgtcgtggttcatctcctttctccaggaggacccgcgtggcggcggcgacaacggcaccgcccgcttggatcgccgcaccaaggtgaggagctaggacccgcgcgtgtgcgtctgtttcgatgtccggattctgttcttggagctgtgggggttggtggtaatctcatcgaggcactggcgatccccgtcacagatgttcctgcacgcggcgcgggcgagcgacggcggcgccacggggatggagaaggccgggctgggtctcttcgacgccttcttcgctagcttgtccatgattctggtcagcgaggtagtaggtgacatttcgggatggaaattaattagtcttactactctagctgctctgaatttgcttttttctttttgtatctgtatctgtggagtgatcacttaacttagtgttgcttgtttatgcattgcttggtgaagattggggatgagaccttcatcatcgccgcgctgatggcgatgcgccaccccaaatccaccgtgctctcaggcgctctgtcggcgctggtcgttatgaccgtaggtgaaactgcagcttgcagatgcagcggttgtctgtcaaggcaagattgggctgcagtgtagagtctaactaatccttacttggctctactgttgtagatcttgtccaccgggcttggcagaatcgttccaaatttgatatccaggaagcacactaacagcgcagcaactggtatgactgatctgattgctacattattgcgccgtgataaagcctagtatgaagtgatgtgttagatttttctattgaattatgtatcacgagcctggaagtcggagaaaagtgatcgaatcatcataataaattaagtggtatggttaattgctccaaaagcatctacagacatacaaacattattaagactgtagtactggatttattgtttcaagttttcgtactatactgctgtgcactagatagtcagcattgccatagttatcaagggaccattgtcagaaaatcagatgttacagtttcacagtacatcacatgaaagttcagacatttaggcatgcacccgcattggctactagttgcttcaaaaacagtgtcccttagatatagaaacaaatagaagctgtttgaaatctcatgctacggtaattaaagatatatgcttttctaccgacttaaaaggagtccaagggcctccacattggtatagaaaagttccctaagaaaccaactcctctttggcatcccaactgtttgcatgccatccagttaattttaacaattcaccgtgctcacctaatattttgtatcctctttggtattttgtactcagtcctttatgcgttctttgggctacggctgctgtacattgcttggaggtcagattctaaggcatcacaaaagaaggaaattgaagaagtacgcacattttattacatttactctttgcctctacagatttgcattagcatttttcttttgacagaaaactgcattagcttaatattgttagtttatattttgttgcgttaattttatccttttttgtgcatattcagtatactagaatctctaatttgcagcatctattgttgttgtatccagtgtaactgaatatctcttggagctttctgactttggattactctctgctggaccaatttcagcatttctttgccctgttgtgcttaaaaaatagaactagactgctgaagatatttagttatttgggaagatacatgtttactgtattgaactattggtagtccttttaattactattatttggttgtttatattatgcattataattggctctgacctttgatatcgtccaattgtttggtatgctacttgaaccatcttatatattttgaatcccttgacatacacaggtagaggaaaagctggaagcaggacaagggaaatcaacatttagacgcatcttctcaaggttctgtactcctatttttttggaggtacattccgctcttatcgttataaattttggtgcttcttggcaaaagtgcatttgctgccatctgatttcagatggatactgaattatcaaacactcactttttaccaacaaatggttgataaacacgtgatccaatttgtgtctttttaaatgaattcatccaatgtgtatgaacgacttgaaaatgcagtcgtttgtgttgaccttcctggcggagtggggcgaccgaagtcagattgccacaattgcggtaaggcctacccccttttcagcaattttccaacacttctcttcttgctcaattccccagcacttcttttcttgttcacaaaccgtaaacttgttgcatttcttgccaatgcagttggccactcacaaaaatgcggtaggggtcgctgtgggagcaaccttggggcacaccatctgcacatcgttcgctgtggtgggtggcagcatgctggcatccaagatatctcagggcacagtggccaccattggaggcctcctcttccttggcttctctctgtcatcatatttctacccaccattgtgaattttgtgatgaactgatgacatcctaccaagggggtgtatattccgttgcagccaagcatgctggcttgaaatataaacgcaggcgctacatatgtgcagcagtgtgcaacctttgtattgtttgtttgaaatcacaaatctattctacgtaggtttccgattgaattagtttgcgacaaccggtgtacatttacgatatactctctctccgttttaaaatgtttgacaccgttgactttttaacatatgtttgaccatttgtcttatttaaaaaattttatgaaatatgtaaagctatatgtatacatagaagtatatttaacaatgaatcaaatgatatgaaaagaataaataattacttaaattttttgaataagacgaatggtcaaacacgtactaaaaagtcaatgtcaatagtgtcgttttggaacggagggagtaaattttagagatggggtgggggtgcatcttacctccctcgactataggtcaaattcgattcgtatccgtgaactgtaaagctatgtatagaggctgccacaacaattaaaatcggatcaagttacctatttcatgctggatggttttgatgatattttcctcctacgtggtagtcccgtttcaatagtcgtgaatcgaactcggtgaataagctgagggataaaatatggacttattccaatttcgggccacctacgtggatgggccgggtctgtggcccatccatccaaacaaggcctagtgaagttggaggcctccaaacaaggcgctcacatcgacctgttcggtccggagtcggatacatcaaacaggtcagccaattttggaccgaatccaattataatcggacctttatatttattgagaatcacaaattcacgatccagacgaaagggctcctccgtctccttcatcaggtgtgggccttctgctctcgtttgttggcttttggaggcttaggtgtcgctcatttttattgtcgaatctcgatctggatttgtagaatttttgtgcgaacgtagagtagatcgatgtgttgagatgatcttccgtagttgatagttgacagatgataaaaaaaaatcgtctcctttctcgtttctgaattctgatcgatattgtattatactgatgcttccacaggaattccggcgctggcgatggaaataatattttttaatattattttcatataatatgttataaagaatagtagctatagtagtatggtaattgcctacagagacatacaggaccaccaatataggagaataaatgaggaaacaatagccgtgtaaaagatgaaaaaaatcgatggatcctatctaacctaagcgtccatcaattcttaaaaaaaaggcccaaacaagattgatcttagttacagatgtcagaacattggaccaaagcttcgaaaaaaaccaaacggacatgggagatgatggacgatagaaatgttatgaatctttttaatggaatcggatgttttttctttctaaattcggacagttttttttcacattgcacggtgccaaaccagattttttttttttttacaaacggtggcgtttttctcgcgttgagtcggacagttttttcaaagcggttcttttataaatggcgatgttttttcgcgttgaatcgtacggtttctcaatgggttttttttctcgcattgagtcggacgttttttctaaacggcgtattattctaacagttaattcggagcgtttattctaacagtttcttcggagtgttttttataagggatttttttctcgtgcggtttatattaacgttgacattttaggccgattttaatatatgacaatttgaatgaataaaaaaagtaattcgaaaggggattttttttttcagccaaccttttttttcttgaggtaattttggaaaatcagccggtttttttagtggaatcggatttatttttaacattgcgtggaacttttttttttccactaacctttttttgggagggccgatttatacagactctttttttagaatcggaccgaaaccttttttcttcgcactatttttttccttttttagaaaagcgtatttttttcttttccggtacggtagggatgacataacttttttttctccagtaacgttttttttgaccggtttatacggacgtctttttttaatcggacagaaaaaaaatttcacattttttgtttgctttttttttaacggaagagtggagacggaacttttttttcgcgcgtttttttttacgtttttacagacgatggaaatttcttttattttcaagtagtatatataagagatagagatagagatgtgctaatctttcctattaataattgaataatacaaaagcttcagtttgcctttgtccggcgtggaatcttgctgatgggattcgactattccagtcgttgtcgaagccgcacctgaggcctgcgcccacagcaacctgttcggcttggagtcggatactacactatttattatcacaaattcacgatccagacgagaggggggggggggggggcgtctccttcatcaggtgcgcgccttctgctctcgtctgttggcttttggaggtttaagaggggcttaggtgtcgctccttttcattgtctaatctcgttctggatttgtagaatttctgtgcgaacgtagagtagatcgatgtgttgagatgatcttccgtagttgacagttgattaaaaaaaatcatctcctttctcgtttctgaattctttttcattaagcatggaagaaaataatgtttaaacaaataacaggaattctggcgctggcgatggatccatctgaggaaacaagtgcagggaaagatgatcttctggcgattgatgactctaaccaggataaggctaaacaggctacggttgtatcagatgaaagtaaggcgccaatcatagaaaagaagaagaaaaaaaagatggttcgctatactcaagagcagatcgaatactgcattgctaacccagaggagttgtgggacatcaaagtcattaagctgactgagttgttgagcaaggagtgcctggcccgaatggggcaggagcaagtagacaagttgtacgctatggaacgtactgaggaggagcagattgttagacggaagaagctacaggaagtcctccgcaatgaacgggagaacatctacaaaatccccgataaaccgcaggacgtcctcaagcagtactacgccaaaggctatgccgagtacgaggttgttgttgacgatggagatgtcgatgtcgatgaagacgatgaagttcctgcacgagttgctcaccctggccggagaagattccgcaacgggattgtcgtgaagaagaatcagtcaggaggaggaagtattaggaagataaactgaataatcgtcgttagtatttggcatggatccatcttagttgtaggggaaattatatttttcccctctatttatcagcataataataatagtactagtagtagtaataacgctgtgcgactctgtggtttgacttaattttatattcctgctatggtttgattctaatcgtgctaattgtattatcgttcagcattgatccatcatcttgttcagggaattttaaactaccctagactgaagtcagagaacagagtttgtttcgactggagtagtttttactgctctgtgctctcccagaggcattttcaggagtagttttgttgattgcattttcaggagaaatttggaatcccttgaaagctcctcgcctgaaaaagatgtacaatttggaacctcttgcaaaaactaagctggtctctattgacatgttttctcctacattattcagagtttcatgataaggattacaatggacaaaactttttgacatggtcatatgagaatggcactctgctaccatctgttactccaaatgccaatgcaagttggatcaacacttgaaatgaaaaacgagtcagtcaggcagttgtgcttgagacaatcagacataatttcggtttagcttgcaaagttagtgtagctatcaggtctgtttgatttataatctgtgctcacctctgccatctcttcttgatcgtggcggattgtccccaccttgtcaaacattaatgcttatcaaagtattttaccaatttaaaatccccaattccccaccatttttattcagcacagaattgaaaaaaaaaaagagatttggaggaagagaggccccctctaaacattttttaagaaaaaaatgtgagtgtgttgaaaattgaacacggaatctcgggtgaaactacacagcccttaccacttcactatcaagtgcatctcttcagcacaatataacgggaagctttgtggcatgttctgtaacatacatcacacacatcttttgttactttttgttatgcaaagcaacaggaatgctctttgatcttcagtttgggcagcggttggctgttgtgggagaggatctgcacgacctcggcccgccggcgccgactcctcctgctgcgccgcggacggtggtgatggctggctggatcctctccttctcgtcatccccctcgtccccatccctgcgccaccgccgcttccgtgggctctgggtgcagtgacagaggacaccgcggaaaaggagaagaggcaacggcgacacgcgtcgcggaggaccaagcgggccactccctcctctcccaaatcgccaagaaggagaggagttggcggtggtggggccgaggttgtgcagctccattcttgccagccgccgcgcgccgctgcctcctcgttgcgcctggagtgaggagaggggagagagatgaagagaggtggagctcgttgaggcattcaggccctttgaccgcgacgacaatggcttcatctccgccgccgagctcgcgcgctccatggccgacaccgacaccgacctccgcgcgatgggtctcaccggcgacctcttcctctccgccagcgcgatgttcctgccggccacccttctctcttccgcccgcggctgaccgccagatgctagcgacctttccttctcggttggcgtggtgctcccgctagccacctttttctctgtcgcccatgaccgaccgtcggtgaagtcgtggagaagggagaaggagaaggggaggagatagagaaaagatgggatgaggtggaggaagtgggtccactgacatgtgggtcccactatttttaattttattattttactgacatgtattttatttttaaaaaaaaattgttaaattttgcttcagacgttacgtcagatgaagaccgaatcaaattagccacataggcgccacgtcagctaaaacctccgtccaaaccgccatgaaatctatattgcatcagttttgatagttgagggacctacctattgcatctggttttccggttgaaggacgaaaatcggatttgttgacaagttaagggacctcagatgaacttattcctaatagtgatgtttgcaggtgatggataagttgtcatgggctgacgtgcagggcacatatgtaattgagcctgcgttctagttgggccggaatctggcccatgtcgaatccagctaactcattgttaatccagctagcccatatgtatatacacacattttgtttgaagagatcacatcgccaaatgccagaaaatcaacagttaaattaaccggctataataggctagtaaaacaatagctagttaatctagtagtaattaatcatctaattaacaatgctatcaataatcatcatcataataacagttaattagtagttgaaccaccatcgccagcgtccgatgatcttgccgacgtagttgtgttcatggggcttgtacctgcacacggtggggaacacgccgagcacgtgggcgcactccctgagcaccacgtcgccgacgagcctcttctccctccgccgcgccggcgccgccctggtggcgcgccgcccggtgacgaggaacatcttcccgtcctcgaacaggtagtggcacccgccttcctcgacgcggcaccgcagcgcgtaggcggcgctgctgttgaagacgacgacgtcctggaggaagttgcccatgtacccccacttgcagaggatggcgtacggcacggcggcggcggagttcggcggcggcggcggtggctggaagaaggcgcgctggggcttgtaggggtcgaggatgaagtagtggaagtactcccagttgccggagaaggcggtgcggcagctgaggatcatctggccgccggtcatggtgctcagcatggacaccgagtggttccgccccggcgccgccggcgacgactggtcgcggggctccgccgcgtgcggcgacagcatcccgacgatgatcacgatcgacgggatggcgatgaacacgaacgggatcgagatgatggtcagccgccggagcaggtccttcttcttctcctccatatttattatgtacttttaatttcttgtagaaaatgcttcagttttgctcttcttcttcctcctctctctcctcgaagcctctaatttatcgtgtggttgacgaggtggcgtgtcaaaattaggaagtgaccacacctgaatgcagatgagaaatatgagatattttgaccaaatgtatcaacgatttaaacttgctcgtagctactccctccattccataatataagagacagccacttttcttagatgttctataatataaggttttaaactataacatattttttattaaattactactttttttaaaatccttcactgtcacattctttaactttattggatgcatgcattatatttattaggatgatccaaactacaagataataataactatttcttggtctttgggttaagagtggttgtggcttatattttggaagggaccacctatacatttgtcgacaaattttctcctaaaaaaataacagatgtaattatagtataattgtagtgtaattacattgtaacttgtatgtaactacagcataacttgtatataagtttcacgtaattttgaatcgttaaatctattacaagatttgtttaggtgaggaagaaaaaaatcacagcacacacatatgtataaggatttgttctcacaacctccattttaccgaaataacatattacagagagatttttgaaagttacatacaagttacactttatttacagtgtaattacactacgattgtagtgtaattatatttgtcaaatttttaggagaaaatttgtcgttaaatatatagcaaaatcgttttcgaatggagggaatagtaatttggaatgaaccgattggtcgtttccttgaatatcaggctctcgatcaggacgccgcctctcgacagatcaaatgaagcccatccagaaaatgggcccatcaggcctgataccgacattatcaggttagaataagttcactttacgtccctctattttgttgcttagtccgatttacgtccctgaaccgcaaaccgggtatgacccgtcccccaacccccaacttacgaaaaccggacaagcgagatccctcggcagtatgaagggcggttttggccgacgtggcgcctatgtggctaatttgactcagtcttcatctgacgtggtattgacatggcgctgacatggcaattcgatctagaaaaatattaatccatgtgggacccacatgtcactttaacgcacaaattaataaaatgatgggccccatgtggatcccacatgtcattatcacccttctcttcttcctctcctccctccctcttcacggcgtcacgaggaggtccggtggtggtggccgacgacgcgacaacgacgaaacgggagaaggctgggtgtcggcggcgagagcgttggggggaggggctccgcgtggggggcgccgcccgccccgagaagctactcctcgtcttcgtccgcggcgccggcgcagagcccgcgcgggggctcgaggagttcagggccgtgcacgtgggcggagggatgcagcagcagttcggcgccacgcggtggcgccggagatgtcgccactcgccggcgggaggcagcggcgggcggatctccatggcagaagcggcatcgcccatcaacaaccggctcgccgcgggccgtcagcggcggcgccgccatggctgaattctcgtcagcgaaatgctgcatgaaatctcggcggacaccagaagcaacctggtgtgattttggttagctctgttaattaattaccggctaaataaacacatccttttcacttttttccttaaccatcgttcacgagcacggtgacagccgggccacctcggcctaccaccagcggcctcggcggaggagcgcacctcgcctccgcacgccggctgccgggctcttcgcaccggcgcggactccagcgtcatcggagcagctcactgaatggccgcggagctgcgcgaagggggagcaggcaggcggtgaggtcgtggcggtggtggagggccgctccgccccgctcgtcgcccgctccgccggccgccgcccgccacggaggaagacggagaggagagcaacaatggcgatggggagcagtgggggatagagagaaggagagagaggatagagaggggatagagataaggggtagtgaagatgacaggtgggtccacgtgggccccaccaattatctattattgtgtgtgtgaaactgacatgtgggtcccataggatttattatttttttattgaattgccacgtaatcgctaagtcaatgccacggcagataaagatcgagtcaaattagccacatatgcgctacctcagccaaaaccgggatcccgagggaccttatttaaacggtttcataagttggacgacctgtcgtacccgttttgcgatcaaggacgaaaatcggactggccggcaaataaaggtacccaaagtgaacttattcccatcaggttcgacattatcaggttgggccttggttaattagcacaaatcgaccaagcccaagacggcaaagcaccatcaccttccttccgctctcgctctcctcaaactttcgagctcgtcgcggattctccagcatacagctcgagcgcggggtgggtcgatccgaggcgctcctcgcgtactccggtaggttcgttctcctcccacattttgcttccctcgtcccgctgttcgtcgccgacgcgggggttggttgatcgcgcgcttggtgggtttcttggttcctgaatccgcggcggcgcagttcttggtcctcgccgaccttttttttttttcttgttggagcctctccatatggttctctcctcttcgttcgctttcttgatccattcctagtccgtagggttcctcttgcgattattgacgggttcgagttggcccaaatgttgatttctcttggcgattttttctttcttgttctcctcctcttttcctctctcgattcactttgtacgatttcatcccctagtccgtactggttctttggatttatggatttacgcgagttttttttctcttgtggttgttgcaattccaggtgtgatgaacgaggagaagagggcgagggtgggggatactgccgagaccccgcggaaatcccctcgcctggatcggccagctgcggcggcggcggcggcggcgccgttaaccagcaacggtagtattctgcggtgccaacacgtctttcgctttcttcatcagttcttggttcatcacgttcatcagttatttggggtttatggatttacgcgagattttttgggttcctgcaatttcaggcgtgatgggcgagaagaagaagaagaatgcgacgcgggatgtgagcgattggtgttggtgggggaaagcggcggcattactatccggcggcgaccgccgtactcgacggtgccgccatgtcttgtgtgagcaggctgacattgatgtggccataacactgatcaagacccgcgttgacaccccggtgtgttgtgttaacaagtgtgatgatactgaggggagggaaatctcggtgtgtttggattgccagttgagtttctgcacggcacacgggaagccgcacgtctttatgaacgaccattggattgctctggtgtacaagaggcccaatgtggcgcattgcttcgcgtgtgaagagtgctatttcatcagaaccgacagtctcggggagggaatggcggtcggtgagaatggcttctccatcggtacccataagaaggatgagaagggaatgacgacggtcaacaatgaggcaggtgttcatgcatctatggtgtctgattatgaaagcgccctcatggtggctttactcagtgatgtcggtactccacggtgcaggcatgacatgtataacaaggatgaggttgatttggtccaaagacggatcatgttctgcgatatcaccagaatgtgtagtgattgtgacaacatcagtgtgcttatgatctttgtgtgcttgggatgtgaaaagcctttctgcactgtacactccagtttacatgctgagagcaccaagcatttggttggtctggtgtaccataacccgtatgtggcgtgctgcttcctgtgtagtgaaacctttgtcctcattggtgagggggataagaggatgccagttgacaaagcggcaggtggttatgcatctgagtcagttattgggcatgcccatgctatcaaagggataccgaatcttggaaacacttgctacttgaattcattgatgcagtgcctccttgtgcttggaaaactgcgggcaaggatgttaggaccggacgctccatcagggacccttggtactgcattgcatgacctctttgagcaaacatacagtgtgaataatgcaacaggcctgctggagacgtcattgctcttggattgtgtatgcaatttggacccacagttcgtaggaggttttatgcatgataaccatgaattgctttgctgtttacgtaaaaatttggatgaggaggagaggatgaggacgcctcctaacatgcaagacagttctgctggtgcagtgcctctacggtttttaattccattttcggtggtcagctatttgttaccagatcgtgcaaatgttgctcgttttgttcagtttcccacgctgtattctatgatctctcagtaccagtaccaccgaagaagcctccagccaaaagtgttgaatcaacaccatggattgaaggtcacagatctcaaccgaagatttgtatcaaccagtttgaagcaatacataagaggaacacagaaaagactcatagaattgttgaagatgccgattctgatcctgcttcagaattgaaagatatggtcatggtgaaaacatcagagccattggaagttggtaagttcatgcgctccgctcatgtactgagtaaaggaatggaaggcaatattaaacagtcctgcaaacgtgcatggtgtatcagaagtcagaacataaaacttttcatgattgaaagcaccaaactatggtagtaccacaaatatttgttactagcttttgttctagagaagacaaatgtcactttgcaaaatggtgctcttgtactagataaatgaagaaacttgttcaaggacttgattatacatggactgcagaaataccagaaccttcaggatgtctacattagacaagcaggatgtttcagcaaatttaacatggcatggctttttgttgcagtgtaacagtaacacttattattcacccggggaagatagctatgggtgttgaatgctcaatgcttcaactcttcatataataaattttgctcgaagttgttggttgacaagtacatgcagagatcttgaagaaaagaaacttcaaataatcaaatgtagaggacaaagattctcaaaccatgtagagaatggaggttgctcctttcatgaaggctgatgaggacaaaactaaaaacctattttcttgattctgcagattatactgaagtggaacagatctcacaaagcaaggactatgtacaagatcctcaaaatgtgttggctgatgtcaaaactgcaggaatggatgcgacaacaacagatacccgcattccagaatatatagggccacatccacctgtctctcaattaagggaagagaatgcacagttagaatcatgcaatgatgtggggaaagatggcaatgctattctcgaagttagttcagaacacaagatagacactttctcagcagaagttactacagaagacaaggggaaaacttgcagtagtgacgttgtttgtggaaaggcacaggatatcgactctcttccatcgattacgagtgcttggaactgcactttaaagcagagatgatagaatggacctgtgagaactgctccaaaggtgctcggaagtcagatgtcactgaaggtacatacagtgaacagatgctgtcaagtactaatgaggacacagcagttggtggataccagagggaacagtcagagaagataacatgccaaagtgagcaatccaacaaaaaacctgaatgccctgaaggtgttcaagacgctgtacctcattgtgtcccagctgagagacaggacaacctgttgagcagtcaggatcaaaatgccaccacactagatgaaggaaggggtaagcaaaagcttcatcatagtgcacaccaagtcgaagaatgccaaaatgagcagaaagataggaataaaggtgctactcaaacacggattagcaagttgccacttgtgttaaccattcatctgatgagatctttgttggggcctgataaggtgatgggacatgtgagctttaaggaaatccttgatatgggactgttcatggaccccaggtactgactactgcattttttttaacaaaattgtaactgttagcatttctatacagcaacttctaatgattctattccagtttaatcattttacttatttgcagtaagctaatagatattatttttcctaatttgttcctttgctttaagaatgcatctcttctacaatgagttgctttcagatgacacaagcattgctggtcaatgaataatctgtatgcccatttttcatgttctcttgctatgagtatgtcgatgattttattgtgcatgacaagatgttgtccagatgcctcgtgtaatattgaccataactaaataagacaagatgtacttattgatggctatgtggctccatctgctagtaattttcacagattatgatgttttgtgacaatttgattgtttcaactttatttaggaaattaggtgtgatttggattttataataatttgaatttgtgtgattttaagaactagatttgattgtagtattgtactctactcttgttttttcctatcctttaaagtcagattatacatccttagactaaatctaggtttgtcgataatatccatcatgctgaccaaagttaattcactgcagcagaacatcatttacttttatttggatacctacctccttttgttttgaaaaatcacaatctccttaagaaaccatccattacgatttctcgataacaatattcatttacaatgatatttaacctagaaagatgtgctgttgtttacatcgagctatatgagttaaagccacatctgctttatttttatttttttagctctgaagacaaagataattccatttatcgtctagctggtgttattgagcaccatggccgcggcaaagattcagggcactttgttgcttatgtgagaccaagtcctcggcagcagaccaatggttcttcctcatggttttgtgcaagtgataccgacatcagagaagtctctttagaagaagttctcaagtgcgaggcttaccttcttttctacgagaggatggaaggctgagatgtctggaatctatatccacaagctgctaatcagaatagcaatcaaaaggattctttggatgtccaaatatccaatttttgatttgttcgtactcacgttggatcaaaatcaagaagagttttgtttctttcagttgttcttaaatagctggtctgatttgtgcatatccaattctctcctctctttttttttggataagtgaggaatgcagtagggtttcatttggaaaaatatcagcatagtaggacatataggccttggtacagttttgtaggacggtactgttatttacgattgctttgcagtactggggaaattttggaacacattggagtatttgatttgatacgttgtgcttttcctcaatgtttttgttatggcaagctacattgtatgcaagatgattcaaatacaccttgaacttgaagtatcagtaacaggagcagcgttaccaaacccgtttagagtggggttaccgctgctctacggtttgacggttaccgcgaaatataccatggttttaaaaattgaaaatgttatcacacatgataaccgcacggttttataaaccctgaacatgatggcattaattttgccttcttttttcctttcttcattactccaaaaaaaaaatagcctgtttgttgtcggccttgtgggcttatggataaacccatacctagattgggcccataactccatgagtcagaacgatattggcccattagcccacgattaaaataagcaggctttttactcacgaggtcacgcatcccggctgattaacagaaagaaataagtccacttgccatcctcaacttacgtcgggtttaattgacatcctttatcctcaatacgagaaatattttcccctaaactatacataactgtacaacttgagtcctatagcagtagcaatacgcgcgtggcctggcatccctgctcatcggggcaggagccagccgcgtcggcagccaccatgagttaagaccgtagctagacggtgagaatggccattgctttcatttgaggagtggtgtggatatgggcatgataaatggcatcgtcacggagatgcctctcctcctccatggtggtcgccctccaggacggagcagggctcacggggccacctccgccttagagtttatgtccatcttcttcggcaccgtaaggagcggcgtgccatagtggaggaagctcgctggcccccttgtctccctcctcttctcgaaaaagctcgttggccacctccacctcactcgcatgaaggctaagtgagctcaagctcggacgagcttgccgaccacctccccctccctatcctgcctccgcctttctcgcacgcaggccgcttgagctcaagcttggataggttcgctcgctgccttcctcaccgccaccccataaacgcgcatgcgtggtttggggaaaaaaaaagagggtgaagaaagaagttgtggctgacatgtgagtccaatgtttttttttacttcttttgctgattaggatgccagtgctcattctacctaaattagacggttttgcgaaaatgaagggtggtgattggtgaagattcctagtatttatagggatttcaattaaacttgatgtaaagaagagggatgacaagtggacttatttctaacagaaatcgtccaagcccaccatcctcatcaccaccaccaccaccgccgccgcccttccgctctcgcctctcgcttcctcctccctccaactccaacttctcctcgcctcatcgcgacctctccatctcgctctctgctcgattccgagcggctcctcgcgtgctctggggtgagtcttcgcccccgcatttcctcccctggtcctgctgctcgtcgccgagtggtggttggttggttgatcgcgcatgttgggttttcttggctcccgaatccgcggcggcgctgttcttggtgctctccgggatgtccggtttcgccctgtattgttggcggggttctctctgcatctcttcttcgttcgatttcttggtccattccttgtccgtagtgttcttcccgaagttcttgattgatgcgagcttgatggcccaaatgctgtttttttttcttttgtttctcctcatttgctttcttggtttcatgagtccatcccctaatccgtactggttctttggatttatggatttaagcgaagtttttttgtcctgtggttcttgcaattgcaggcctgatggacgagaaagcgagggccggcaaatccccacgcctgaagcggcgctcttctggaagcgatccgttggaggaagcggcggggttaaccagcgacagtagtagtattcggcggtgccggcacgtctcgtgtgaccaggctaccattgatctgggcatagcactgatcaaggcctccattgatggcccagcgtgtgattctttcaagtgtggcaccactgaggagaggggaatcttggtttgcttggattgcggttcgagtctctgcgctctacacgcgagatggcacgcccggatgaaccggcattgggttgctttgatgcacaagagacccaatgtggcgtattgcttctcatgcgaagacgcctatttcatcagccgtgtgaggtttggggggacggccgatgaggatttcttcccaatcagtacccctaagaaggatgagaagggaaataaggttgacaatgaggcaggttgtcatgcatctgcggcgacaggggctggttctggaggcggcacaatggcggtgttaaccagcaatgtcagtccccagcggtgctgtcatgtgtataagaagggtgatgttgctcgggtcataaaaaggatcatgttaagcgatatcgccgcggcgtgtagtgattccatgtgtgataccactgggaggagcctgatcttggtgtgcttgggatgtgaaaacccgttctgcagtggacatgccgatgtgcatgccaagagcaccaagcactggaattatttgatttaccaaagcccatatatagtgtgctgctttgtgtgtaaaggcatcgttttcctcggtggtcaggataaggaggagatgccagttgacaatgcaacagctggtgatgcatctgggtcagttattgagcatgcccatgctatcagagggataacaaatcttggaaacacttgttacttgaattcattggtacagtgcctccttgcacttggaaggctgcgggcaaggatgttaagacctgaagatacaacggggaggcttggtacagtactgagatatctctttcaggatacggacagtgtgaataactcaggaggcctgctgaatccaagtggcctcttgcgtagagtacggatgtttgtcccagagtctcaagtcacttctatgcatgacagccatgaagcgctttgccgtttgcgcactaatttggatgaagaggaaaggttgatgaagtatggtgctctcagtgtagaggctcctaccgtcattgattccatttttggcggtcagctgtctgttaccaagacatgcaaatgctgctcacttagttcagtttcacatggtatagtattccatgatctctcaatgccaataacaccgaagaaacctctagccaaacgtgttgaaccactatggatcactaaaggtcgcagatctcaacggaagaggaacacagaaaagactcatacaattgctgaagacggtgattctcagaatgtcatggtgaaaacatcagaacctttgggagttggtaagttatgtgttcatgtacctaaataaaggaacagaagggaatgttgaacaggcctgcaaaaacgtgcatggtgtctcagaagtcagaacgtaaaactatgaccgaacacaccaaactgtgatagtaccactattatttttgattttttgctccagacaagaaaaagggcattttgtagaatggcactgttttactagataaatgaagaaacatgttcaaggacttgattatacatggactgcagaaataccagaactttcaggacgtctacattagacaagcaggatgtttcagcaaatttagcatggcaatgtttttcgttacagtgtagcagttattggcactgggaagatagctaagggagttgagtcctccttgtataataaatattgctccaatttgttggttaacttaagtacgtgcggagatcgttgaaaaaaaaagaagcttcaaataatcaaaaggaagtttgctggtttcatgaagcagctgatgaggacaaaactaaaattttatttgcttcattctacagattctactaaagtggaacagatctcacaaagcaaggatgctgtacaaggccctttgcagattcagaaggataaggtccaaggaaaggctgttgatttccttcctcaaaacgtgttgtcggatgccaaagttgagggaatggatgcaacacgagcagattcccacattccagaatatcttgctccagctccaaccttttctccactaagggaagatgatgcacaggtagcattaggtattgatgtggagaaaaatggcagtgctgttcggccagaagttagtactgaggccaaggtgaccacttcctcagcaaaagttactgcaaaagacaaggggaaaactcggagtagcaatattatttgtaacaaggcacaggatataaactctcttgcgtcgattgaggagtgcttggaactgcattttgaagcagagacggtagaactgacctgtgagaactgctccaagtttgctcagaagctgaataaaagtgtaattcaaacacgtcttagcctgctgccacctgtactagtcattcatctgaaaagatcattgttgcagtctgataaggtgaaaggacatgtgagctttaaggaaatccttgatgtgggactgttcatggaccccaggtactgattactgcatttatttcttttttcgacaaaaaatgtaaccgttctaatgattctctgccagtttaaataagtttctaatttgtagtaagctaataaatattatttttcctaatttgttcgttttgctttaagaatacatctctcctgcaataggttgcttttgggtgacatatttttcatgctttctttctatgagtatgtggaattgtggattatttgtactgtgcatttcagtgtgtcatctagatgcctcgtgtaacattaaccataactaaataagacatggattgcttgttgacggttttgtggccccccttgctagtaattttcaacagtacgctgttttcctgcgaaatgaaaacaaggtgacaatgtaaatgtttcaactgtatttggggaattatgtgcgatttggattttagagtaatttgaatttatgttattttaaggacccaattttgattgctctctactctcttgttctttcctatcctttagagtcaggttatacatcctcagagtaactctaggcttgttgataatatccatcatgttggccaaagtaaattcactgtagcagagtatcgttcactgttctttagatccttgtcttttaaaataacagcctacataaaaaaaccatccacaatggtttctcgctaacactatattcatttacaaagatattttagccaagaaagacgtgctgttgtttacattagaaaagtcttacgcctggtctgattttcccccctctaattttcagctcagtggacaaagataattcaatttatcgtctagctagtgttattgagcaccatggccacggcaaagattcagggcactttgttgcttatgtgagacaaagtcgtccgcagcagaccaatggctcttcctcatggttttgggcaagtgacaccgacatcagagaagtccctttagaagaagttctcaagtgcgaggcttaccttcttttctatgagaggatggaaggctgagatgtgtggaattctatatctaccagctgctaattagaatagcaatcacacaggattctttggatggccaagaatccagttcaaatttgtacatactgactgttggcttgcgatcaagatgatttctgttgctttggctgagtcattgcaggacttcaatttggccgcaacatatacgttccagatttcggttgttctttgactagctgatctagttacaggcattcttatctacctttttgtccgagaagaatgcattaggcctttggtacagttttgtcggattgtactgttgttagcaatttctgtacagtactatggaaaatttgtaacatatcatttgatttgttgagctacactgtatgcatggtgattcagatactcgttgaagtagcaataacaagagcattctttctttcttccattgctttctggaatctggatgaacatgacataacatgccaacatgggagggtgagaacatgctgttccaatggtcaccgttgattctgagatatcgtgcgttctgtttagcatcaccgttctcccaaaggaataatgaggggagggattatttttcttttcatttttaattacatggaggcatgtggaaagtgcaaacacaccaccacagacgcataccacaccacacactttatttttcttcagatcaaaaaatcagactagatatgaaaaacatataaaaaaaaagaacaagttttacagaatgagacaacactcggcgtgagtttgtttcttcgtattcctgacctccacttactccttttccatgcacacgcttcctaaactgctaaacggtatgttttttgcaaaaaaaattctgtaaaaaaattatttaaaaaaatcatactaatctatttctaaagtatttttaataataataatttttaaaaatatttttaataatattaattaattaatcatagaaggtttccaatcctagcaattaaacacagcctcaatatcgttacggcagtagagcaagacgaaagcccatctcatcgttgggcccggcccatcatgccgcgaggccaggacgacctcggcccattaggcccacgatcgatgaataaaacgcagggctcacgcggtcacgaatcccggaggtgattaacacaaaccggccaaaaagcccaacgcgccgcacgccaccgccaccctcttcttcctcctctcgctccctccctcctccgtctccgccttctcctccaagcttcctcctcggcctcgccgcgcgcgagccctcgtcgccggattccccagctcgagcgcgcgctgggttcgagattccgagcacgcgcgcggtgctccggtgagttctcgcacccgcatttcctccccccctctctctgtgatgctttgctgctcgtcgccgacgcggggggtttgatttgatcgcgcgcttttgggtgggggtttattggttcgcgaatccgcggcggggcgcgggtggttgctggtcgtcctcgccggaatggttcgattattggtggagttctctctcggtttctccgattatttcggtttctagtccctagaatctcctcgcgttgttcttcccttgcttaattaatggcccaaatgctgctcgccccttgctctcctatggtggagttctctcggaatttttttcccgatttctttcggttttttcttggtttggttgctcctcgcgctgttattggttgctcctcgcggtctccttttttggtgaactcatgcggcgtgctttgaggtttatggatttttccctaattcgttctggttttcttcggggtttattgattcacgcgagattttttggcttgtggttgttgcaattgcagacgtgatggacgacgagaagaggccgagggtgggggatactgccgagagcccgcggaaatccccgcgcctggtgcaccgaattccgacgacgacagatcaggccgaatctggagtcggtctcaagtccttgcttgggttgatcaaaaacaatccgagcaaggagctcgatgacccaaatgctgcctctctcggtgaacttctatgatcttgttctcctcctcctcctattttcgctttcttcagttcttggttcatgttctcatccctagtccttaccgataatttggggtttctggattcacgcgagtttttttggcttttgattcttgcaatttcaggcgtgatagacgtggagaagaaggcagcaaggccaggggatactgcggcaacggcgctggatgtgaacgattggtgggagaaagtcgtggcgttacaatggatggcatcggtcggcggcgactgccgtgctcggcggtgccggcacgtcttgtatggggaggatgacattaatttggccatagcactgatcaagacctgcgatgacaccccaatgtgtaatgctgacaattgtggcaatactgaggggagggaaatctcggcgtgcttggattgcgaatcgcgtttctgcactacacacgggaaatggcacgcctcggtcaacaagcattgggttgctttggtgtacaaaaagccacatgtggcgtattgcttcgcgtgtgaagagtgctatttcatcagaattgagcattttggggtggtaatggacaacgaggatgactatttcatcagtttacgtgaggaggatgagaagggaatgagagttgacaatgtggcaggtgatcatgcatctgggtcagttattgggcatgcctgtcctattaaagggatacgaatcttggaaatacatgctacttgaattcattgctgcagtgcctccttgtgcttggaagactgcgggcagggatattaggactagatgctccattggggctccttggtagctcactgcgatctctctttgatgatgcagacagtgtaaataatgcaggaggcctgctggacccagagaagctcttggcttgtgtacgcatgctgaacccagagtttaaaggcaatggtatgcatgatagccaggaagcactttgcattttgcgcactggtttggacaaggaggagagggcaatgaagctgtctaacatgcaagccggtgctcccagtgcagtggctcctacagttattgattccatttttggcggtcagctgtctgttaccagttcatgcaaacattgctcagttagatcactttcccatgatgtattccatgatctctcagtgccactaccacaggagtctccagccaaaagtgatgaattatcaccatggactaaaggtcgcagatctccacggaagattcgtatcaacctgctttcagcaatagacaaacacaaaagtgacaatgaaaagactcagagtcctgcttcagaattggaagatgtgttcttggtgaaaagatcaaagcctttaaaagttggtaagcttatatgcttgtgtgcttaattaaaggaagggaaaacaatgctgaacaatcctacaaatgtgcatgctgtctcagaagtcagaacatagaacttttcatgaatgagcacagcaacctttgatagtaccagtattgtttgttagtttttgctcaagataagaaaaaagggcattttctggaacggcgctatcgtactagctacatgaagaaaaatgtttaaagacttgattcatacatggactgcacaacaggatgtttacattagcaggatgtttcggcagttttaacatggcatagatttttgttacaagtgtggcaataattatcaccaaggggagatagctcggggttttgagtccttgttttcgtataataattttttttctccaaattgttggttaacttaagtacatgtggagatctttgaagaaaagaagcttcaaataatcaaatgtagaggataaaggttctcaaaccatgtagagaatgaagattgctggtttcaggaagtagctgttgaggacaaaactaaaaacttatatgcttgattctgcagattctaccaaagtggaacagatatctcatagcatggatgcaggtggtcctttgcagactagaaaggataaggtccaaggaaaggttgttgatgtccttccccgcattccagaagatcctgcttcaccatcatttgtttctccactaagcgaagagaaaaatgacagtgctgttcaaccagaggttagtacagaagccaagatgaccgcttcctcagcaaaagttactacaaaagacaaggggaaaactcagattagcgatgttgtttatgacaaggcacatgatatcaactctcttgcatcgattgagaaatgcttggaattgtatcttgaaacagagatagaatggacctgtgagaactgctccaaagttcttaagaagccaggcatcatgtcaagtactaaggaggacacaacagctggagaccagagtgaacagttagagaagagtgcacaccaagtggaagaaaaccaaaatgagcagaaagataagaatgaatgtcccattcaaacacgtcttattcgcaagttgccacctgtattgaccattcatctgatgagatatttggaggatttaacgaaggtgataggacatgtgagctttaaggaaatccttgatgtggggcagttcatggatcccaggtagtgacaagtgacaactgcatctgtttttttccgaaaacatatgactgatgatgtttattagatttctgtttgttctatgcccgtgtaattaagtttcttatttgtagtaagctgataaatgttatttttctcaatttgttcccatttgttttacacttctcccctaaaagaatgctttcagatgacactagcattgcaggtcaaagtaatttagtccatttctcatgttttcttgctatgagtatgtggattattgtatggtgtgtcaagttgtaatctagattctagatgtctcctgtaaaattaaccatagttaaataagaaatggtgtgcttcttgatggctgtctagctccctttgcaagtaaatttcaattgttacgctgatattatgaaatgattacaacgaaacaaggtgacaacgtgaatgattctgctacatttggggaatttaattgtgatttgggtaatcaaataatttgaattttgggtgattttaacatcccgatctgattgtactctcttgctcttgcctaccctttacagtcagatcagatcatacatccttagattaactctaggctagaagcttttagctctttttctttaggggtgtgccttcaaatggctaacctggaaacctttttattttgttagaagtccgggctgttcgatatagttctgttcttgtttcagtattttagtgtatgatggatataaacaaacctaacattttccattggattgttgaaatatgactgtttatttgttgattttcataacatcatggttatttgcttaagatgatttagaccagtctttttaactgacagatatctcgctaacaatattcagttacaaggacaggcgttctgttatttacatcgagctataatgagttaaaagccttagatctgctctgatcatctttattttctctaatcttcagctctgaggacagagataattcccgctatcgtctagttggttttgttgagcacctgggccctagcatgtatgcagggcattatgttgcttatgtgagaccaagtcctccgcagcagaccaatggctcttcctcatggtttcgtgcaagtgataccgatatcacagaagtctctttagaagaagttctcaagcgcgaggcttaccttcttttctatgagaggattgaaggctaaggtgtctggaatcctgtatccaccagctgctaatcagaatagcaatcacaaaggaagcagatgttttcagattatcaagcattatttgggcacgaaggattcaattttaatcagtgtacatactgtactgacgtaggctcgtgatcaagttgaatttcgttgcttttgtctgagtcattgcatgagcgcaacacgtacataccagttgagagatttgggttgttcttgaacaactgattatttccacttctcttttgtccatgaggacgatattaggaattcatttgaaaagaaaacatcaaagttggacattttgcattagaggattgagcaagatgaatatataggcactggtacaattttgtcggatgttactgttacttgtagttactttacagtactgtaaaatcaggaacacattttcttttataccttgagctttgcctcaataatttttgtgatggcaagatacattgtatgcaagatgattcagatacaatcatatatcttgagaagtagtagagataacaagagcaattctttggacctatcttttctgaacggatacaatgttttttttttgaaaggaaagaatggatacaatgtgacatgcaattagagtatgagaccctactgctccgctgatgtcttgatgatgagatggacatttgctttgtttgcatcactgctgttcttctgaagcaatcaagaggaggatttgtttttaactaactctcttggaggtgtcaatttatagcgttggtgttgcccaagtgttgtgcaatcgagttggcctgacatcacgaatgaaaaaactgaacctcatttggaaaagaaaagcataaaaaggagaacatggaattctggaaagagggttcttttaagtaaatttaagataacttaaagttgcataatccaaccttagtataacttgtggcatgcaaccctgaatttctgatattatagtcccaggattccagaaaatccacacccatataatccagataatatatttaattaaattttcatgccataaggtgtctacagaattttaaattatttgttttttaaaattcagatgattgggttaactctctattactttgaaatattatttcacatatcataaactctgcggttatatgccatgagtatatacatgctttctattaaaaagatactaaatgctatttctagcatagtagtttttccaaaaatgaagctatttatctacccacctgtcatcatctttaccaatcacacacattatccactaattttctcatctactttctctacttaactaatcacaactttccttcattattttcacctacttttttaatatccgtggtcaaaccattttaggacgaaggtagtatacgtgacatttcgaaatttactttcattttttacaggaggaaatatatactttccatgggctccgttgaactcacgacggccacctaggcccatttagcccaatatacacccacccgagcgccgccgtccccgaccagcgacgccgccttcgccgctctccccccctcctctcctcctccaacttctcgccgtcgtcgtcgccgtcgccgtcgcggacgcctcaccccgcggcgctagtcgactccgggtcctcctcgcttcttccggtaagtttcctcccacatttccacacaccccctaaaccccgctgttcgtcgccgatgggcggtttgatcggtgggtgttggtgtttttttttctattttttttggtgtgcggattcgccgcggcgctgttcatgttcgatttccgatcctgttggtggattctcactttttttttggctatgttgattgatctcgctaatctgtagggtttgaattggggtttaagacgcgatggaagaggggaagagggcaagggcggcggatactgccgggagcccgtggaaatccccgcgcctggagccgccggctgcgtcggcgtcggcggcggcggacgattctgagtggttccaggcgatgttgctggaggccagcggcaccggcgttgagcggtgcgagcacttcatgtctgaccaggatcacgtcgattacatcgtgtcggggctcaggttctccgaggacgtcccggtgtgcggtgattacacctgcgacgtcaccgcggcgaacgatatcatggtgtgcttggaatgcgagttgcgcctctgcgccaaccacgcctgtatccacgccatgcacgaagaagagcattcgattgctttgtactatgagagattgaatcgggtgtactgcttcaagtgtgaagaagcctatgacatcggtgttaaggatgatgatggggggatgactgacaacaatggggtgccgcgcgaagagagcccagcgaaatcagcgttaaggatgatgatgggggaaagcctacgacagaggtcacatgtgtctgggttagctgatgggcatgcccatgctatcaaagggatactgaatcttggaaacacctgctacttgaattcattggtgcagtgcctccttgtgcttggaaagctgcgggcaaggatgttaggaccggacactccactggggacccttggtacaatactgtacgatctttttgatcagacatacggtgtgaacaatacaggaggcctgctggacatgacttggctcttggcttatgtacgcaagtcggactcacggttcataggagcttttatgcaagataaccatgaattgctttgctgtttgcgaaaaaaattggatgaggaggacagggggacaaatcctcctaacatgcaagatgatgcagtgactcctacagttactgattccatttttggtggtcagctgtcttctcacatatcgtgtaaatgttgctcatttagttcagtttcacatgttgcattccatgatctctcggtgccccttccaccaactcaatccaaaagtattgcatctccaccgaggactaaaggatataaatctcaacagaagatccatgctgaactagaagttgacaagcgtaacccagaaaagattcatactattgctgaagacagtgattctcaaagtccttcagaattggaagatgtggtattggtgaaaacttctgagcctttgaaagttggtaagtttatgtgctcctgtgcctaatgaaaggaaaggaaaacaatgttcaacattcctgcaacattttttttaacagtgcctgcaacatgttgggtgtctcagaacatggaatttttcttgagtgaatgcagaaaactctgatattaccacaattatttgttagtttttgctcaatataagaaaaagggcatttttcggaaagagttaatggcttgactgttaaatatactacagaaatattagaacctgcaggatgtttctgcaattatagcatgtcatagctgtatgttacagtgcagtagttattcttgccactggaagatagctctaggtttttgagttctccttgtcttcatataataaattttgctccaaattgttggttaacttaaagtacacagaaatccttgaagaaaagaagtttcaaataatcaaatatagaggataaagactgtatttcagaccatgtagagaatgatggttgctgatttcatgaagatactgatgaggacaaaaaaaattatatgcttgattctgcagattctactaaagttgaacagatctttcatagcaaggatgctgtatgtcgccctttgcagactcagaaggataaggtccaaggggagactgttgatttccttcctcaaaacatgttacctgatgtcaaagttgaggaaatggatttgacaaaaacagatgcccatgttccagaagatatagggccttcactaaggaaagagaatgcatggatagaatcaggaagtgatgtagggaaaaatgtcagtgctgttcttgatgatgtgttcagtgagccagaagttagttcagaagccaagactgacactttctcagtagaagttaggaaaagtcggagtagtgacatttcttgcgataacgcgcagggtatcaactgtcttgcatcaatagacaagtatttggaattgcattttgaagcagagatggtagaatggacttgtgagagttgctccaggttgctcagaagccaggcatcaatctaggtaaatacagtaatcctatgatgtcaagtaccaatgaggacataacagttgatggagaccagagtgaactgtcagagaagataacatgccgaagcgagcaatccaacggaagacctgaatgccatgaaggtgttcaagaagctgaacctagttgcattccagctgagaaacaggccaacctgttgagcggccaggatcaaaatgccagcatactaagtgaggaaaggggggagcaagtaaagcttcatcatggtgcacaccaagtggaagaaaaccaaaatgagcagaaagattggaataaaggtggaattaaaaaacattttattagcaagctgccacctgtattagtcattcatctgatgagatctttgttgggacctcataaggtgataggacatgtgagatttaaggagatccttgatatgggtctgtttatggaccccaggtaccgtcgtaccgatacctcatctctgtttttttttttttgaaaatatattggcattggcgttcaacgacttctaattgtgttaagccaatttaaatatctatcttattggcagtaagccaattaatattttttttattaatttgttcctactttaagaatacacctctagcacaaaatgatgcttttagatgacaccagcatttcatatcaatgagtaatttatgtttccttgttctgctgttatgagcatgtggattgttgtactgtgtgtgcaatgctttttatttgtccaattcaacctgtaaagctctaaattgagcaatctcctgttccacgcaaaaaatgaattgacaccagagtaccagactgctgtattttcctggtataaccagttcgttttgtgtagcataaaggttgtttaggacatgggatagcactgctcttgtttcttgctgacagaccaacatggattaatgataaaaccaatgttttaattgtcatgggagcatttggtatggaatagctcattaagtaggcaatgagacaatttggactatgacaaattggcagtaaagtgaatagacattcttaagctgcagcagatcaatgaaccccctcccacatgggatttactgaacattattaacccatttaggatttttccctaggtgcacctgtgaatggctgtctggcacccttgctagtaaaattttgaatggctgtctggcacccttgctagtaaaatttcaatggttatgctcttattatgtgaaatgtgaaaaaagaaaacaaggtgataatgtgaatgattcaactgtagtggggagtcaagtgcgatttgattttaacagcatggtttgactgtactctgctttcttgctcatcctacctttagagtttagagtcatctattgtacaccctctctaactctaggtgtgtttatatgatatcacactcatttcctacctaaatcaacccactgtaacagagtatcattgactacactggattttttcaatcacaatctaattaaaatccaatttataatatctaggaacttctattctttccttttcttttgtcggtgtgtgccctcaaataactaaccaggcagcacttttatttgttaaaaaactgaattgtttgacatactttttgtttcagtatttttagtgtatggtggactcgtaaacctaatacctgtttaaattatcacagtgtgtcttatttgttgattatttttgtaacattacatggttattcacttaagatgatctatactagtagtattttgtataatagaataattattaacaatattcaatacaaggatattaacacaagaaagatgtttgctgtttacatgtagctataatgagttaaaatctgcttttcatcgttttttattttttctaatctttcagttcagaagacaaagataatctcagctatcgtctagttggtgttgttgagcaccgcggccttggcaacgatgcagggcacttccttgcttatgtgagagcaagtcctcggcaggagaccagtggctcctcctcatggtttcgtgcaagtgatgacagcatcagagaagtctctttagaagaagttctcaagtgcgaggcttatcttcttttctatgagaggatggaaaactgagatgtccagaattcaactaatcagaatagcaatcacaaaggaagcaggtgtgccagattgtcaagcgttctttggacgaccaagaatccaattctaatcaggttaatttggctgagtcatttcagggcttcaatttgatcgcgacatgggcatgctaagggatttcagttgttcttgaccatctgatctgcttacatgcatgcatatccatcctttttatgttatgaatgcgttaggattccatttgaaaacagaaattagtatagttggacatatagcgttagagaattgaacaaggttactatataggcacaggtaacagttacacccctggtacagtttttgtggatgttgctgttatttgcaattactttacagtactatagagaaatggaacatttactttgaaatttgcctcaatatttttgtgatggcaagatacatcatatgcaagatgatacaaacttgaaccttgaaatagcaataacaagtgcactttttttttctttcttcccttgttttctagatggacattatgtaacacctaatgatctccaattctccattgatgatgagagacatgtgctgtgttagcaaaaaatattttctccctaacaggccccatatgggtagaggaaagaacaaaaaaaaaagggggtccattttatatgttccattcatatttctcaatcgc

SEQ ID NO: 46313 - DNA, 13244 bp, Oryza sativa
atgacatatatgacatgctgttgaaaaagtgtggcgagtcacaactgtgacagtgaactaaacacatatctaacaaactgtggcaataaaaaatgtagtgtggcaaaatgtggccatgaacctaacacccctgcatcaactttaaaagttaaagatgctggttctgtggttgaattatcggtggggagaaggcccagttaatgctacttgtcgtctcatttaatttgctatagtccacaactaacgttaggcaagttatggtagtcacaaaagtgtggtgaataaattgctagccacagagtgtggtaaaattggtaagaaaattaagtctatgacatataggacatgctgttgaaaaagtgtggcgagtcacaactgtgacagttaactaaacacatatctaacaaactgtgtcaataaaaaatgtagtttggcaaaatgtggcaatgaacctaacacccctgcatcagctttaaaagttaaagatgttggttctgtggttgaattatcggtggggagaaggcccagttaatgctacttgtcgtctcctttaatttgctatagtccacaactaacgttaggcaagttatggtagtcacaaaagtgtggtgaataaattgctagccacagagtgtggtaaaattggtaagaaaattaagtctatgacatataggacatgctgttgaaaaagtgtggcgagtcacaactgtgacagtgaactaaacacatatctaataaactgtggcaataaaaaatgtagtgtggcaaaatgtggccatgaacctaacacccctgcatcagctttaatttgctgtggttgaattatcggtggggagaaggcccagttaatgctacttgtcgtctcctttaatttgctatagtccagtaggacatcctaggtactcactactcagtccttcactcctttgtcgtcgattcgttcgtggtgctcttaaatatcttcgaaatatagggcctgttcactttggtgtcattttcaaccttactaaattttagtaaagttgccaaaaaagtggctacatttagtttgctgctaaattttggtaactatataagaaatcttgccaaaattttggcaagttaccatgccaaaatgccaaaatttgataaggtttttttttggcagcaaagtgaacatgcccatatatatcacgggttaaggagatggacggtttggatttcgctatcttttgcaaatcatgcaatagtttgtttttgttttttgttttttgtttttttttcggggataattgtgccatagttagtggcctctctgcctcactcgacatgaacaagaacagcagcagcaggaggagacgagggcaataacagcagcagcattttctgattcttctcaattggagagagtgctcagtgctctcctataaatcctactagcactagcacacccaaagcgaccaacgagtgatccgatccgatggacagtcgccgtcccttgcttattccgaatgagggtgacgagccgccgccgcagccgccggagccgccgctcgccggcgtgtccgacttccgagggcggccggtctaccgcgccacctcaggcggctggcgctccgcactgttcgtcgccagtgagcgtgtactgcgtataccgatgtttgttcggtttggttaattttgttccttaatttgcaaagtttgattagatttcatgagagattaattgattaatgaattgttgcagtgttggagatgggctgcagcttctcctactacggcgtgtcggcgaacctgatcagctacctgacggggccgctggggcaatcgaacgcgtcggcggcgaacgcgtggtcggggacggcgcgcatgctccctctcctcggcgccgtcctcgccgactccttctcggccgctacccattcatcctcctcgcctgcaccctctacgtcatggtaatattttatttattatttactatatattcctccatccatttgttattatttattgttaagattgtaaataaaactggtcactcttgttttttccaactcccacccaaagtcaatttgctgcaaaggctgacccaccaaatccatccgtgcacgcaaataaacaaaggctagatcagccagctcgatacctgttgtactctctgtcttaaaaaaaatataaattctagctatgattctgaatatttaatttttttagacggagggtgtagtttaaagcagaaagatgaacttgaataacttgagggttgaaggcaacggcgatgagccgatgagtagtgacaatcaactacggtcatgctctttccttcttattgaataatgcattataagaagtgaaattattattaaggataaaattgaaaaggttttgaataagacaactaacactccgtaatgataagtattttggaacaaaatttaaattctaaaaagaagtaatttaggataaaggtagtactattctaaagagaagtaatttaggataaaggtagtactatgggtacacgttggctgattggctccataatgataagtatttatcaaaaaagggtttgggtgattggcctttgtaacaaatcagcttttgagggtaaattcaaaacagaagtgataatttggtggtttattcaattttgtcaatgttaatttagtacttaccactcctcgatgaataataatggagtagcaccccgtatatgccagcatgtctgccatgaaattcgtgttacttctactaatactcctctgaccacttgttatattgcccattaacgtacgaacacaattagtaattgatagtacagtactagtaatcatcatcaggacaaaaatataatggaaaagatagaaatgtgcatatcgatctgcatctgcaagcaacaaagacgtggatgacgcgtattaattagtacaagcactgtcaaaagaagaaaactctctgctcacacatttggtccatccaattaattaagccctgtttgattcagcttataattattataatctagattattatgagtaagctaaaacaaacagatagcttattataatagattattataatatataagccagattactataatttggtaagccactctaaagatgcttattttagattattggatgactaacaactaacaaacagataataatccagagaaacaaacaactagcagcttattctatatcggcttattataatccagcttataataatctagttctataatctagattataataattttaagctgaaacaaacatggactaagtacttatatatctgaccctttcgcaactgagcgatcaaatcaaacactgtcaccatctccctgctccaccttatcttaatcctatcttaaaaatgttactcccactggtagagtattaatcttactcactaatatgcgtgcattcttaaaataaacaacaaatgtgatttaattgaaatgaacgtgcgtacgtccgttcgagagtgatcagtacccttctccgaaaaattcaaatacaaattttaaaaataaattaatttgatatttcaagcaactttatataaattttttttacaaagaatacaccattttaacaatttaaaaaatgctaagaaaaatctatatcttaagtagaattaaatggacaaaggttttgagaagaggagttattaggtagggaaacttgaacggcggaagattattattggttgaaaaaatgatatatatatatatatatatatatatataaactacgtacaaaggagttatattttatgataaattttaaaggtaaaaacttattactacaaatattttagaacggataaatacaaaattgattggatttcacgcgcatgggcgcatgattgcaggggcttggcatgctgactgtggcgtcctcgctgccggcgtgcgccgccaccgccgccgccgccgccgcctgccgtccttccatggcacaggtgatcttcgtctacgtttcgctctacctcgtcgccttcgctcagggattcgacaagccatgcgggttggcgttcggcgccgagcaattcgacccgggccaccccagggagagcgccgcccgcagctccctcttcaactggtggttcttctccatggccgtcggcgtcgccgtcgccatcgccgccgtcagctacgtccaggagaacgtcggctggggcgtccccttcgccgtcgtgtcctgcgcctccgccgtcttcctcctcggcacccccacctaccgcctctacgcgccgccccgtcccgacaccgccatggatggcaagcgatcgtcgtcgtcggaggaggatgcgcgtggcgcgctgcggcgcctgcttccgatatgggcggcgtgcgtggcgtacggcgtggcggacgcgcagatcatgacgctgttcaacaagcaggggcggatgctggaccgccgcatcggcggcgtggagctgccgcccgccgcgctccagacgatcgggccggcgaccatcgtgctgttcgtgcccatctacgaccgcgcggtggtgccggcgctgcggcgcgcgacgggcaacccgagcgggctgacgacgctgcagcggacgggggcggggctggcgacgtcgctggcggcggtggaggggcgccggctgggggcggcgcgggcggggcggcggccggcgatgagctgggcgtggctggtgccgcagtacgcgtcgatgggggtggccgacgtgctggcggcggtggggatgcaggagttcttccacggcgagatgccggaggggcggcgcagcgtcgggctggcgctctactgcggcgccgtgggcatcggcggcttcgtcagcgccgcgctcatcgcggcgctggatggcgtcaccaggagggacggcggcgaggggtggttcgccgacgacctcgaccgcggccacctcgactacttctactggctgctcgccggcgtcagcgccgtcgcactcgcgatgttcctctgcttcgcccgctcgtacgcctacaggaacaagacgctgcttgtaccatcaaacaccagtagtattaatactcatcatgcatgatactagtacgacggatcgatgcatgtacggacagacaatccagattgcagactgattaattgattatgcatcatgtaaataattcaccctctaattcatagtaattccattccatactggcatgctcaaaagcaaagcagtcatttgggtaaaaacttgctagtactccagttgtatcaagaagcaattgcttcttcaagatatatgctaaaacaatataaaattataattattttaaaacataaatagtactagtttctttctacgccacgtaggacgatagaccagatcaatgcaccacgtaagtagtttaaccaaaaccagcgaccaaggggaacttaatttgcactagttttataccttagttgtactctatattcgattttgcagttgagtgaacttttcaaaaaaaaaacaaacaaaaaaacaaaacaaaacacaaaagaactgccgctattcctcaattccacccctccatgtactccttccattatattggcgttcatccaaaacaaagcagggttaggtagcaaccatgcgatccacgcacatgaccacctctctaacaggaaactatttaaattttttttaatttttttaacaagataaattaatacgaacattcttaatttaacttttacatattgccaaaaaaactatttttactgttaatatacattaacaatttataatttaatttgttttttttaatttgtagaagttaaattttaacagtgatatatcacatatacttcttaattttttataattatttagatagcatgcaaacaatagagatatgccttctcgagagtttaaaatccactccctctttctttcgggattaggcacctctaccttcaaagaaacgtgtgtttgtcattgtgaacccgatgaaccatggacccacctattatctcaagagaaaatccaagaaataccattgacaaacacccaaatctaaaacatgctattgacgagtccgagtttccacaaaatattcgtacaaatgatttagtatcagaaatgccattgccgttaaggtttcgtccatcctacgccgttaaatgcattgtttattctatagcacttaatggaaggatgctaacggaaccctaacaacgatgatattttagagacaaaatctcttgtatattgatattacatcaaacttgtatttatccatgatatttgttggaatataaagtgaattgcccgccttttctcatcagcttaaatttttgggttgaactggtcggtgcatacaactcaatatggtattagagccagatgtctcgagttcaaatctggctgtcgcgcaattaaataaaagttgctgcccatttctattccacacttgcatgcaactcaatactaatatttttgaaattggatgcttattaattaccaacctcaactctcagtctctctttctgggattttctcaaatctcaatctctctttccaaccccaactctgcccgactccagtgtcctccaaacccaacacgagccggaacgccaccgcctccctccctcctccaaaacctctcggcatcgttctcgtcgattccgagccctcgtcgcgcatttctcccccaaaccaaatcccgctgcacgttgcggcgttgcccgatgcgcgcttgatccattggttggtcctcacccggattgtctcgatttcctctcttgttctcatctttctttcgcctttcttggttcatgttcatccggaatgtttattatcggattcttgcgattttttcttcctgttccagagtccagacggcgatgtattcggagaagaagaaggcaagggcgagggatggggatggagatcgggatgctgccgagagacggcggaaggggaaggccccatgcctggagccgccgccgacaccgccacgcgcgatggcggcggcggcggcggcggaggccggtccttcacgcggcggctgcgttccgtcacggaatcccttgaaggatccgggggattgcgaggcggtggccatcagggacaccgacggcgaggactgcggccacttcagctgcgacatggacgagatcgctgacatcgagatgggcatggccgcccgcggcgacccgatgtgcgagcacgagacgtgcctggccaccgggagcaacctcatgatggtgtgccccgaatgcggctggtgcttctgcgtcggagggctagcccacagggccaagccgctggggcacatcagggagcatgcctaccggagggcgcattgggtcgcgctgcgctgcgaggatccgtgtgagggttactgcttcgagtgtgaggattcattggcaattgagagccagatggtggccgatgatggcgccggaggcggcgaggaagggtatggatgtgttgtcacagggatgccgaatcttgggaacacctgctacctgaacgcgctgctgcagtgcctccttgtgctcgggaagctgcgggcgaggatcttggggccgggcgctccgtcgggtgtccttggtgacttgctgcatgatctctttgttggtacaaatggtccgagctacgctcgacgcctgctggacccggcgatgctcttgcgttgtgtgcgctttcgttacccgcagttccgaggcattgctatgcaggactgtcatgaattgctttgctgtttgcgcgatggtttggatgaggatgaaaggaaatggagggctggtaagatgcaacaaggtgctcctagtgctgtggctcctacggttattgattccatatttgctggtcagctgtctgttaccttgtcttgcaaatgttgctcgtttaagtcagattcagaggaggtattccatgatctctcaatgccattaccaccaaaggggactccagccagaagtgttgcatcaccaccacggaatggaagatgcatatctcaacagaagactcatatggaactgtttccagcaatcaacaagactaacaccgaaaagattcatgcaatttctgaaggcggtgatgctcaggttcccgcttcagaatcggaacatatggttatggtgaaaacatcagagcctttggaagttggtaagtttatgtgttcctgtgcctaactaaataatggaaaacaacgttgaacgggccttcaagcacgcaaggtgaaacagaagatgaatttttcattaatgaatgattgaatggagcagaccatgatagtacaactattgtttgttattttgttgcttgacatgacaaggacatttttcagagaagagcccttctagtagctaaatagagaatatttctttggtatggttcatacatggactgcacaaatgtcagaaccttcaggatgacagcattatacaaacgggatgttccagcagtttttgctgagtccttgtgctcgtataataaatgttactcagctttgttggttaacttaagtacatggtccatgaagaaaataagcttcaaacaatcaaatgtagaggttcaagattctcaaacaatgtacaacggttcctggtttcatgaagttacttatgacgacaaaacctaaaacttatatgcttgattctgcagattctaatcacttggaacagatttcgcaaagcaagggtgatgtacatggtcctttgcaggctccaacaagggaagagaacacgttgatagcatcaggccatggtgtagagagaactgtcagtgctgttcttgatagcatcaagccagaagatagtatagaagccaagatggacactttgtcagcagaagttgctacagaagacaaggggaaagatcgaaatcgtgatgcagtttatgataaggcagatgatatcaactctcttgcttcaatcgaggaaatattggaattgcatttaaaagcagagatgatagaaaagaggtgtgaaaactgttccaatgctgatcagaaggcaagccctataagtggtaaacatggtgaacagccagtggcatgtaccaatgtgaatgggacagttgatggagaccaggatgaacaagatcagggaagggggaagcaagtaaatatgggtcatagtgcacatcaagtggaagaaaaccaatatgatcggccagataggaacaaaggtgcaattaaaacatgtctttttagcaagttgccacctgtgttagccctccatctcaagagaaatttatggcctcttaaacttaaagtgagtggacatgtgagctttaaggagacccttgatgtgaaattgttcatgcaccccaggtactgagtaatttagtctgtccatttttttgtgtgctgttgttatgagcatgttgataaccgtataccttgcacacatttgtttctgtttgtccaattgaaaaccagaaaaagcaaaatatgcatgtttccgtagctgtggtaaaaactaaaaatgaatttcgcttgcatggtcagctagttttctttggcacagaaataggttacgacttaggatagcactgctctgtcctatttctggcaggctaacatgatttaagacaaagaaatagacgcaaacaaaaccgatcttgtagttatcattgcaacattcgtttggaagagctccgtagtttgcgttgaggcaagtggactgtaaagtgaataggcattctaaggctatggaactgcgtcccctccaacatgggacttgtgtatattattgctttttctaaccctatagagtcaggttacacccagtagagtaactctatggtcgttaatatgatatcacccatcttgaaggacaaactcaatcactgtagtagttcatcattgaccactggatattttttggaaaatgacatcccattaaagaaaatctgaaatggtatatataattgctttttgattttttatttgtaggtgatgtgtaccatgaaatgcctaacctgttgaaccttttttatttcttagaatttgatttgtttgatatacttatgtattttttaatattttaatatatgatggatatatataaagtgatatgttgaaatagtttgtaggggatttacttgtttatactttacatgtttattctcttaggatgatttataccagtcttttacttagatctgacagattttttttcatgagatgagatactgatttcttgttaataatattctgttcataagatatactccctccgtccccaaatataagggtttttgtttggatgttacacattagtaggatgtgtcacatccgggcaaaagcccttctattttgagatggagggagtaactatataagataaaataagacatgctgttgtttacattgagccataatgaagtacagtcttatatctgttttgatcgtttttgttttctctaatcttcagttctgaagacaaagataattccagctaccgtctagttggtgttgttgagcacctgggcctttgcatggatgcagggcattttgttgcttatgtgagaccaagttgcccgcagcagaccaatggctcttccttatggttttgtgcaagtgatgccgacatcagagaagtctctttagaagaagttctcaagtgcgaagcttaccttcttttctatgagaggattgaaggctaagatgtctggatcctacagagtagcaatcacaaaggaagcatatgttatcagattaacaagcattctttggacgaccaatgattcaattttaatcagtgtacatatactgacgtaggttcgtgatcaagttgaatcttgttgcgttggcttagtcattgcaggactccaatttgaccgcaacatgtacataccagttgagagaattcggttgttcttgaccagctgatatcccttttttgtccatgagtgtattaataatttatttgaaaacaaacggcatagttggacattttgcattagagaatttgagcaaaatcattatgtaggcacatggacaggttttcttcttctttttgaagtaagcaaaatcattatgtaggcacatgcacaggttttttttcttctttttgaagtagaagcaccggtacagttttgtcgattgttactgttacctgtaattagtttacactaaagtactgtggaaaatatcattcgccatgttgagttttgcctcaatatttttttatggcaaagagacattgtatgcaagatgattgagatacaccttgagaattttgcattcgttgaaaaaaacaaactagagacttgagctggtgatgtttagccatcgatatagttttgtcggatgatctgttatctgcaattgctttacagtgctgtggaaagttcgaatagtatattatccgcttcactttgcctctatttttcttgtgtcaaggtgcaattaaaacatgtctttttagcaagttgccacctgtgttagccctccatctcaagagaaatttggggtctcttaataagtgaatggggcattaatttgcataaaagatcatatatttttgtttgcagctgtacacgatgacggttgcatgtgtccttttatctaccatagtaaagaatagtagtacaagataaaaaggacaataaagaaaactggaggagacaagagagtggatctatcaaaaaaaaaaaaaagtgcattgccactctctttcatctcgaggggtgctaccatgttagctgcatgcattttctatctcatccctctcttctctctagtctctccaagttcagcattgtcactacagctgtgtcttgccacgcctgacacgagtcgacacactgacacgcgtgtctcgataacactgcttctgaccagcaccttcgttgcttgaagcctcattaattttcttctttgacttcatctccaagtaccatcgttttacctgtcagacaagtatcaaatgacttgttctttataaattttgcaagtgtaagagagcctggcatgaaattggtgagttaagagtacattctcaagtctacaacttactttagcgatgtggggttgattcttaagtggaatgtaattgcaattcaagtaaattggttcctcgtccacctgttacataggaaaataagttgattggagagttttatatcattagagttaaggaaatcgtagggtatcctaacctcttccagaatcctccaccttgctttggggtaagcatctaatatatctgtgtctgtttccaggatcaaaatggatccatctttctgcggtagtgtcatcaacaatttaaagggggcagcgtattaaataaaatattgaaacaaaatattttcaaataaaaagatggccggcattatagctatagggttaatacctcgcgaataagattgaatatgtcatcgccccggtaaagaatagcatattcatccttccctaatccttggcataaagactgatatctgtgtagttgagatgataatgtattaaatgagtgaattgcagtgttcatcaaataaaataaaagtatagtccctagtgtccaacatacccataacttgtaaactgattccttgcagccaacaaatcttgcaataagaaatcaaacataacaaatagtaaaataaaaaaaaaatcaaatcatgggatttattgagtaaaatgtttgatgatattacaatcttacttttgcttgcatccctatccctctgtgcagcttcagaattatcactccgagcatcaagggatgaaatgtgtgattccaggtcatcagaagagaaggacttgaccgtctcatagatgttatcctcgggattagctacccaaccatgcaccaattcgatccccagcacacaaattaagctacgtccaaaagaatccttgaatgatgtgaagctgcaatgaaatatagcacggcatgaatcaaaacaattaaaaagaaatacaaagatacagaagtaatgacaagcaatctacagtaactatttgcacctgtcaagaacaggatagatctgatgagtatctgctgtagaacgtatgaaacatttccagataaactcacagttatacagcttttcatgttttgatttctcgcttttttctatctcaccaagtacaagtttgagatgtgcaatgatcgcgtctttcacctctctctcaggcagaaattggagttttacttccgatggtttcactgcgagagctctattcaaaactaaatggttatagagagcagtccaaagtgaatatcccttgtggcaaataatgctagtaagcaagttctcatgcttgaactgaacaactctatagtgcagtgtctcatcag

SEQ ID NO: 46314 - DNA, 8475 bp, Oryza sativa
taaaggatagcatattcatccttcagtaatccttggcacaaagactgatatctgtgtagtccagatgataatgtattaaatgagtgaattgcagtgttcatcaaataaaagtgtatagtagtccctagtgagaccaacatatatacccataacttgtaatctgattctttgcacccaataaatcttgcaataagaataaacacaaaaattagtagaacaaaaaaaaatcaaatcgtgggatttattgagtaacatgtttgatgatacaatcttacttttgcttgcatccctattcctctgtgcagcttcagaattatcattcagagcatcagaaatgtgtgactccagatcatcgcaagagaaggacctgaccgtctcatagatgttatcctcgggattagctaaccaaccgtgcaccattcggatctccagcaaactaaataagttgtgtccaccatttgtcttgaacgatgtgatgctaaaaaaagaaagaaaaaaatagcacaacttgaatcaagacaattaaaaggaaatacaaagacgacaaaatctacagaaactgcatatatatctgcacctgtcaagagctggacagatctgaagtccacctggaagagcatgcacaagacatttgcattctttctcggcctcatacagataatcgaaatttgagctccaacctttttcaagatctttgatcttatgttctacgaatgcgatgatggaatatttcacctcttgctcagtcacaaatcggggtgttatcagtggtaagggaatccacgtcagtagagcgaagttatacagagcaatcgaacaagaatacgcctcgtggcaagcaaggccaacaggcttgccctcattctcggatcgcacaaatctatacctttccatttaggcactgaaagcttagaattattataatgtagattattagaagtaagctgaaacaaacagatagtttattataatagatcattacaatctataagccaaattactataatctggtaattaatccactctaaaaatattttttagattattaggtggctaagagctatctatcagagaaacaagcagcgaacatcttattcaatgtcgacttattataatccagcttacagtaatatgtctcaataatctatattattataatcttaaaccgaaataaatggggcattagttttctcggatccaaatctacatataaacatatatataaacacacacacacatatatatatataggatacccatatgggactccatggtgcctaggctccaaggtataaaacacacaaattctctcaaatttttaaaaatgttcaaattgtgagtatatacctaggtatatgaatttgattcatacaaatacctaacaacaaaacaactcaaactcaactttatttcacaattcattattacatacctaactaattatatgtttggatattatatacttagaaccaaaatctaacaaaaagaaagttcaaacttgaacttgttagtaaagaagttaatgtttatatctaaatattttaaaaaatttcatacccattaaaattgggtatatactcaatttgaatcttggagcatgcatattcatgtagcaccagttaatttacctctttctctctctctctctctctatatatatatatatatataggatctaggattcgaaatcacatcgagagaaaagagagggagagagaggaaagaaagagagaatcggcatcagctagggtttagaaagaattggagaccatcataacagaggccgatctaaaggggcgagaaagatggatatatacataccaggatttggagacgggggcggagcttggatgatgaccggccgccgctcaaatctccgacgcggcaagatgctgagctgctcgcggcggggggtttagggtttaagagtttgagtttgccggctagcgaaagaatgctaattaacgacgggtttaattagggttttgatcagtggcggcgagtgtgagatatatatacgtatcgcttttcagcggggcagccgcgcactggccccccaaaatggtggggccctccacctacccctctgtgattagggatgcgatcatgcaattagactagagattagcgctacgctgtacgcaaaagccaaaggcaacagcacgtgtagataactatattattcctgattccagctgatcccgatttcttatctcttctctgcaagggcttctagctagctgattggcaattttagtgttgttgattgctttcttctagtaatatattaacattaacgtgcaatcctcttggtgcttgagaaaagaaaatatttgtttggattaatcggtgctaataatttaagttgtataatctatatgagttcgaacactaatacattatttttacaattcttagtccattcttcacattatgtcgcctcgaaaataaatgattaaatgagaaggaatcgttagatgtttttatgaaaagcgaattgctagatgagattactatcaccaatgaattcgcgtctaaaaatatctcaagaaatttgcaatgaaatatttgtgaggttcttcatataaatattgcttttggatgaactttaaatatttacaagcaatatattcatatatgtatatctatattatttattttttgtatgtgatattaagggccccgtttatagtttcgccctgggccaccaaaatctcagggccggccctggcttttctacggtgccggattaagattgggcctatttaatggccgtatttattcaaaactaatggacgtgccaacgcgtgggttttactccctacttcccaaattgatcatcatataataaaattcaaaatttctcaaattgatcatcatataaccgcatggacacgtattttatcataatataattaatacagcatgggagaatgtgtgcatgctaagatgtaattggcatgttgttttaatcgatgcatgcattgtgagagaatgtgtgcatgatgtcttgattgatgtgatttaaattatccttggtcttggtgcataaatatatatgatgatcaatttggaaaggatggagtatttgctatttagtgcttcctaaatagtgaatgaatgaagactattattactactagttctaacaaaaaaaagagtaaagactatttaatggttttctaaatttaacgactagtaatagtatgatcatatagtgtcgattaactttaatgaacaaataatataatctagtcgtagagaaatcttttgagtattgtttattatttaatttcgtatgaaaagctaggagaaagactgattatgcatttgttttatttttcttattattcgtatttaattgacggtgatggcggcggtgggttccggctgccgacctctccctcgagctcgccgtaccgacgcacgtcgcgaagctctcgccgtgtccccacatgtctcgttcttcgaccagacacatatagagtacggagagatgggaaagaaaggggagagatggggagaggtagaaccgtggaagcccacttacttgtgaatctttttattttattgactaggatgctatgttagctaaaatagacatcgatactattttaggacctgactcactgttttgaaatgatcaatcgatttccggtattgtggtttagcgacatcaattaaactcgatgtaaagacgagggacataagtgggccttattccaaacgaaaagtattggaaaagcacggccgctaggcctccagttcatgcacggcccaactcttggcccatcatccatgcttatgagcccataccagcccacccacgtttggcccatccgtataagcccaggcaaagtagcaaccgcctcctctctccttcacctcaactcgctccggccagcgaagccgcttcttcttcttcctccaaaaacctctcgtgatctcgtcggcgttgtcgtcgcgggcgccgcagcgtcgatgactcgtcgccgatcgcgccctcgccgattcggagccatccccgcgtattccggtgagtcccccctcgcgcgttttctcccagcaatcccccacccgctgatcgcttcggttttggtttggtcgctcctcgccggaaatgcccgatttctcgttcttgtctctcatccctaatccgcgcggtgggctagggtttattaccggattcttgcaatttttttttattttctggtggttcttcgcttgttccgtaatccccgcgcacagcatttgggggggattttattgacggattcgtgctgatttcttgtggttgtttcggttccaggcgcgatggaagaggagaagagggcaagggcggcggaaagggatagggctatcgtcaggagcccgcggaaagggaaagccccgcggatcgagccgctggatgcggatgattctggatggggcggcgatgcctcgctggaggtgtacagggaggccgcggcggtggcaaccagaggcggcgccggcggcggcggcgagcggtgcgagcacatgacctgcagcgagcatgacgttgcggaaatcgtgtccaagattgcgtcctggggcgacccggtgtgccaggatgaaacctgtatgtgcaccgagaggcacctcatgatggtgtgcgtggaatgcgatatgcatttctgcattggaaggtttgccaagaagtctaagccgcgaggacacatcgaggagcatgcgttcgacgatgggcatccggttgcgctgtggtacgaagatccgtatactggttactgctttgagtgtgaggatcccttgaccattggtggtgaggagggtgataagggaatgaaggtcaaaggcgaggaaggctgtcgcgcatctgggtctgatagtgggcatggctgtgtcatcggcgcatctgggtctggtagtgggcatggctgtgccatcagagggataccgaattttggaaacacttgctacttgaatgcggtgttgcagtgcctccttgtgcttggaaagctgcgggcaaggatgtctggaccggacgctccgcctccatcggggatgcttggtataatactgcatgatctctttgttgctacagaaagtgtgagctatacacgagacctgctggacccagtgatgctcttgggttgtgtgcgccactataaatcagagttccaaggcaatactatgcaagacagccatgaattgctttgctgtttgcgtgatagtttgattgaggaggaaagtaaaacgaggcctgataacatgcaacaggatgctcctagtgctgtggttcctacagttattgattccatatttcgtggtcagctgtttgttaccactctgtgcaaatattgctcatttgagtcagtttcacagggttcacaggatgcattctatgatctctgtgtggcattaccactacagaatgaaagatgcatatctcaacagaagattgccatcgaacaatttccaacaattgacaagactaacaccgaaaagattcatgcaatttctggaggcagtgatcctcaggttcccgcttcagaattgggagatatggtcatggtgaaaacatcagagcctttggtagttggtaagtttatgtgttcctgtacctaactaaataaaggaaaatgatgttgaacaggcctgaaaacgtgcgtgtgaattggaagacggaacattttgttgatggttgcggcaaactgtgatactaccactattgtttgttattttgttgctcaacatgagaaaaaggatattttaggagcagcactcttttggtagctaaatagagaaaattgcttaaggtatgattcatgcatggactgcagaaataccagaaccttcagaatgtcagcattatacaaacaggatgttccagcagtttcagcatggcaaacagtttgctacagtgtttcatcaatagctcagggtgttgaatccttgtcatataattaattttactccgaattgttggttagcttaagtacatgcagagatccttgaagaaaatagtctttcaaataatcaaatgtaggggataaagattctcaaaccatgtagagaacaatggttgctggtttcatgaagttattgatgaggagaatacctaaaacttatatgcttgattctgcagattctaacccattggaccagatcgcacaaagcaaggatgatgtacattgtcctttgcagagtccaataaggaaggagaatgtgctgataacatcagaccgtgaattagagagaactaagagtgctattcttgatagcatcaagccagaagatagtatagaagccaagatggacactttgtcaggagaagttactacagaagacaaggggaaagatcgaaattgtgatgtagtttatgatgaggcagatgatatcaactctcttgcgtcaattgaggagttattgggattgcatttcaaagagatggtagaaaagaggtgtgagaactgttccaatgtcgctcagaaggccagccctataagtggtaaagatggtgaacagacggtggcatgtaccaatgtgaataggacagttgatggagacaggctgaacagtcagagaggaaaacatgccaaagtgagcaatctagcgatttggtcagattggatggggaatgcagttcttcaagtaggcagccacatgttgctgatgcacagcatcaagttatgccaacagaggacactatgaccaaaggagacatttcagggatgagtcacggtgaaaaagactcatcctctttcagcatagtcaatcaaaaacctgaatgtcttgagtgtgcccaagaagatgtacctgactgccatctaggtgagaagccagtcaacctgtcgagtggccagtgccaaaatgccaacactgaagatcagggaaggaggaagcaagtaaatctacaccaagtggaagaaaaccaatatgatcagcaagataggaacgaaggtgcgattaagacatctcttattagcaagctgccacctgtgttagtcatccagctcaagagaaatacggggcctattaaagtgaggcgacacgtgagcttcaaggagatccttgatgtgggactgttcctgcaccccaggtactgagtaatttagtctgtccttttttgttgcactcttgttatgagcatgtgggctaccgtatactgtgtgcgcatttgtttttgtttatcgaattgaaccagaaaagcaaaacaagcatgcagccatcgatatgtaaaaatgaatttacctggcatggtgacttggtgagctagttttgtttagtatagaaacaggttacgacttaggatagcattgctttagtttctttctggcaggctaaaggaacaaaaacaaaagaaaccttatcattgaaacatttttttggaggagctccgtaatgtgtgttggctgttgaggcaagttaactgtaatagtgtgtgaacagacattctaaagctgccgcagatgaaactgcatcccctccaacatgggccttgtgtatattatgctctttctaaccctttagaatcaggctacatccatagagtaactctagagtaacccttgtggttatcctcctttttattttattttctttttttttatgaaaatgacatcccgttaaaaatatccgagttagtatgtatgattgctttttgcttttctatttgtaggtgatgtgtaccttgaaatgcctaacctgccaaccttttttatttcttaaaatatgacttgtttgatatatttgtgtttttttaatatttttagtacatgttgggtatgtataaatagttttcagatgattttttttattttttaaaactttacattgttattcgcttaggatgatttatactactccctccattccaaattgatctacatatagttttttttgaggttattcctaaatgatttacatatttgtgtttatttattaagtctattcgttatttgtgcattggagtaaatagacattgatgcatgcatccatgcacacaagtatttataacccacatgtaatatcttgatttgctattggctaggaaatattgggaatggtgcatgcatagagtttgttgctagaataaatatagtatgagagagttattagcttttcttggtcttggtgtacctatgaaatatgtagatcaatttggaattgagggagtagtattttacttaaactgatatattttttgtgagatgagatagatatttcttgttaacaatatcctgttcataagatatgtattaaataatatcaagaaattcatgatgttgtttacatagagctataatgagttacagccttacatctgctttggtccttttttgtttcctctaatcttcagttctgaggacaaagataattccagctatcgtctagttggtgttgttgagcacctgggccatagcatgtattcagggcattatgttgcttatgtgagaccaagtcctccgcagcagactaatggctcttcctcat

SEQ ID NO: 46315 - DNA, 10450 bp, Oryza sativa
attaataattacttaaattttttgaataagacgaacggtcaaacatttttaaaaaagtcaacggcgttaaacattttgggatggagggagtactattttgaaattgctttacagtaccatggaaatttttcgaacataatgtttgaaactttcagctttgcctgtatatttttctggtggcaagatgattgagatatacaccttgaagtatcaatctaaagagctttttttctgtcaaaaaattctaaagagcttttttctttctttcttccattgctttcctgtatggaccgtgttataacatgcaatgagatcctacttctttgagcctcttgctttcaatgttctgcatggatgatgataagtgtataaattgcttgcaattatccacatgtgtttttgttggcaacatttttctccgggacctgccaatttccagcgagcaagtttgcctacatatgatgggtaaagaaataaaaatcatcaaaaaagcgaaaaactagaacaagttgatctaggaagaacacaagaacgaaaatagctttctgagaagaacggccactgcccggtaggactcttgtttatttacggcccatttaccagtcggccaccctcatgggcccattacggcccatccaaacagggccgggttaagtagcaaagcacgcgcaccatctccgcctctctctcttcgcacgcgcgcttcttccccaacctctctctctctctctctctctctcctcccacccacctcggcggctcggcctcggcgtcgcgggacgccgcggctcgcggggcgatcgattcggggtcctcctcgcgtttcccggtgagttctcccctccatttcttccccaaatcccgctgttcttcgccgccgcggggttgatcgctcggtttggtggtgggtggtggtggtgtgggagggtgggggtggggggttttgcttggtgccggaatccgcggcggcgccgccgcgttcgtggttcgtcgccgggaatgttgtgatctctctgggtttgcctggccccgcttgttgagcctggctaactagagttcgtggcgtggttttgtggttgggttggattggtcgtcgcgcctaacggccaacctgtttgatgatttgcttgccttgtttagcccttctcggttcatcccttgttcgtactgttcttcgtctagcttgtttgatttgatgggaatttatggattcactcgatcggttggtggttttgcggtacccgtatccgcggcggccgctgttcgtggtcctcgccggaatttggtcggtttcgccttgtcctattagtagagatctcttggttttccgcttcgtttagctttcatggttcaccgccatagtccgtacaattcatggaaccctcgcctttcggtcaatttcaccgccatagtccgctgtcttcttaaggctccttggatggttcatccctggtagcagcagcagcagcagcagtagtagcagttcgtattcttcttcgtatatcttgtttgattctttggggatttatggattcgcatgtttcaggtcttgcgccccaggcgtgatggaagaggagaagagcgcgatggagacaggaaaggggatgagcccgcagtatgcggtggcgcccgaatctggatgcggcgacactgcgccgccggatgaggtgagcagcccggaacagaaggcggcggcggcgtcgaccagcaacaccgaggggagggtatgcccccacttcgaccctttccaggacggcgtgctcaagttcatctcggagctcaggtcctactcctacgattgcgccccgaggtgtgaccattacctgtgcgagaacaaggtggaaaagagcagtatcctggtttgcatcgactgcgacttgcatttctgcattggggacgggaccatgaacaagccgcagggacatgcccggtggcatgccgatctggaggagcattgtgttggtgctttgctcggtgagccggaaactctgtacttcttcatctgtgaacgtcttctggacttggatgtcagcaacatgcagcgtggagacttctcatgtggcaaggaagaaattgataggatcgagtcagatgtcagctcctccaagaatgctgtcgtgtgccatcatcattcgtttgacacggagaacattgttatcatcaaggatttcgttgaatctgaaaagggtgacccaatgtgtgataatgaaacgtgcctaaccaccggggagcaccacatgatggtgtgctcagaatgcaaagggtatttctgcattgagccagccaccaaggctaagccgcaagggcacatccgggagcatgcattgcttcaggagcattgggttgcagtgtggcacaatgatctgtatgttggttactgctttgaatgtgaagattccttggtcataggtggtgaggagggcaaggagggattggcagtcaacgcagaggcaggttctcatgcatctgggtcttctgacgggcatggctgtgttatcagagggatatcgaatcaaggaaacacttgcttgaatgcattgttgcggtgcctccttgttcttggaaagctgcgggcaaggatgtttggaccgaatgctccattggggatccttggtacaatactgcgtggtctctttgttgatgcaaacagcgtgaggcatgcaccaggcccgctgaaccgggcgttgctcttggcttgtgtacgaaggttcgactcatggttgataggcacttcaattcatgacagccatgaattactttgctgtttgcgcaatagattgaatgaggaggataagataataaggcctccaaacaagcaacagggtgctcctagttctgtggctcctaccgtcattgattccatatttggtagtgagctgtctgttaccacctcttgcaaacgttgctcgtttaagtcttattcctgtgatgtattctatgatctctcagtgccattgccaccaaagggtgctccatccaatagtgttgcatcaccaccacagaatgaaagacctatatctcaatgtaagatttgtgtactttctgaaggcggtgattctcagattcctgcttcagaattggaagatacagtcatggtgaaaacatcagatcctttggaagttggtaagtttatgtgcttgtgtgcctaactaaaggaaatgaaagtgatttaagcagggctccaaacttgcatggtgtatcagaaaatggaacttttcgtgaatgaatcaaactgtgatagcagcactattatctgttattgttttgctcagcattggaaaatggtaactatcagagcagggtcttgtactagctaaatagagaaaatgtctaaggatttgattcatatattaattgcagaaacaacaaaaccttcaggatatctacacaaacgtattaaacaaacatgatagttcagcagatttaacttggcaaagctctgtagcagttactattgccactggaagatatctcagagtgttgagtcctccttgtcctcatctaataaaattttctccatattgttggttaacttaagtacatgctgaggtccttgaagaaaagaagctcctaattatcaaatgtagcggatacatattctgaaaccatgtagagaatgatgagtactggtttcgtgaagttgctgatgaggacataactaaaaattatatgctttattttgcagattctaataaattggaacagatcgtgcaaagcaaggacgctgtacattgtcctttgcagtccccaacaatgaaagagaatacatggatagcatcagtcagtgatgtagagaaaactgacactgctgttcttgataatgcgttcagtgggctaaaagttagtacagaagccaagatggtcatttcctcagcagaaattaattcagaaaacaaggggaaagctcgaagtcttgatattatttatgatgaggcagaggatatcaactctcttgtgtcaattgaggagtgcttgaagttgcatattgaatcagagatgatagagtggacctgtgagaactgttccaaggttgcccagaaggcaagcactataagtggtaaagacggtgaacagatgatggcaagtaccaatgtgaataggacggtttatggagaccaggctgaacagtcagacaggaaaacatgccaaagggagctatctagcgatttgatcagactttctgtagaatgcagttcttcaagtagccagccacatggttctggtgtacaaaatcatgatatgcctgcagtggacataaaaacttgtggagagacttcagggatgagctctgttgaaaaagactcgtcctcttgcagcatagccaataaaaaacctgaatgccttggaggtgctcaagaagatgcatctagctgccgtctgactgagaagcaggccaacctgttgagtgtccagtgtcaaaatatcagcatagaagatcaggaaagggggaatcaagtaaatctgggtcataatgcacaccaactggaagaaaaccaatatgatcagcaagataggaatgaaggtgcgattctaacatgtcttattagcaagctgccacccgtattagtcattcaactcaacagatctttggggcctcttaaagtgagtggacatgtgagctttaaggagatccttgatgtggagccattcatggaccccaggtactgagtaattttgtctgtttatttttttttctgtgacctttttaagagtttgtggatcactgtatactgtatgtacttttatttattgtttttccaattgaaccggtaaggcaaaataagcatgcttcctgtagccatgttaaaatgatttttcctggcactgtgagctagttttcttaggtgtagaaacaggttgcgacttaggatagcactggccttgtttctttcttgcagactagcatgatttaggttacagaattagaaactaacagaactcattttccagtcatcatggagccatttgttttagagagctttgtaattagttttgatgcaagtggactgaattgcttggctttatagtgagtgaataggcattctaaagatgctacagatgaaactgcatcccctcgggccttgtgtgttatgctttttctaaccctttagagtcaggttacatctttagagtaactcttggtttgtttatatgaaatcacccatcatggctgccaaactcaattcgttgtagcagtttataattgaccactgtggcataccattagaaataatctgaactagtatatgattgctttctgcttttctattttaggtgatgcgtaccttgaatccaacttgtttgatatattttcatggtttttaagtgcaagtgctatgatggatatttttttagataaaggaagcttttaactaccatggatatatgtgaatctatatccaatgttctgtttaaatagctggtcgatgtttaaacacattacatggttattcattcaacatgatctataccagtctttcactcatatctaatagaggtgtattttttagataaggtatagatttctttttaacaatattcagttcctaagatataagatcaacaaagacaagttgttgacatcaacctatgatgagttagttccttgtatctggtttgatagtatttttttaactttctctaatcttcagttctgaggacaaattcagttcccgctatcgtttagttggtgtcattgagaaccgtggcctcagcattcatattgggcagtgcgttgcttatgtgagagcaaacaatcagcagcagggcagtggctcttcctcatggtattgtgcaaccgatgacgacatcaaagaaatctctttagaagaagttctcaagtgcgaggcttaccttcttttctatgagagaatgggctgctaagactgtaagacatgtcttgaattctatacacaccaaagaatccgaagagcaatcacaaatgaagcagatatttgagagtatcaaggtttatttggatggacagtgacccaatcattgtatatactgacgtgggttcgtgatcaggtccagttttgtcgttgtggctgaatgatatttagtccttgcagggctttgccaacatgtacgtacctagttggggatattagctggtgttcttgatcatttgatctggttacagtcattcacattcttttttttcctttgtccatgaggaatatattagggtttttttgaacgaaaaagaaaaacttaaaaacaaagcaggagtaatgaagtgagaaagttgtgtatatcatatcagcattggtacggttctgtgagattgtacttctaagtgcgcacactctgtgagatcgtacttgattcgatgagctttactccagatttttttcttctgtgatggacaatctataccactgttatatgctgcaacatgattcagaatttcagatactgcattgccaacctactgccttttgactctctgggtaaagatcatggcttgctaaagtggtgtcggatgatggatgaaactgagttcttgataataattgaggacatggacggttaaattaaccgttaaaacttaaaagttgaaaaagtcgatttaaataatattctaaaaaatgttgatagagaaagttattacaaaaaaatgcaccatcgttgattgaaaagaacaataccttgtgcattattttttccagtgctcaacagctctgtatcttgatctgtgtggtcgatgttgaacggttgatggatttgctcctgtaaacaagaaagggcaggaggcttgcctcagctctcatataattataaaattataaggagcagtatagtagtaataaaagcaggagcaaactttattggcaaaaagtatagaaagaagaggagaaggtagatttattcagagagcacattggagggttgacgcctactgggccgggccttgatttcctttcccctgggccctggctattcacgccccatcaaggcagaaagatgcattcacacgacacgcccgcttacgcgctacgcctcccaactccaaagcccatcaccacgccaagtaaccgcccaacgccaccctctccaccaaaccagctctccctccctccctccctcggtccctccccttctcctctccaactcctcctcgacctcgtcgtcgcgagacgcccgcggctcgcgcgcccgatcgattcggcgccctcctcgcgtcttcccggtgagatttcccctccatttctccccccaaatccccctgttcgtcgccgacgcggggttgatcgctctgttttttgttgttgttggttgtggttggggtggtggtggtggtggtggtggtagtgggggtaggggttggggttggggttttgcttggtgctggaatccgccgcgttcgtggttcctcgccggaatttccgtggtttccccgcttgtggagctctcgtggtttgccctagcctgagtacgggttcgtgcgtggcgtggtttgttgttggagttggattttggtcgtccctcgcctaacggcggccaacctgtttgatgatttgcttgttccgtttagccttgttgtttcatgcttggtttgtgctgtttttttcgtatggctttgtttgattcgatggggattttatggattaactcgattctttcttgttgttcttgcgtccccaggcgtgatggacgacgacaaggcgagcaaggggaggccgctcaaatccccccgcaaggacctggacccgctggctgcggccacgcccgatcccggatgcggcgagacggctccgccggaggtgagcaagcctaaggagaaggcggcggcgccgaccagcaacaccgaggaagggttatgcccccacttagaacgtttcgaggaagacatggcaatgttcgtatcaaggctcatggcctccaagttcaccccgagttgtcagcgtctcatgtgcgatagcaaggtggacaagagcagtatcatggtgtgcatcgactgcagcttgcctttctgcattggggacgggaccatgaacaagccgcagggacacgcccaggaacacgcccaattctacgctcatctggagaagcattgtgttgctgcgttgttcagtaaaccggatactctgtactgcttcatttgtgaacgttgtctgaacttggagatgagtgacatggaggcagaaagtgacagcagcagcgaccaagtgggatgcgaacactttgtattggatgaggaagaaatcactctgatcgtgtcagagatcttcgcctccaagaacgttccggcgtgccaacatcccgggtgtacgatcactgggaatacccatatcatggtttgcacaggatgcaacaagcatttctgcactagagctgaggccatgaaaaaaccgtatggacatgcccgtctgcatgcccagaagtgtgaacaccattgggttggtttgtggtacagtaatccatatatggggtactgcttcaaatgtgaattcgaatggatctaggtgcaccgaatgctgagagggggatggtgtttggcaaggaggcatttgatcaagaatctggattagcaaagaggcatggctgtgttatcagagggattccgaatcttgggaacacttgctacgtgaatgcgttattgcagtgcctctttgtgcttgaaaaactgcgggcaaggatgttagcatcagatgctgcttctgggttcgtgggtagcgcactaaaagagctctttcaggaggtaaacagtgtgaataatgcacaacgcccactgaacccgacgaagttcttggatcgtgttcgtatgttgaatgcacaatttgcaggcagtgatatggaagatagctatgaattgctttgctttgtacagaatcaattggaaaaggaggagaagtcaatgattcctgcagtgtctactacagttgttgattccatttttcgtgttcagctatctgctaccatatcctgcaggcgttgctcatataattcagtttctcatgaagtaatgtatgatctatcagttccactgccatcaaggaacataagttgcatgtctcgagagaagattggtatcaaactattcccaaaggttgacatgagtaacaccgaaattgttcatgcaattgctgaaggacgtgattctcatatcactggtttagatctgggagatgtggacaaagaaaaaccatctgagcctttggaagttggtaagttcatgcatcctgtttctaaataaaagaagagagaacatttttaaacagatatgcaggtatagaggattgtgcagaccatatacatcttttgaggattgaatgcaagaaactaaggaatattgtaatcacaccaccattatttttctcatcataaagagaaaacatacattttttttggaatggatccccaattctagttagacagaaaaagttgtgagggcttgctaaacacatggagtgaagaaatatatggaaaaccttcaggatggctacataaaagaagcatgacgtttgagcagtgttagcatggaagagttgtttgtcgtagtgtagcaattaagagcttggagtggaagattgtttatttgttgagtccttgtcttcatacacaaaattttgctctagaaggttggtttacttaatcaagtacggagattctcgaagaaatgcagcttcagatcgtagagaatgaaggttgatggttgtatgttgttgctgatgcagataaattatagccttatatatgcttgattctgcagattctgttgaagtggaacagcactcgcaaagcaaggatggtgtacatgttccttcccaaattcagaaggatgaggtcccaggggagattattcaggcgccaactaaggctgatgatttagggaaaaattacaatgctggtcttgagtatacgcccagtgagccagaagttagtatagaagccaagaaaaacgtttgctctgtagaaggttctgcagaagacaaggggaaagctcagtttagcaatatggcttatggcaaggcgaaggataacaactctcttgcatcgattgaggagtgcctagaactgcattttgaagctgagatggtggaatggaaatgtgagaactgttctgaaattgctcgccgtaggagcaccactagtggtaaagatagtgaacagatgatggcaagcaccagtgagaataaaatagttgatggagatcaaactgagcagtcggacaagatagcatgccaaagcgagcaatctagcaatttggacagtggtgaacaagacttggcctctgataacacagccaacaaaaaaaatgaatgccatgaaggtgttcaagaagttgtacctagctgccttgcagctgaggaactggccaaccagttgagtggccagggtcaaaatgccagctctctagatcaagtaaagctagatcatagtgcagaccaagtgggtccaaaccaaaaggagcgggaggataggtatcaaggtgggattcaaactc

SEQ ID NO: 46316 - DNA, 15515 bp, Oryza sativa
actgcaaatagatcgcattcataatctcctttttgttcatgaggaacgtacttcttttcctggaataagaatgaaggaataggacatgtgccatttgtaaatgagcaggactgtactaatgattgataatgctttacaataggtctaaaatacagaacgatattacttgatatatcttgagctttagtcccccaatttttttggatgtgcaagctaagcgacatggtttcaggcatataatttcctagatggaccatgtgcagcatgctttgagtacttgcttgcttgctgctttggaagtcccctacagtttctggtgttctgatggatcaaacaagaaaggatgactggaatctctggtgaacaaatcctctccagtctggacggtgttctggacggtggatacttgtaatgtgtttatttgcatctccactttgggacctccagcctctggcctctccgatttgggctagattccgcagaaaccgggccagatcccacaatgtgagctatccagcgattttgaacagaaacccgcagtggacacagataccaaaggatacactttagggatgagttgtggtaggagtaccttgcagcatagccaatataaaacctgaatgcattgagcatgtgaattattgcatactgtgtgcacatttgtttttgtttgtcgaaataaaccagtaaatcaaagtaaccatgcttccacagtggtgcacaaatgaattttcctggcatggtttgcttgttttctttagcatagaaacatgttttcgacttatgatagcgctgtcctgccctttgctctccttttcttttcttcttttttctttttttgccgggtcggtcaaagttgtcagcagtgaggcaccgatctttcagcgcaatccacatgaagaagcggacgcacgagggggccctggagcgccatagcagctcgccgtagggacaattctctgttgccatgaagaactgccctttgcttctttctggcagaatagcatggtttaggttaatgaaatagaaacaaaaaaaaaccccatgttctatctatgatcaaaacatttgtttggaggagctgcataattagccttgaggcaagtgtgactgtaatatcatgggcagtaaagtgaataggcattctaaagctgcagtagataaactgcatccctccaacttgggccttgtgtatgttatgctcttcttaacccgttatagcttagagtcagtctacatcagtagagcaactcttggttcgtttttatatgatatcacccatcacgattcacggttgccagactcaattcattgaagtttatatataactgaccacagtggatattgagctctccgttgcttgtgtgagagcaaaccatcagcagcaggatagtggctatttctcttttttttttttttgtggagaagagtattttttatccggcctctatatccatttaaatatatagtcttaaatcgggaacttagcccatcaaacaacctaatgaatcttttaaattaggaacttagcctcttataaataatctaatttgaaattcacttctaaacttagaacttaaggtcgtgttactcaggaccttggtttggatcagcccagcctgttagagggttgacacctactgggccgggccttgatttcccctcctggctatttaagccaaatggatcagaagcattcacacgcccaaaagcccaccaccacccaacccgcccaacgccacgtcaccgtctccctcccaactcctcggcctcgtcgtcgtcgtcgtcgtcgcaggacgccgcggctcgcgcgccggccgattccgtgcccctcctcgcatcctccggtgagttttcccctccatttcttcccccccaaatccctctgttcgtcgccgacgcggggccgatcgctcggttgttgttgttggtgatggtggtagttgtggcggtggcggtgggggttggggtgggggttttacttggtgccggaatccgcggcggcgcggcgttcgtggttcctcgccggaatgttcttcgtggttttcccgcttgttgagctctcgtagttcaccctagtatgactacggttcgtggcgtcgaggttgttggaattggattggtcgtcctcgcctaacggccaacctgtttgatgatttgcctgtatcgtttagccttcttgtttcatgctaatcttcgtatggcttgtgttgattcgttgtggattttatggatggattaactcgattctttcttgtggttcttgctcccctaggcgggatggacgaggagaaggcgagcaaggggaggccgctcaatgccccctgcctggatttggacctgaacctggatctgtttgctgcggccgtgcccgatcccggatgcggcgacacggcttcgccggaggcgagcaagccggaagagaaggcgagcaaggggaggccgctcaaagccccccgcctggacctggacctgaacctgcttgctccggccgtacccgatcccggatgcggcgacctggctttgccgggggcgagcaagccgggagagaaggcggcggcgacgaccagcaacaccgatgaggagttatgtgcccacttcgtacgttttgaggaagacatggtacagttcatatcaaagctcaggtcctccaagttcgccgcgaggtgtgagcattacctgtgtgagaacaaggtggaaaagagcagtatcttggtgtgcatcgattgcagcttgcctttctgcattggggacgggaccatggacaagccgcagggacacgcccggtggcacgccgatctggagcagcattgtgtcgctgcattgttcagtaaaccggacactctgtactgcttcatttgtgaacgttgtctgaatatggaggtcgatgacacggaatcagaaagcgacagaacggaatgcagacacttattggacgaggaagacgttactctgattgtgtcagaggtcaccacctccaagaacattccggcgtgccaacatcccgggtgtaagatcaatgggaggacccgtatcatggtgtgcacgggatgcaacaagcatttctgcactagagctgaggccaagaaaaaaccgcatggacatgcccggctgcatgcgcggaagtttgaacaccattgggttggtttgtggtacagtgatccatataaggggtactgcttcaaatgtgaatttgacttgaccctcagtgcaccgactgttgagcaggggatggtgtttggcaaggaattatttggtcaagaatctggattagtgaaggggcatggctgtgttatcagagggatgccgaatcttggaaacacttgctacatcaatgcgttgttgcagtgcctatttgtgcttggcaagctgcgggcaaggatgttagcaccagatgctccttcgtatatccttggttatgaactgaaagagctctttcaggaggtaaacaacgttgataacgcacaactccaactgaaccccacgaagttctttgcttgtattcgtgttttggatgcacggttcataagcagtgatatgcaagatagccatgaattgctttgctttttactcaatgaattggataaggaggagaagtcaatggtgcctccagtatctcctacagttgttgattccatttttcgtgttcaactgtctgctaccatttcctgcagccattgctcatataattcagtttcccatgaagtaatgtatgagctctcagttccactgccatcagagaggcctccgccaaaaagtattgcatcgccaccaagggacataagttgcatgtctcgagagaagactggtatcaaactattcccagaggttgacacgagtaacaccgaaattgtcaaagcaattgctgaaggcagtgtttctcatatcgctagtttagaactgggagatgtggacaaagagaaaacatctgagcctttggatggtggtaagtttatgcattgtgtttctaaataaaaggagagagaacatttttgaacagatatgcaggtatagagggtttcccagaccatgtacatcttttgaggaataaatgaaagaaacagaggagtattgtagtcacaccaccattgtttttctcatcataacgagaaaacgggcacttttttcggaatggagctccaattctagtcaaacagagaaaaatttgtaaggacttactaacacatggactgaagaaatatctagtaaaccttcaggatggctacataaaagaagtatgatatttgagcactgttagcatggcagagttgtttgtcgtagtctagcagttaagaccttagagtggaagactgtttatttgttaagtccttgtcttcatacataaaattttgctctagaaggttggtttacttaatcaagtatggtgattctcgaagaaaggcagcttcagatcgtagagaatggaggttgatggttgtgtgttgttgctgatgcagataaattatagccttatatatgcttgattctgcagattctgttgaagtggaacagcgctcgccaagtaaggctgatgatttagggcaaaatgacaatgctggttttgagaatacgtccggtgagccccaagttagtatagaagccaagaaaaatgcttgctctgtagaaggtgcttcagaagacaaggggaaagctcagtttagcaatatggcttatggcaaggcaaaggataacgactctcttgcatcgattgaagagtgcctagcactattttttaaagaagagctgctggaatggagatgtgataactgttctggagtttctcaccatctgagcaccactggtagtaaagatggtgaacagataatggcaagcaccaacgaaaacacaataattgacagagatcagactgtgcagttggacaaggtagcacgccagagcgagcaatctaaaaatttggaaagtttggcactagaatgcacttcaagtaagcaaccacatggttctgattcagaacgtaaagctatgctcgcaatggacagcattactgaaggaatcaacacactacctcctgtcaagcacacatactcattgcgcagccgaggtcgaccaccaagccataacaaaatcacttctgggatgatccatggtgaacaagacttggcctctgataacatagccaacaaaaaaactgattgccatgaacgtgttcaagaagctgtatctagttgccttccagctgaggaaccggacgacctgttgagtggccaggaaaataccagcagtctagatcagggtaagtggaaacaagtaaaggtggatcatagtgcagaccaagtggatgcaaaacaaaaagagcgggaaaataggaatcaaggtgggattcaaactcgtgttattaacaagctgccacctgtattggccattcatctgaagagatccaaggagactggtaaagttagaggacacgtgaactttgaggagatccttgatgtaggacagttcatggaccccaggtattgcatattagcatttctgcatggcaatatctatataagcatgtggcagttccaataaatttatgattcacagtaagcaatttttcttgtttgtatattttgactagctttactgatacatctcattagaaaatcagaattattatgttttagagatgactgcctttttgtttgtaggtgattaggtgcctccaaatgcattttttcaaaaatattagtttggccttattctggttttagtatttggcattagaagggtataattatatagattttttaggtactgaaataaatatcccagccttcgcaccaacatgttttaatggcatgttgaaattcattaaagggcctttattcgttaaatgtttgaggatatgagattcttgttagcaatatgcagcattgaggatatgagatcaaaataaccatgcctaacatctagtttgattgcttttgtttttctgtaaccttcagttctgaggacaaagacaattccagctatcacctagtcggtgtcattgaacacattggccccagcaccagttcagggcacatggttgcttacgtgagaccaaatcaagagcagcctgacggtggcacttccccttggtatcgtgcaagtgataccgacatcagacaagtatctctagaagaagttctcaagtgcgaggcctctcttttcttctatgagagaattggaggctaacgtcgaaggaagtaaatttgttagattagcaagcattctttggatggacaaggatccattcagtagacgtcgtgatcaagtccaattttgtttgctttggctgagtcattgtaggacctgcaaattgactgtaatacgttcctgcccagctgaatagatggtggccggtgttcttaatcagctagtctgatcacattcgtaatctcctttttttttctcatgaggaacgtgttcttcttccctggaaaagaatgaagaagaacacaggactgtactaatgcttggtaatgctttacactaggtagaaaatacaacgatattactacttgatatgtcttgagctttggtcccccaagtatttttggatgtgcaagctaagcaacattgtttcaggcctcttgtttccttgatggagaatgtgcagcatgctttgagtagtacttgctcgtttgctgctttggaactctcctagaatttcggtgttctgatgcatcaatcaatacaggatagcaacttcgattctgtcctcgcggattcggcggcagattctaatcgttttctttcattttttcaatcaattctgatgtctactggatactgcagctcgcattgaaactctcactgatgagagtcaggagaagggtttacctttccgtttttaaatgaaaaccactcctcattgtattaccgaaaaccaaccagaaaccaataaaaagtggtgacttttgtttaacgtagtagaatacagttaatttcgattagtttttataaaccgggacttggcgatattttttttaaaaaaaacttttaaatgaaaactgcccctcatcagtttaccgtaaaccaaccaaaaaccaataaaaacttataaattttgtttaatgtattaaaaaaggttaatattgatcggtttttataaaccgggacctagcgattttttttttgaacactgggcagacaatgcagcagtatcatcatcgccgtcatgttccacgaccaacaaagtgggctacgggcatacagcccagtacaccgccaaattggcacgctggtttcgtgccatttgggccaaattggcacgcagaaaccgtctccggccgacgcctccgaccgcacgcacgcacgcacggccgcaccccatccgtccctccattaccaccacccccaccacctgccaaaccaaaccaaaaccggttacgccaaacgcaaccgtgccgtgcaccggcgcacacattgacaaacaaaaacccccgcaaaatgaagaaaaatcccccacctcgccgagatccaagcgaccactcctccctccctttcctcctttgcttttattaacccaaagcagcagcagcagcagctgcttctctctctccccctcgccttgtccggacacacgcggcgaggcaggcttggccgcagcaagaacgagagagtgagctcgatccatccatggaagggagggtgctgcggcggagtgtcacgctggcggaccagctggccgccgtggggcccgcggggacggccgccgccaccgccgccgcggggtcctgcaacctccgcgacctcctcaagctccgcgacgaggacgacctcgccgcgggccgccgcgccgcggtcaccctcgcgtcggccatggcggccgagaggttgacggtggcgcctgcgtcctcggctgccgcggcggcggcggcggcgcgcaccttgctggatatcatccgggatgaccagctcccgtcgtcttccggtggtggtggggaaggtggtgaccccctcgtccgccgcgcggtctccctgcctgctccggttacggcgactcctcctcctccgccgccgccgccggagacgccgccgcgacagctgccgtctgtgtcgccgccgacggtgggggaggaggaggaggaggagcagggggagagggtgtccctgatggcgctgctggagcagacggagcggcagtggagcgccggctcgggcgcgaccgtgcagcagcatctcgcgtctccctccgccgccgcatcggcatcggtatcggcggcggcggaggacgaggcggaggcggaggcggggaagggggcggcgggcggcggctgctgctgcgtgtgcatggcgcgggccaagggcgccgccttcatcccgtgcggccacaccttctgccgcacctgcgcccgcgagctcctcgccggccgcggccgctgcccgctctgcaacgccgccatcctcgacgtcctcgacatcttctgacctcgccgccggcgaccaaggttgcctccctcagctcgagccaagaaccccactgatccagacatagatagatctctcctctcctctcccctctgttcttgattcagttcttcgcaaatgcaaatgcaaaaaaaaaactgcaaagattagaacctgttcatcagcttgttgcaacttgcaagagatcaaacattctcttcatgtttcaattccccccaaaattcaaaaacctagtaccctggatcgatcaaaaggtttgttcttgcgtcctgtaggaacgcatttgattcaaccatcaagatcagcagatggtgggtgggtgcctgcttgcctgggtggtggtaggttaaaaattagtaaaacttttgactactggagtacagattagtagtaattgtaaatctggcagagttttttttttttcagttcttgtccaggctccagctacgcaatgtttgaagatctatagtaagagcaggtttacaaaacctcacggttatctcgggcggtaacttttcgcatggttaaaccacgatgtgactcgcggtaatacgtgtttttcgtgatatccgataaccgttaaactgtgaggtgacgagaaccacatccaaaacggtttggtaaataatacagtttttgaaaccatgatatgcctcgcgataacatcgtgtttggtatccgataaccagtcaaactgaggtgacgggaaccatatccaaaacggtttggtaaatccttgagtaatagtagaaataaatcaatatactggctgcagtgctagtgcgttaaataactccaaatttattgctccaaagcttccaattatcaacctcacttcattgtgcattcctatggtatgaactcatttacttccacggagggagcgccatttcaaatgctgattaccctctgatgtcacatgatttggcgaaatttatgaccagaagtcgaaatctcataaatttgcgcgacaccgacgcaggagtacaattagtagcagtatagcactaatactctaatagcatactagtataatctcattctaggggtcctactcatcggcctaatgatgttgacctgataaaaagaattcctttgcactaatcctccctttctttttcttcataataatggactaatgtggcaaagcagacgccaaaaggtttggtcgagagcatccaaatgtcaatgctggggccgtgacagcctgacaggtggtcatatgtatgtgacagagttaagcctgatagagcactgtcgcgatgtgcctatatccatccatctcaatgtagcataattggataattaggttcgattttgggggtattatcttttgaaaaagggtgtgagcagattgccacctccatccattttggtacgaggttgcgtaagaaatgtttatttagatgcaccaaatgaccaaattttgctcgcaaatgtcaaccaatcgtgatcggtttttggccaacaacaagagcaaccagtcctacaatcccacaattttctaaaggctgatttggtacaagaatttgctctctcgaaaataaattatttttcatatacgaatctgaatacccctcccccctcccctcataatataagaaattttgactttttaattgcactgtttgatcattcgtcttattaaaaatttttgaaattattatttattttatttgtgatttactttattatccaaaatactttaagcacaactttttattttttatatttgcataaattttttgaataagacgggtggtcaaacagtgcaagtaaaaagtcaaaaattcttatattatagaacgaagggagtataatttatgttcagatttcttctataaaaattgatttattatgcaacgaagtgtatgctatatattgctcatgaggatcttcctttttttggctgagaagtactccctacgtcctagagaaggtaatccaatactagatgtgatatactatagcacaacgaatctaaatacaagattatgtctaatgtattattatgttctagtgcaaggttgggtatttttgggacggaagaagtagggttgttctgatctggttagttaagtaaagttccagcatcaggaacaaagtacgtaatattccgtggatttggacgcttgcccgtttactggtcaagatgcaatcatacgctccggcatttttatgcatgtgtgtgtgcatccgccaatgattctgtcgtcgcggcgcgggcgggcggcaacacaaccccaacaccgcgtcgcgcacgccgagcggaggaaaccgtggagcgcgacagcaaaaaacggtggccgcggccggcacgccacgcctccccgcgcgcgcgcgcgtggccgccgcgcggggttttgcgagggtgagatcccggtgccaaaaaaaaaaaattgggatggatcgcgtcgcggggtgcgtgtgccggtggaagacggtgaattggtggtggatcgagaccgcgggattcctggcgtgcggtcgcaagccggacgccacgccacgcgcggctgcgcgcatgtggattgtggagaggagatgggtttgatccgcgcaatttttcttttttttctttctttaacgaaaataaaagaacaccgcacttgctgactgactcaggatgtgttctttcctacgtgttctcaactttatctcactcatttttcacacgttttttcatactgttaaacggtactacctctatccccaaatataagaatctaggacaagttaaaacgtttcttagtataacgtatctagacggactccctgtccaaatactatgtacttgaaaacgtctcatccaatactagattcttatattttgggatggaggaagtatgggtctgttcaatatagctaaactgcagctgtacagcagcaaccgctacagtgcatggtaaagaaaatatatacaccggctatacaacgcacctggttacagctgcagagtattgttgccgaacagagcttatgttctttgcaaaaatttctatagaaaagttgattttaaaattacattaatttatttctaaaaaagttaattaattatgtactaataagtcgttccgttttacgtatgtggaagatgcaggaatggcaacgggtcgggtcgggcacgggtagagcaaaaccatgcctgaccccatgctcgtcgtcgctcacccaaaccctacccactagggttagcgggcaaaactctatacccgtacccatgcccgacgggcacgggtatacccggtgggtacccaatggatcacacatgaataataactcgaaagatatataatttaacaaagagaaataaaatcaacaatttactaaattatcagttatcgacaataatttgaattacatcacaacttattactaattagtatcacaaatgaaccatgagaaaggagtataagaattaagagataagtcaaaattagctaatacatatgtatcgggtcgggcatgggttacccacaggtaaaaaatgaaacccagttgttgcccacgatatctacgggtctcgggcgggcgtgcccacgggtaaaatatcacacctacgcccgtgcccattgggtcgggtatcgcggatacccggacccatgggcaaaattgcaatccctaggaagatgagctcctagctctttaagaagaacaaaggcacaaagccactgtgctggaagttttccttttttccctctggtccattttttactttgcaaggtgtgtgatctttctcgagtgcaatctgacgtaaccaaggtttttattttatggatgagagtatgaggctgtgtatagtgcagatggcgagagtagccgtcgtgctgctagacggtccgtgttggatcgttcccgatgtgttcaacttgtttcttgatattgatacgcgatgctacgtttctctttagtattctatgtttagggttcacagtcccgatactgaatcaaaatttgcttgcaagctgtatcattggatttcgcataatccattaataaatcgacaaaaaccaataaattctgaataaattttgttaaaaattaaaatttcagtttgatttttttaaaaaaatgacgaaaaattaagtggtttgtgttttttgatccggtccaaaaattcgaaccggattacactttatttgtgagccctcagtttgtttaaccttggtatgtgtataattaggcgattttgacaattggagagttcatgttcagggtaatattgatctttttctgcttaagtaatcaaggtggtaggtaagcttaagtatatactgacaataatgacataacatcaacatcacagaaaccccatctaaggccaaaatctgtataacatggtccaaccttgttagcattattgcatcctgtttaaggatcaaacaaagaaggagtataaaaatgtttaattagatggtccaaaaccaaaagcatactactacttcagctgacaccctgctaccaaccctatcaacctagtaggagtagaactgtacaagtagataaaaaatcatcaatctcgcaggaagaaagctgcccaaaatccggctgtttgacgctttcccttggaattctgcgaacaaccaaacaacagatgacacaaacacaatggtaaaaacaaccctggcagcgacaagtactactagctgcattattcttctccccatgcatgcttcatcagagcaatcggacccatcgagtgcagaatttgcaggccaagtgttgtagtactgtttccttttcgggcgaataaggttgtggctaggtggtgtttggatccagggacttaactttaatctctatatttagacactaatttagaatattaaatatagactaattataaaactaattacataaataaaagctaatttgcgagataaattttttaagcctaattaatttataattagagaatgtttactgtagcatcacataggctaatcatggattaattagactcaatagattcgtctcgcgaattagtctaagattatggatgggttttattaatagtctacgtttaatatttataattagtgtccaaacatccgatgtgataggtacttaaaagttttagtcctatctaaacaaggtctttggatctaaactagtccttttccatcatatcaacctgtcatacacacacaactttttagtcacatcatctccaatttcaaccaaaatccaaactttagatccaactaaacacagcttaaagatttggttaaagtccaatttacagtacgcaacttttacaaaagcctaatttaccctgtacttccataaccttcacccttaatttcttttacactggacaaattacccccaaagtactgtgcagtatggttttggtcccatctattcgcaatccagctagcaactgtggtttaccccacgtgtcaatctcttatccatcttcttattatcaactccctcttctttctcaggactggatgtgacgcattctagtacaacgaatatagacatgcctctgtccagattcgtagtaataggatgtgtcacattcagtattagattggttttttatgggacggaagaagtatatgttgtatatagatgctctcggatggcttggaaaatgactatagtaacttacaagtgtaccactagaagtggctctagagcttaaatgagacccatagctgaagatagctttagagcttgaaggaagtcgacaataaaatgaatcttggtttggatccctgtgatggtggcggcctcagatcttacgcttagagccatgactaggcagcggctagcgcaaatctgatgacaaattgacaacaagctcataatagctagatcaagatcaagttgccacctccaccacatactccctccgatgatgggcttgttcactttgctatcatttttagccttaccaagttttggcattgccaaattttagtaaggttactaaaattttgacaaggttatcaaattttgacaacattttatatgtacatactaaaatttggcaacaaactaaatatagccacttttttttaactttaccaaaaaaaaagtaaggttaaaaatggtagcaaagtgaacaagcccgatgacacattttcacataaaaaaatgatgactcaatcttagcctccatatccatttgatacgaggacctccatccaatcaacaacttaagtactctctccgttttatagtggacttacattgtgaaacggaagaagtaaggctgaacaaatagtgatggcttaagaaacaggactatgtgcaagctgtagatggcaacctacaaagacaactagagcttgagctagcctgtacaataggagaaaaaggatgggcaatggtgtggatttaagcagagagatgatataatgtctatttctaccaagctgattatgacgacacatgtcaaatgtgtcctgtgcatcacataggattagaatcgcttcgaatttggatgggaggagaggataattcgtatggtattaaagagttgagaggtaaattatttttttcccgcaaagttaacggtgtaaattggactttattcataaaaaaaatactatatctcgtttatacctccggccaaaactatactgttaaccattgagggcttatttggaatggaggagaaacacaagaaaaatgaaggtttttggttcctatggattactttactgtggcgtcattcggatcacaggaaaacatccgtaggaaatacatagggaaaattcctgcgctagccatatcactggaagatcacatgaaaaaaacatccacgctgacctcttttttctctccctctgcgtgggaacgaggcaaatcatgccatcaaccaactaaagcatattattaggttgattaatgttgtttaattcactagtagcatgtgataattttgtaatagtgcacctattttcttaaagattcctatgtttttcctttactccatccaaacacctactcacatgaaattcctatgttttcaaattctctgttttacacttacatttctatcatatttctatgtttttcttattcctatattttttcaatcctacatcccgaatgagtcctgaaattgtaatggatct

SEQ ID NO: 46317 - DNA, 5580 bp, Oryza sativa
ttagaagtttgtgtgtaggaaagttttgatgtgatggaaaagttgaaagtttgaagaaaaagtttataactgtacaactcgataactttttaaatataaatatttttcctttaaaaaaactccctctatctcaaatataagcatttctagctataaatctagataaacaattgtttaactttatagctagaaatgtttatattttaggacgaatatagtaacattttaaatatgaatatatttagctatgcattagtacattcagatgaatagctagaattgattttattttggattaggaaggagtatgaagttgagcggttggcttgaccgatgagtcggcgtgtgcaccgactggccgggccatcttattcgtggctgcatttttgccgtgttgctgcacaagaaagatcgaaagaaagagggctagctagctggctgggtggctggatggctgtctgtccgttcggccggttggatcggacaggtcgagtgagtgacagacgtacttaaaaaaaaaaaagacaaacctttatttccgtgtccaatgtttgactctccgtcttatttaaaaaaattataaaaaaaattaaaaagataagtcacgtataaagtattcatcatgttttatcatctaacaacaataaaaatactaattataaaaaaaaattatataagacggacaatcaaacattggtacgtaaacctgcggtttatctttttttgaacggagggagtaactagctaccggtggttgttgaggtgcgctaatcagtcacttgatcaacagcttagctagagaaatgaatcgtctagcggataaaggatgtgagaatgcggcagtattgtttaagataatggatgaaagttcggtcattatttataaccacaaatgaatacacacaatcaaaagttacattaataattatattctagttttaagagaaaacggaaatactaggcttcaatcttatgctgcatgatgagacctactacatcaaaaatcgcaaggaatcgatcattacagtctcattcatttctccaacgagagttagataaagataaaaatttccgtgacatgttttttaaactactaaacgatgtgtgttttgtgcgaaaacttttaatatgaaatttactctaaaatatcagattaatctatttttcaagtttgtaataactaaaacttaaccaaccatatgttaataccaccttgttttacgtaaaacacttaatctccatcttcatttttatttacaggagaaaagaacaccacatatatgtctaagctcctgcacctctccacatttcatccacctttggctggctccttttcctttgccatcatgtctctaccttctagtgcctttgcttggcgatgctatccaatgaatgcagagaagaagaagccactccaatgcagcttgccgaggcacgatagattcggacaccaatggccgccttccatctaccccgaatgccattggaatcattgtaccacctacaatatcattgctgttgacgttagtcgatcggccaccgccaccattgttgaatactgacacatccatcacggcctcgccctatcaccatagccaagacactcctgggtcgctctgtgggagctacacaagagcccatgcgtcgatttgagtccttataaaaatgcaggagttgaatcctttagcttatgatcgtcaaaacatcttgcagctttgtcaatcctattatgaatgtcaaaacatctcgcatcttgtcaatcctagcaaccctttttatgctactagcaacctcatcgtttcccctatataaaatcaacagctagcaaaatttaaaatttaaaacgtaactttggagtttattttagttttcaacatagttttcgttctcaatattggattttaagtctcaaaggaaacgtataaaaaattttagtcataaattactttttttatcgttgataagctattttggctgaaaattaactcatggccaactaattagagctagatctttgagaagtcatttcagtgcaatgaattgcatttcaaatcatgtactactatatttctaaaatggaaataaaattgatgagttaaaaaaactagcatgcatattacatactgtactatactcctactagtatcatcctagcacattagggatcgatccgtggcagggttcaccaaatcgtaaaaaaagggggtcaacggttttcaccaaaaaggggttcatgaaaaccgtttgaaaagcattgaaaaaaatcaggtcggattttgtcaaaaaatattaaaattaagtttgaaattttttacttgataaacaaactgagcggttgtaatctccaactagtccgggaaatagaggaggagctacattaggttaggacagtgcccaatatataacctgacttaatttcttttctatagtttgtctatttttaccatatatgcatcctttcagttcaaattcagacactcgcatcagtgtgaactcgatataaatagagtagagtaaagcaagcgagttgtacctcccgccattccgttctagcaccccaatccccgcggcgggaaatctggttttgtgaaatctaactggttttcatcggtctggtaaaccctaataagtggatcaatggaaggagaaggaacggatccagccaagtccagtccaggggttctggaacggatcaatcatgcatcaacggaggcattcaagaagctgcaggatagccatggccatgtcccctcctgcttcacgtacgctcgcattcactactgcccggccctaattcttcttcgatctcgatcgctggcgaggaacagcaagcaatgcagccgacgacgacattggattctatgcatctgcacgcgtgcgcccatccccagtttatagtatcaatcatccatcgatcgccatggctagctagcttagctagctatatgtgtcaaatcgctgcctgcttgcctttgtcggagcctaatctgatttccgtgtattattgctgcctgcaggcttttttttttttttaaggaagggcgaaagctttaccacttttatattgatagagaaggaaaaaaacactaacaaagtatttacatggtccgtaaaataaaaaccgaaaggcgctactctcctaaagggattaattctgtgatttttgcctgtgatccaggtccgtgccttcgatgatggatggatctatcgattcaagcagcatttgtaattagttcgtggagtacagtatcagcaggtgtagtatggtactgaaatttatctcgatgatatgatatgatcatacattatgatgatatagggtccgtttagtttctcaaaattttttcccaaaaacatcacatcgaatttttggagacatgcatgaagcattaaatatagataaaaagaaaaactaattgcacagttatggaggaaatcgcgagacgaatcttttaagcctaattagtccgtgattagccataagtgctacagtaacccacatgtgctaatgacgacttaattagtctcaaaagattcgtctcgcggcttccagacgagttctgaaattagttttttcattcgtgtccgaaaactccttccgacatccggtcaaacgttcgatgtgacacccaaaaatttcctgttccccaactaaacacacccatagtattcaagtcgagaagatcggatgggttgtgcaggctgcagacagatcaagggcttttaacaagtcacagtactatacactgctggtgcttgcagtactgctccatgcctccatggaccatagatccaagaacagaacctcccaaattaatactccctccgttttaaaataaaccatttctagattatttagcaatgattaagattgatgggaaatttctctttcaatcgtattattggttgaattttgaattgcttagatttcctttttaagcttctgacgagttgaaaatgtttggatttttatacataggaatcagtgtcctggaatcgcttatatcgttacataaattttaaatcctaaaaatgcttatattttaaaactggtaggtgatagcaggctggtacagtgattttgccacggttctcagacatgtaatagggctccttgatgacttgaagattgatgattgatctgcccatgtgtacgtacgttccattcatcagcatgcctgcctgcctacctgcaatgttttttgtactcttgcctgcaaagttttttggattcttgccacactacttccaagttccaaccctgaacattcctagctaaccttgctcaaagacaaaaaacttgcacaacccaactcacatgtatacacttctcatttcaagatcctactaatggccagatgattagaaccaactcatcattatcagtatcagcagcagcagaagcagcttgtcaacaagacaagaagcaatctcccaattctcttcagacttcagagtaagctggtcccctgcctccacactatccttctcttcactcttctcttccaggagactagtagagaggagggaccagcaaggaaggaagtgagatgagatgacggctcctctcacatctcaattctcatctgccagaattgaagcccaccaagtacagtagagacagtacagttgagccaagcatgtcatgtgccggcaagcagcaatgcagctgacctagcacacctctccctttctttctttcatctttcattcctatctcccttgaggacagatgccaattaatgtttctctccacaagcaacagtgacatactccctcagttgcaaaaaaaaataaatgttcgatttttagagttcaaaatttatccttaaaatgagttgtttctattcttttatctaccacctgtccacaaatcgagaaattttatccattcgataccatttatctaccactgacaatactagttttctattaacaatgggtatttgatctttttccctctctattgatttctttgagatggctataaattttgagacaaagctacctgtccatttatatggatggatggccctgatctgcttgtcattcagtcagtaacgagagaaaccaatgcaacttactgtagttaccataacagcattgcaggtgatgtatatatttttcattttttattcctcctggatgaacatacacatgacacatcgtatgcgttacaacttgagaagcaccagtgttttttacccaggtgttagatctgtcgttagttccaaattaaccgagagatatcgtacacgaatgttggcgacaggaaacagattctagcagctgtgatggacccattgtagtggcggccattcactgatcactagtaggaggattgtacgatgtagagaagcagcagcaccagctgcctcctcatgatgaagtagccgaaaggatcttccattcacttggagagtaggccaaagtaggggttttccattgcagatgctacctcaactccagcagcattgagaagtgccaagttgatattatccctcggcattaccaggtagccgctgatcgcgagcttcatgaatccgcacagctccaggaattctacgcctccttgcaaat

SEQ ID NO: 46318 - DNA, 2317 bp, Oryza sativa
  unsure (1)..(2317): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctctgcaaacatgttatgatatagccaagaaagcgtttttcacaaaaacaaacattcaaaaaaagagtggagctatttctatcatgcatatttgatatttcaacctatgcctctacccaaaatgtggttacaaaagctaggacactaaaggcttagggctttagggggagcttaagattctgagatatgagaagcggctggttgttagctagcttctaagaatctggaaaagctgggtttcctaacttctagcttttagttcattttctggattttataactacagcttctcaaaatctggaccaaaagatggactgtttgggggagcttctgattatgggagaagttgcaacagctaaaagctcccccaaatagagccttaaattcattaagggtatagatgtgaagggcattttggtcttttcctctagtcttgtaatctactatatatgtgcctattaggctaactccaattaaaactgttcattcattccccaaattgtgacatggtatcgtaacaaaagatccgccgccgagccgcgagccattttctcgtcatccagtcatcagtcgtcgtcagttgtagcagtttttgccattatttgtattcattctcttgtgtcaaagcagcagcagcagcagcatcaatcacctcctctagttgcaaccatcggctgcctcgtccatctgtcgtccaacgcgcctcttcacttcgtcctctgccacgtcttgtcgatttgtcttccgtcagcaacggagtgaatggatctctgccaataggctgctcctccccgagcccaaacagtgaaaatactggaaggaggatagggattaggaaaaagcaaataaaaatgaaacaaatggaacagtcaataacaaatactcccttcatttcatattataagttgtttgatttttttcttagtcaaaattatttaagcttgtaggaaaatgtagaaacattttcaatacaaaacaaacatattattaaaatatattcaatgttaaatttaattaaactaatatagtattgcagatgttatcaaacgtaaagaattttaattaaaaaagtcaaaatacttataatatgaaacagagagagtaacagtaacactaactactgacgcaggcatctatttgttaaattgcattcaaactaatcagacaaacatctctcatctgtctatcagtttcgtccaggcacaacataagtagaaatgaataagcttcagcgaaaaacaacagaaatatgagaaatatctgccttctataaggtgcgaaagagggcctttttgaaaacaaaatgcaggggtatttgtaaaaaaaatatggaccgttagcaatggtagcggtaataagggttcctttttgaaaaatgcaggagggaaggaatcctggccattggatctatcaccaacggttagatctccagtacaagccattcccccgccgccgccgcctcccccaccggagccggcgagccgccgcctccccatcgtcaccgccaccaccaccacgtcctcctcaaggtctacggctcggcgccgctgccgccttcccccaactagtgaagccccccccccccttccgcctctctgctcgccatccatgccccctcttcctcgccgccatgctagcagagtcgggggtggggcaacgatcggcatctctgcttggcggcggagattgcaagcgttcagccggcgacgaggttgtccgccgctcatgctcgccgtatagttcttgttgcctttgtttatgggtcgaagtagtggtcacataggaatggggattttaattccaaatgtttgtgcctgcaagttaaagggttttcgctgctaattataatatactcctataagacaatgcaatgcagcttccttgacgaaagcactagttcttgagatggtgaattggtgatggcacgataggctttggcgatatgtgcaatataagattggtcattctaaagggaattatggttttgctcttggaagtcttacatacactttagggctgcaggaat

SEQ ID NO: 46319 - DNA, 2758 bp, Oryza sativa
gtcttcctagtgatttattatgagcttttcaccccagaagaggttactgatccagctgtaagcatggtgttgattcaagaggaaacttaagtaggaagaaaggtataagtaaccgcaggaaggaagatgtcactagagtctcctgaggtccaaagaaccatctgggaagaaaagataagaatgaagtgcagaagaagcaaaagctctgatcctcctcaaataattttcttacttccttctgcatttggagtaatgcattgctttctgcactacttatagaggattcgtacagccacctgggtccaaagtttgaaagtgaaaagaaattttgaaaaggtaagaaattctgttcaccattcatcttgttcatgcagtcgaaaactttcaacattttcctttgatgttctgtcaagataacctggaaaatgctttgattatttcgcccaactacttgaatcctatgttttgctgtttctaccatattaccatcctgtaagtatgcacaggtgtgatgccaaattatgcaaatgtctcagccttcttcagttccctaactgtgccataatagcctgtaattctagactatgcttaccaggcagttttccgttctcctattcaaccaagaatgataattacacaaataggctatggaatgagatcagtgcgtggacagattgtagacattaaacttcagaatgttgtaactttactaaacatgagttagaagtatttgcatatagatcactccaaagatatctcaacttcactttactggtaacatttgctaattctttgtccttaaaaaggctagttcgcaatttagatctttaatttttatgggagatctagcttcaagtgtaccaacttttctcatgaggataacatttcattcctattttgttctaattttgcatttatggtcagtagaatgctcttattcttattcatatatgtatcttctaggatggctaccccacaattggacaagagaattcttagcgaacttgaacttatgggattccctactgctcgttcaattagggcactccatttttctggtatgtctatttcaaaaggaatacaaggtagacatattgtaataaactattttatggtaggctgaatggcatagtattcaattagaacagtaaaggatatttaatttcgtctatggttgcatggctgtaatcctgtttgtgaatttcttcaacacatatccgaatcggtttggttaaaacaatcggtctttatcaggtaattccagtcttgaatctgcaataaactggcttctggaacatgaaaatgatccagacattgatcagctaccactggtatgttatttataaaaaaataactgttcaacatgagttcattgaaatatgcattgttctgtaattggtggaataattatcaatcgggaaacctatcagaagtttttcacttcaagcattttaaaagagagcttccctctatatcagttacatacttacatagtattgcacattgtcatgtaaaatagtgcttttgttaattttcaccttttgttctgagtacttgctttcattttctagattccaagagaaatcaacattgaatgtggtgatacaccaaatgaagcgagaaatgacattcaaggaatgaggtcagctcttatttcttaaatggtttcagatgagagctgataaaatatcagagtattatttcagggaaaaggcatttttttccttccctgttacatagctacgtaatcaatcaagaaatctgcactctacatatccactgtatttttcatatggcaacagccagatatgtcctagtaatgctgtaggttcagaatctgatatacctcaagaaacaagtgtcttattggggatgccttacaagagcaattgcacatttgacctttggtactgctattataattgtaaaatgattgctatatggacctgtcctttagcctgtgcatttgataaatccgaacagttctgatgttatccattagttctcctaactggtacaagtacactgtatgtgttgatttcaccatgcatttttatcatgccatatgccattgtcaaatactttatgttacaaaatacaaacaagtggagacaaaaggcaccatctgttaatccatatagatttgtgaaacttgtatactcaagtaactcaaagaatgtatgatcgcattcttttcttcgatatgtgctgcactgtaaaatgtgtaataggcatggttgttttgtagggctgatgcccaggagagtaaaccagaagagtcaacagcagctggaagacagaaggtttactcagagaacttcctaattttgacaccttaaccattttccattacatcagtgtgttatggacaaaccctttattgttatacttgaaggagtaaaacctgcaaagtgcatcatgttgaggcaactcttataggaaaggttaaacaaggtggcaatttgcatcagtttcttttccaattttgtcagaacacatcctcagattctaatagtacactggactagaagttgtgcataagaacatacaaggggcaatagcaaatatattcccttatccttgtctcaaaattgtacttgatttgcatatcctgtttagtagtctagtgttattacattagacaatttgggtcattgttagatctgcttacagcatagttagacagaaaattaagcaatatttcagtataatttgcaaatttatatgattgaccaaagatattggtcaattagtgggc

SEQ ID NO: 46320 - DNA, 727 bp, Oryza sativa
tggtctacaatgtgtagtgcccctgtgctgacatcattttttttctgagagagattgttggactgcatcacatccttcagcatttcttgtcatgcaaaacttacttttgtcatacattgtgaagagggagaggattcgagctgctaaagatcttatggaagcaaagaggactcttgaggaaaatcaaagaaaacggtttgtttcatatgcaacttgtatgtgatattccaacttaagggtgcttacttaagacacggtttttttagtgcagtgtgatggagagtcgaaaagcagatcaagaggaggagaaaagaacaagagagagaatccggaagcgtattgaagatgataaggtccccctgatccaatggttttaacttttttttttaacttcaaaatttcccttcatcagtttttttttcagttcaatccaattgttttctaggatagttcaatctcctggtgccctcacaattgttcatttaaagtatggctatctgaaaccgtaaattcattgatcattgtaattgtctttttattgttattggatttccacattgactatgttattgccatgttatcacctcagaccacagtcatatgcattagtacagcctacattttacaattgcagttcattgcatgacctccaaacaaccagctagttcaatgatgacattgcttattgccatagtgtgattacactattactccatgaccagagtga

SEQ ID NO: 46321 - DNA, 714 bp, Oryza sativa
ttggcggggagagctttggggggaggggctacccgtggggggcaccggccgccctgagaagatactgctctatttcgaccgcggctccggcccatagctggcccgggggctacaacatttcaagtgcgagcacctgggcgttcgatcagaatcagtttggagcaactcggtggttcaggagatgtcgtcactcgccggcaggcacgcaccggtgggcgtatctccatgctgcacgcggtttaatggcatcatgaaccgcgctttgcagggccgtatttaagcggcgctggcatggctgatattctcacagcgaaatgctgaattaaatcttggcagacaccagaagcatcctgttgatattgtagttgtcatctcaaattcattgccttttccatacaagcattcttttgacttttttctttaaggatcctaatttaacctggaaacatcctagacacctatatctactattaactggctcggacaactagagcaccattcgaacaatagtctgttattcgacttttactctagagctgacattcattttaatctgaacaccttgttgcatatgggtatgacactcacccatgtgtatcctgatttcttgttactaataaaggatttcgcccatttctatcctatacttttaaataatgagatttctttatatcgtaatttgacctcttatgtttatgaaatagtaccccttac

SEQ ID NO: 46322 - DNA, 24182 bp, Oryza sativa
  unsure (1)..(24182): unsure at all n locations
ccctgcttcatatacattttctcctggccttgcattgataaatccttctgcaatccatctacttaccaaactactctttgcaatttcacaatcttctggaaatgcactcaagtataacaggcaacttcttatatcatgtggaagattataataactgagtgctaacactgactgcatggtctcgagatactcatttcctggtagtggagaactgataatttttttcacctcattccaatgatataacgattcatgatcagccaagaagctggatatggaaataattgctagaggtataccatcacaccttttcagtatctcttcagaagctagctcaaatttaggaggacatttctcttcacagtcaaaaattcttttgtaaaataaccttttggagtgagcgccatcaagatgtttcatttgataaacaaaaccaccatgagaagatgaagatgatattgccacttctttcacacgtgtcgtcaaaattattatgctaccatgactagttttgaccaatgcttctccaatgaagttccatggttccgggctccatatatcatccactacgataatatacctggcacatgtagttttaattttatcatggaagagcaaattaaagtctaatttatgtatacattttcaaaggaccaaaattataaatgatacccttccaaagaaccggaattagatttctaaagtatgctcatatgtttggttgggtgttagtttacaaaattcttgaaattggttttaccatttgtactacgaggtaattatagcttacatagcattaaacaatagtttactccggttcgcagcaagtatacatcaggcttccggatcccgaaaaaaaatagtgcttagaattacaacatgagcatttgtgctacctttgcctcatactagcaaatcctatatacttatacaattcatccccattaactctaattctctcatcccacaatgtgccacatcacctcaaattaatctagccatcagttatgtacttgcgaagatattttatgttttttctctatttcttatagcttaggataagttttcccgcagcaacgcatggggaaccatctagttacctaggaaagcttggcccactcagtgcttagaacacaatacatcaaactggggcacttgttttcttcgaacctaggtagtctagcctaccaccttgtggagctagccggaaagcccatgggtatttctcactattttccgtaactgaaccaataaaatgcaaaatggtttgtttttggccaactatttctatacctgaactagtaggtcttttggcagtgtttatcgtctactaattgtagcacataaccaaatcaatgcctcctgtagcatttagattacaagtattgtatagttggagggtgtttagaaaagttctgatgaaaatttgagttctcatgcgattgagcaaagttaaagataacaaaaatgaagattaattaccgaaacaagctaagaatggtcagttgaaaacaaatggatcattagagtgcaccttttttgtttgagatgctccctaagattatccacgagatttgctacatcatcccaagtgtttgttgacttgccaacttgagtagaaatgttgagtagaagctcctttatattcggtctctgagacaccgaaacaaaggccttgtactcgaattccgccttgattttgtcgtacacttgtttagcgagagtggtcttgcccaagcctgcacatccaacaatggataccatcctgacatcatgctgcgctgccgctgacgacgactcctgctccaagcggctgatgatgtcatccctggggccatcgatgccgacgaggtgcttcgtctccgtccagagcgcgcacagccgggcatcaaccttggtcgtcgaggaggaagcatccgagctggttggtacaagtccatggagagtgtacctgttacgccgctcgctgacctccaagacacgggccttgagctgctggatctggctcgcgatctgacggaacgctccgatcttcttggccatgcgcgccatcttggcggcgaggccgctttcgccggcgccatggaggcggtggacggagaggtcgatgcagtcctcgatgtcgtaggcgagatcccgcaccctgtccctccagtccttgctgagctcgtcgagctgatccgcatctgccagcgcgtgcagcgccttgttcatggtggtgagctcggactggaggaaggcgaggtcgtcgcggactcccttggcgtgcttgtactcgtcgccgaggaaggccgcgagctttgcgaggacggagttcatcgctccggtcgccgcgctcaccaggacgccctccatgcctgccagatcgaggtcaattgccccctgctctctacctcactctcgatcgcctctctcgttgtacgtattgaactcttgttggttcccatgatcatggaataattgtagaagtactcgcttcgtcactaaatatttgacatcattaacttttttaaacatatttgaccgcttgtcttatttaaaatatttaaataattatcaattctttttctatcatttgatttattgttaaatatactttcatgtttacatatagttttacatatttttaaaaaaacaaataagacgaacggccaaacatgtttaaaaagtcaacatcgttaaatatttagggatggaaaaaatagtatttaatttccctcgttgatagtgctgcgaatagaaaaatagggaagcgaagaattttgcacgacacctgccatagcgatagacaattttaatagtagtattttcttcgctagctagcctgggtaggaccagacgcgagtgagatttatccattcccgtgccttctctttctccatcaacggcgagcgtggcggcgaacggcagctgtacgtgtgatacttgcaggttgcagcggcctctccttccgaaggtcgtcgaccccaacacgttcaccgccctttgaactccccatcggccgctttgaaaagaaaaaaaaacgtagatattagagaattatataatatcaaataattagaatggtagggcttcaaacttagatcgtctagtccatcaccttatgaagctagtcggaagatccagatcgtcctgcgagttccggcggccctctcctcagcatcgggcgtgggtaggcggcctccgtgggtaggcggcccacgggcatgttgcccacggcggtgacgagcgacgacgccagctagccccgtagacagcaactgcgacgcgttcgccggcgtgatggagaggtttaggagcgcgtgggggccgtcgtcggtcggctctgtcggcacggcctcgaacgcgcggacgagaggccctccttctcgaagggccgcacgcccgccgntgagganagggccgccggagctcgcgggacgccgggcatggagggaactcgccggcaccgggcttggagggaggtagggaggaaggttgtggagggaggtgtgcgcgtgggagctcgccggcgtcgggctcagagggaggcagtgagggatgccggactaggagggggctgctccccgtcggcgagctggaggatgagcgaggagccgaggaggaagatgaagggaaggggatagaagctgacttgtgggtcccacactgctttttgggttgcaagccacggtggtacgccacgtaggcaaaagtggcaaattgttaagaagccatcacctaagaagggcaaaaaaaaaaaagtacaaatctaataggggtatttagataagtgccaaacgcaatagtggcaaatagttaaattctccggtatttacaggtttgtgcatgtttgtcttctgtgtaatcaaaaaagaaaacatggtttctctctcaacaagacaaccaagcaagagaaagactgatatattttcatggcacttgaccaacttaactctgaaataagattcatagtaagtctattcttataaagttgattctcattaagtgtaattaatattaaattctctctcctcatgacgccacatcaatttcattcttttgtcttcggatgattaagggtgcaaactaccccattttcaaaaagccagccttcggataattgataagggtgcaaattgcctcttctccaaaaaaaaccactccatacattttaattaattattgcctttaaataatcgaccaaatgtgcacgatatagaaagcacgtgaatgcattcgcgaaaaggaaagcacgtgaatgaaatcataacaaaaaggaattacacagcttatatatactccctccgtccctaaatatttgacgccgttcatttttttacacatgtttgaccattcatcttattcaaaaaatttaagtaattattaattattttcatatcgtttgattcattgttaaatatacttttatgtatacatttagttttacatattttacaaaagtttttgaataagacgaacagtcaaatatatttaaaaaagtcaacggcgtcaaatatttagggaaggagagagtactattttgtcgcaacccataggtccgcattacataaacgcatgccagtttgagtaaaatgcaccattagtaccacaacttgtgaggtgggtgtaatttagtcacccatcttgtaaaatgcttaaccaagtcactcatcttgtcttaaggggtgcaaatcacataaaacatatgccgttgggttattcgtaatgaaattatatgctatattaatttgttttggaaacatggtcacacaatccataaataaaccaacatgcaatgctgccggtagtaaaatccaattaaagatgatttttgttattgattgctaagtacaatatggtcatttttattaaaagtaggagtagtagcatatgagtgttaatttgtaattttaatgcttgccctgtccacatggctaaaaaatgcatgatgttaggtcgatatggcctgcaatttaaaaacaactaatccatgtgacaatgtatttggtaagatttgcaccatcgaagcaagatgagtgacttatttaagcaatttgtaagatgagtgactaaactgcacctacctcgcaagttgtgataccactggtgcattttactccagtttaattaatggatagagctagcaaaccataacatatggggctagaggagcaaccaaacgtagcgtgcttattcaaatacatgaaaattgaaacaagtgaacaagtttgaaaatggtaattatgcaactgagtaaaaatggtagagatgaaacacaaatgctgtgccaactccaggaccaagccaaggtagccattgatgcaaaagccatcgtcctgttccattgagcaaggaagaccaatcagtggtgttcatggaaaaggtaaatgaaacaaggagcaagctggggagcaaattatattatctggcaacaaattatcacttagaaggaaggagcaagttaattacctgcggctcattgacgcttctgtttttcgctgctccacctctagtgctactgaatgtatgtcgcagtcgtgagtgagggacggttgggatgtgtgttcgcaatgttcaagattttttctttcagttttgagaccgcatctagattgccagaaatccaggcatggactctgcagagggtgttggggaggtgctggaaggaatcattctcaccaaccacattcaatctaatgccaatgtggaggtccttcagattaggcatggaatcatgcataaacaacacgttgcaaagaaaggcaaacttgagacatcggaaaccatggttgctgatggtgagccatgatccttgtgtgtctgaaaagggaagggcaagatattcgagagctttcaggtctccaagcatttcgagatcgtcctgagtaacatatgctttactgagctctaatttctcaagcttggcagcaaggcgaatccaacttggaatggttgtcgtcttgaacccgtttacaatgctcaatctccggaggttttttagggaagggaaccacgaatcaaacaagaagcgttttgcagctatatccgaataagaataataaagagacagatctagatattgaaggctatgtctgtccagtgcattaagtgaggagatgaaaatcttctcgtagctcttttcatgctcggcatgggcctcatcagaatctctaacatggtcaggaatccaagataccgctagtactctcagcttggtaagctcacctagctccttcaaaaagcttaccggttgattgaagggcaagagacctgttagctgctccaatgcttgcatcttgctaacaccttctgcagggaacatgacgtcagaattgacagacagacgaaccaattgctgaagtagaacaatggatggtggtaattctttaacttgagtatctagtatatctaatgtctccaaatgctggagacgcccaatattggcggggagcacacttactcctgttccgctaatgctcagatacctcaaataggctaacttttctatattagcaagatggttgtttgtcaatgattcgcacccttctagatccagtactcttgcaactttaaattccgatagaggatgcaatcctgtgcagtccatagaacaagcaagtgaccggacatgaggcttaatcgacttcatgctcgaggcaaatttctcttggcagtagctaccctggagagacatgcgacgaaccttgcagcagttgctatgctgcaaaggtacaggaccagacggatccaacaaggtcataaagttctcctctactgatttggacactatgaaattaagaatgacgtcgtgaacacggcagctcagcacctcaccgtagtgctcattccatggttggatcaagctctggtttatcagcacattgaaatacctcagccctgcttcatatagattttctcctggtcttgcattgataaatccttctgcaatccatctgcttaccaaacgggtctttccaatttcacaatcttctgggaatgcactcaagtataacaggcaacttcttaaatcatgtggaaggttgtaataactgagtgctaacactgattgcatggtctcaagatccttatttcctggtattggagaactgataattttttttacctcattccagtgatataacgattgacgatcagccaagaagctggatatggaaatgattgctaggggtataccatcacatctttccagtatctctttagaagcttgttcaaattcaggaggacattgctcttcacagtcaaaaattcttttgtaaaacaaccttttggagtgagcgccatcgagatgtttcatcggataaacaaaaccaccatgagaagatgaagatgacatcgccacttctttcacacgtgtcgtcaaaattattatgctaccaggactagttttgaccaatgcttctccaatgaagttccatggttctgggttccatatatcatccactacgacaatatacctgccacatgtaattttaattttatcatggaaaagaaaattaaagtataattgatgtatagattttcaaaggaccgaaattataaatgatacccttgcaaagaaccagaattagattttcaaagcatgctcacatgtttggttgggtgttgatttacaaaattcttgaaattggttttaccctttgtattacgaggtaactatagcttacataacattaaacaatagtttactctggttcgcaacaagtatacatcagggttctgtgtcccagaaaagaaaaacagtgcttagaattacaacatcagcatttgagctatctttgcctcacagcaaaatacttaggaaagcttggcccactcagtgcttagaacaaaatacatcaaactggggcacttgtttttatctcatgttgaaaacaaaccaaataattgtttgttttgagcctactattttctgtaactgaactaataaaatgcaaaaggatttattttttctttgtttttgtccaactatttttgtaactgaactagtaggtcttcttggcagtgtttattgtctattaatcgtagcacataataaaattaatgcctccttcagtctttagctaagttccaagttttgtatagttgaaggatgtttaggaaagtgttgatgaaaacttaagaatatataattttgagttcatgcatagggcttgaagcaaagttaaagataaaaaaatagactataatctatattttctataaagttacaacctactaaacatctaaagcttaacatgcaagcacagtacgcatagtagttattagtacactctaaaggttaaaacgcaagcatgcaacattaacctactaagaacctactccctccgtttcaggttataagactttctaacattgtccatattcatatagatgttaatgaatctaatcacacatatatgtctagattcattaatatatatataaatgtgggcaatgctagaaagtcttataatatgaaaaggaggaagtaatataaaacccatcatgtatgcatagcaattactcctacaattcattatattgtaaacctcaacatacaagcatactaacttatatttctcacattattttcacaatatttaaccaaaaaaaatctatccttaaaaaagataagttctacaacattcaacataaatccatccttatattctgcagcaaagcgagaaaggtcagcggaaaacaaaacggaacatgagagtgcaccttttttgcttgagatattccctaagattatccaccagatttgctacatcatccgacatgtttgttgacttgttgccaacttgattagaaatgttgaggataagctcctttatgttcggtttctgagacaccgaaacaaaggccttgcactcgaattcccctttgattttgtcgtacacttgtttggccagagtggtcttgcccaagcccgcacacccgacgatggataccatcctgacaccgtgctgcaccgatgacaacgactcctgctactgctccatcaaccgactgatgatgtcatccctagggccatcgatgccgacgaggtgcttcgtttccgtccagagcgcgcacagccggacatcaaccttggtcgaggaggaagcatccgagctagttggtacaagtccatgaagagtgtacctgttacgccgctcgctgacctccacgacacgggccttgagcttctggatctgactcgcgatctgacggaacgctccgatcttcttggccatgcgcgccaccttggcagcgagtccgctttcgccggcgctgccgcggaggcggtggacggagaggtcgatgcagtcctcgatgtcgtaggcgagatcccgcaccctgtccctccagtctctgctgagctcgtcgagctgatccacatctgctagcttttgcagaactatattcatggtgctcagctcggaccggaggaagacgaggtcgtcgcggactcccttggcgtgcttgtactcctcgccgaggaaggccgtgagctttgcgaggacggagttcatcactccggtcgccgcgctcaccaggacgccctccatgccgactcatgcgtcagatcgaagccaatggccttgctctctcgctctcactctcactctcactctcgttgtttatatgaaactctggttgatttgacgttcatgatcgagccaggaggatataatttccctcgatatgtgtttatgtgccagggtacacgttcatgagccaataggatatattttccttcgagacgtgttccgtggaagggtaaagttattattaacttattggtgataccctatatatgtccacccatttgtcctctataaattttcacgcccgcccatgttaggtttgtcggtcacatctgcgaggaagccactcctagaggtccaggagcaaatttaatactccaaaaaaaaaaaagttatcctggtacggtacagaactctattacgtgtacatatcgagatttatatacatatccggattcgtagtattataatatatcacgttctgtattagattaattaacttttttctgatatggaggtagtaaaatatacataacgaccactaatccaaagatgaagaaaaaattattatcacatcttcatttgaaccaccctaataaatacaatgcatgtacctaatgggattagatatcttgatagtgaaggattttagaaaaatatatatgaatttagaggaaggggatatactagttaattgcacgtcttgtatcatgagatatgaaaaaagtggttacgtcttatattttaggatgaaggggtattgaattattgaagagagatcaagaaaaataagaagtgcaaagctagctttacacatactccaatataattgcactaattatatatacttggtattttctggaatatttcttccaaatggtgttcttggcaatgcttcaattcaaatagaaaggtttcttggaaatatttttcatagccttctagcacatctagaaacaacaaaatgggaagatctttcacaatatttatccttattttgataactggcggtctactttccggaacgaggttctcttgcatatgtgtagaatgaatgatcccctaagatagttgttgattgattacaactcttgcagtgctatttttgtcctcctcctttttatttatatttgttcataacttttagtatatataaaccagacaaaaacgcttggtaaaaaaaacttatagctaatctactatatatgttagctctaatatttatcttataggattagttagaatttcctccatccaaaagtctaaggcatattttctgtcaccaaaaccaaggagaaattaacttattccacatataataaaaaatgagctatatacatgcatgtaaccaataagtattaagctggttgttcgggttcccatcaataatttaatttagcatcgtaaaacaaaatattcatttaaatattacatgcatgttgcaaaactgactatcttatttatagaaactagaaaacaaaatatatttaaacttttggatggagggaatcactactagaaaaacagattttaccaacacaaacttttattttcctaggccggaaaaaaaataccctcttgtaacctcttgcaaaaataactagagaatccctagctctagccctgcctacgaaaatcaatttttactaatggagtcttaaagaagcccacctacgaaaatatctttattttcacatgtagacctcttaaggttccgtttgaaaaaaaaaaatctgattctcgtagacgagaccttaagtgatccgcctgcaaaattaaaaatcttaagatgccaatcccatgctatgttaaaaatgcttcagccaccttgcaaactgcacaagtccaggtactccacaaatccatgtacacacaaatttaattgatatttccaacaaaccactcaacacactcacacattctaaataatttggcctactaaataaaactaagtataaacaaattagggcacaaacccccccccccccctcttttgtataagcaatataactatttttactgaaaacattataaaattaacctctcatgaccatattccgagcattattacagtcctaagccaacccacaatcgtcttctcagaaaaactctaaatatggtattggttcttagtcaattcataatcattctttcaaaatgatactcagacacggtttctgtcctgatggtacagtgtgatgcgtgggagctccttgtatatggaaaaaggagtgaagtttcgaggaagcctaaatttaaaaagattagagaagaaattggaatatacatcctttgtcccatctagcaatgaatctggacgtgagcccacgtccaaaacttcaaattgatcgctagaagttcgtttttttttatggaggaagtatacgtgagtaaatccgagtaggaatatgagtattaatttaaatttgaatggagtccaagtttaaaaaaatgtaaaagaattaaaatgtgagaaaatcctaatcctagcagaaataggagtcctaatccaaatttggagggaagattaaaaaggaattggaatctacactcaatatctatacatggtgttcttttatcctgaagataaagattaaatttttttcacaaaacgaggtggtattaacgtatgattgattgagttttaattattacaaacttgaaaatatattaatatgatattttagagcaactttcatatagaaagttttcgtacgaaacgcaacgtttagcagtttgaaatgtgtgccacgaaaatcttaggcctggtttagttcctaactttttcatcaaactttcaacttttccatcacatcaaaactttcctacacacagaaacttccaacttttccttcacatcgtttcaatttcaaccaaacttccaattttagggtgaactaaagacaccattaatcttcatccaactcttgttggagaaaagaacaggacctaaatgttggtagtggtgctagtggttctgtcaccacccctaccactgacaggtggggcttacaatgtactccctccgtcccaaaaaatgacaaaccatggatttccgtgttcaacgtttgaccgttcgtcttatttgaaaaaattatgaaaaaaaaaaattaaaaagacaagtcacgcataaagtattaatcatgttttatcatctaacaacaatgaaaatagtaattataaaaaaaatcatataagacggacagtcaaccgttagacacggaaacctagggtttgttttttttttttatggagggagtatcagttctcctacctatcctagccctgaatccttgatcccatgcctgccgcttctccatctgcgacaaaccgacaacgacccagggcaccggccgccagcagcgcgcccccgaactgccaccccgtacagcacgcagccaacctcgtcggctgacgcggtgacgcctccaggctccagcagcgttgacaagccaatccgttgatggagcatgcgtgagctcatgcgtgctggtggagattgggccggggcttctagcattgctgcagctgcagctgctgcctacggtgacagctgaagcggcgtggacgcagatccgtgggctccatgtgaagaaagaagaggaggatccaggagctggtctcatcgattttggacgacaaatggaatagatattatattttgaacaaagtttaaactcataaaattgctatagttttggacgacaaggagaatagatccgtagatactaatgatacgatctctcaacatataagcatctctaaaatttggttagtacagctattaattaagtgaaaataattaaaggaagattctgattgtttgtaagaaaaggtagataaaattaattagagaataattatgattgataaaaatagaaagggtttgtgaagaaatagctttactttgtataattttatgacggaggaagttattcatggccatcatctggttgattgatctcattatatattaggcttgaaatgtcggcagagcacgaatcacgtaaaggtggtagcatactcactccgtctaataaaaaactaacctaactccgtctaataaaaaaccaacctaatacaagatgacatattttaatactataaatctggacatacattctagtattagaatgtgtcgcatccaatcctatatttgatttttatgggacagagaaagtatttagtggcgtgcattttaaaaatggacaaatcctgctcttcatccgacatgaataagtaatttagtattgagaggaaatggcagaatccagcacagaaatgatcaaataagacaaagagtataataagatagccgcaatacacaacataataaggctttgtacatatgcagcgcgggttgtataactaacttgtaagttgagcagcacaggaactgctacaaaacggtgttccagcattgcaagtcagtttagcgcgttagcaccctcactaggctctcgcaacctcctaaagctaaacagattaacgacaatctaacatagctagggagagagatcatctatcttagcagattcagagttcagagccaccaacaaaatcttcttgatgagcaatgcatagttatctgacttaccattacctgcgcgcatccggaccagctggccgagcctgacttgtcacatgacttgtctgctgaccagcaatgttcacactggggttgtagcgtccaatcgctacgctgtaagcttcaccagtcaggctccctctcatctgccctgtgggacgccagctttcatccacaggaagctcctgaagatcatcggaagttccgatagggggaggtgtgctcggaggccgagcagtagctggcaagaagggagactgtgcacgaggtggtgcctgagaaattgtaggtcggggcactgcttgtggtctcattgcttggctgcgttgtggccaaggaaaaaaataccccggatctgcgggttgactgcacttgtgccgcctggttgagatggcaagacctgtggagctgtggaaggttgagccactgtagcttgtccaagttgattcattagattgctcactagccgatgaacgtgatgggactgttgtgcggggggagctccatgggcattagcacctatagcctgtcctgggactcctggcggcggtcttgtacccatgaaattttgaggagcagtaagcccaatgaactggccttgatgatagttttgcgtggctcgaatctcctgtcaacaaatatgtgattctgtgaacaactgcttgttgatataaatttaatgcaagtaaaagaattcaaacgtgtatcatgaattgcttctctctacaatttatcaacgatttgtattgtaaaatgaactacagatggctggcaccctgcaacagtactaaaccactaaaccaatattttaggtcatgcaccaacttcgctggctgacagttatcacagcaggtaccatcacatactcactacttgtatttgcagtacgcaagcaagcagtacgaaatgagtaatgaagatagtgaagtagttcaagtgcctgttaaatatttgcccctattcaaatggagacaaggataaaaaaggtaatagagccaagtaaaagagaagataagatgaccatgttgtcaatactcaaacatctcaaaaatatgagcgaacattaaacgggctattacataaaacaaaccttttactcttttaaaaggagctgggttttggggaagggtgttgataatgcaatctacttctacaacacctcattctagaactctagaagatctttagtggctagatgtggatagccatgtgtatggtactgtccaccgtggtgtttgcaacatctttttcaacaattgcatcactagaacatgtgtatgtatggatggctaactgacctcatgcaatcgtgtatacaatttttagagttgaagataattatgtttttttttcttattttactttacatcatatagtgcatatatttggaaagtaagttggcaaaactatagaacataatttttgaaaggggtgaaatagagtagctcagggaccaagtataacatatttcagcctccaaatcactttataatactagtatggttgtgaagctaagatggcttatcattagtattacagaaagtaaattcatcagatagttctactgtgattacagggctgtttaaatttatagcgacatgtaacatgactctgttcaaagataaaccaatgctaccttatgttggcaaaaataccaagatatagtggcttgaaaagatttttacctgctgtgttgactggtgttgcaataacggagcagcatctggagcccttgatagtgatccaataccagtgctcatagcagtaatgacactatctgcgtttgtcacctgatgtacttgatatgctgaagctggactggattgtgggaaaggaggtggacaattgtagatatttggtcgcactctctgtggttgcactggcagagcctgaattcctgtaggttctctcgcgacattccttggtataggaggtcttgcaatttctaatctaagctgtggatctattcgtggttgcgacggcacaatatcagaacgtgttccttgtgctacatgctgtctcagaactacagaattagaggtatcaagagaaggagagactgcatctgtgataacagggtgcagaatgttatgaggcagaatagactccaaagtcccgaatgaactagagcccagaccgccagtagaaggcagtgatgaattttggccagaagttgaagtggcatttccacgttcattgtttccacggcttgcaccgcctgcatatagatcttctgcctgcgaaactgtgttcataggcaaatccgaaagatagtctgccacagatagatcctgacaattcaagaaaggcttcacatcttctgatgcagaggtaaaactcattggcacatcaccatcattgtcttcatttatcagatctatgacatcatcagcagtcgcatcagtgtccatagtatctctactctgctgaatgacgtcactggaatgtctatcagatctctcatcattagttgaaatggctttccaagatccatcagcaaacacaaggacatcaatagtatcttctccagtctcttgtaatatcttatggaaaaataaagactgatcacatacaaaacataatgaaatgatgtatatgcgcagatacattatacaacttaccttgaccatcttttgatcaatccgtaggtcagtgaagtttgaaggtgtattacaaaatggacagcgccaagtcggcttcctcaagttcaactccatgtaattatcataatcaaaacactaaacaatgcatgctctgtcattacttttgttgaaagaaaaaggctcaagccatgaatacaaacaaaatgataaaaccatacctgatagtgtttgcataggcgccctttgatgggagtttttatgcgcctaaaactgcaacaagagatggcaaatgaatattttccaggccagaatcagaaagcagctgactaacatttttcattcaaataaatgatagaagtacaattttaagttactgaatttcacttaacccccatcaatctagactgactctagacagccaaattcactaagtgtgcattaattaattaattcattgttgtacctttacatcaccatctagacacagagaacatgattttgccaaactaggtattaaaaaagaatagttcttaatttcttatgaggttctttgtccatatccatggaagaacacaggtcaggccttgtgcccttgtggcgaacttgtgtatgcagcaaatttcaccaacatgggaaagttgaaacacagtgcgcagcaaattgtattccatgaagagtgcaatacattaccttatggggcacttcagggaaactctagatggcccttcgagtaaatcagaatctaccaaaaaaaacaaaaaacagatctatgaaaatttcaattcaaaaaatagaatagctgacatacactaaatgattaaaaataaatttcacccaccaggaggatcagcagcgactggttgtgcataatcatttaggtttggagcgtcaaaggactccaatttattcagaaatgcaacagctatgatatagttagctgaaacaaaaggctgttggtttataatattcaacaattgaaatagaagtaaacagacacaacaccatgatcatgcataccattaaaatatcctatagcttggatgatgtttgccccgtatttgagcatcctagtaatatcagtggggaactggggtcctgtttcctgcaacataatttgaaagcatgaatttaggttgtaacgtaattgaagtttaacaagttgcagaagactatgtggtcaactcaacactgaccattgaaacatttgtcctcttgtccacgccttttccattgactaaaaagctgaaaataaaacgtaatattgttttttggcttaacattcgcaagcatcaaagtaaaaaaaagaaaggaaagaaatgtacctcacatgtggcgggtttgcaatacatgatgaggcatttaagtcttccttttgcacaacaattagattctacaaaacataagaatattagtaaagttgactttatataacatcataatgcatacaaaatacagaagtaccagaatgaatagtcataaactcctgccattttgacactacagtcctttcacatctaatcactccctcagtaataaacacaaatgcatgtagatatgagatgctacaagatgaccatgccaccatatatgcaaccagtgggttttggtgacaacttaaactatttcgaaagaaatttaaaatatcctttggcttctatacttcaaaaggggttttttacagctaacttaatttatttcaattcaaaagattttgaggtactaggacagataatagtcataagcaggaactactttacaagaaacgagtatgacctatagaagtagtcagtcaaataaacagtggttccatgcctatgtcacttgcagatgcaaaaaagaacatgacagtaaatattatgtaaaatattgtacaaacacacatggggttgtactttataatgatgattcatgatatattttaaaaaaaaactcacatggaaagactagcacagcatgcataaaataaatattttcactcagtgatactcacaatcttttcctctcgaggcacattcttatggatgaaaaaatcggccattaaaacatcatatccaacctgtagagtatggacaaatacatcaaaattagtatccattcctaaaacaaacctttattatctgaggatcatcagttatatgtttgcacattaagcatctgtttggttggatggatttggaaggttgggatggggccaacccattttcggaagtgtttggttgaaggggtagatgggttgggatgaacctaaaatagaatattccactaatatccaggtttgtttgatccaccaaaatcagccggactgggccaacccacctcgcgccagcgctgtcacgtgaggcgcatgcacgcggtaacctcatccctcctaccgattcacctcttatctctttccctttttccccctccatccatattggcgaggcaataggcgctagaggcggcgtcaaccacgtgcccgagccggcggcatatgcaacctcctccctcctccatgctctctctctctctctctccagccgctcgtcctcgtcaaagcaggtgactgcgataggaatccctacatgtatttattcacatttgtgtcaaatcaatctgtctctggttgcttgttgctagtcctcatcatcagctgttggtcgtccttgcatcctcctctcttgtcaaacttgtgagattttatttgcatgagatgaatgtcccttgctatcaataagattagttttaagcatattgtagtatttttgtttcatctatttcttcagtagacaattttttatgtgagcaagaattagtttgtgatgtgggcaagtaatttgtgatgagatcattaatttgtgcttgagcatgatatggcaacatatttctgtttttgttaaatttttgtggctgctacgaatgtatttttagtgtgagagtttattatttttttgtggaagctaaaatgtatcgttcacgtgagaggtaacctcaccaattctagttgaggaagtatctctatccagctatcccacctcatccctccatccaaacaggtgatgggaccattccatcccactttatccctcaaaccaaacaaaaaatagggttcgttccatccctctaaccaaacaaaaaatagaaccatcctacaccagaaaatagggatggacctaacccatggtgaggatctaagaattcgaaaaaactggtgcatagaaaagaatcatcaacatttatcagatcaatttctgaaactttgtcttcaacaccagattgactacctttgcttccagcgaagtgactagacgttcaaacttcaattgaggatagtacctataggatttttgaggaacagaaataaaagcaggatcaccttagttcaactgaaaattaaaatattgtacataaacagactaaaatactttagattacttctcaatactaacataattacctaattaactgagatcgcagaatataactttcaatttaatatcttcgaaattttgaaatatactagttctattttaaaaggaatatagacttcgcattcaaatattgaagtccaagtttctttcaatgtacttcttaagtactacctccgtttttaaatatatgatgctgttgacttttggacatcatgtttgaccattcttcttattaaaaaaaaactaactaggcttgttttatcatcgaaggtactttaagcatgtcatatatttgcatgtttgtacaaaagtttttaatacgacgaatggtcaaacgtcacatcaaaaagtcagccccataatacatttaaagaaacagttattgaagatttgacacgtcaccttgaacaagaaaatttcacatgtcattttgaatttaaaaatcttgattattggatataaaatccatataagaaatttgtaacatatttttcaaagagtaaattgcactttgggccgcatattcttaccaaagtttcactttgaaccacccttacaattcttattttcactttggactagttactgttgccaaatgttcactttggaccgggtggctcacatgtaagtgacaaatggacaatagagaggtggttagtctcattgacatgttggccacccggtccaaatacaacatttggtaacactacctattccaaagtgaaaaaaatcactataagggtagtccaaagtgaaactttggtaagaatatgtggcccaaagtgcatttactctttttaaaattcttatccatgcacaagtgtgtgaaagaaagatatagtcactaccttggcattattgttgaaataatttggatcacagtgctgtcattatctggctggctgacaggcgtgcagaatttgccagagagctgcatgaaaagcaaaaattatgactaagcaagctaatatctgaaggacatgccattaccataacaaacataaactcaaaataacgaaagtgatcataacaaagaatcaacataattaatagtaacgggataaaacatttcacacacctcattagccatcctgagaatttcagtacaatctgtgggttgaaaccatttttcagaacaagcattctacaaaacagcaagcacaggttactattttattttttgggtggcagatatattacattgggagatatcaggtcaaaaagacaaattgtacaacttgggcatatgatcacatataaaactttttgttgaaacatctcgcaataaaacatgagtatgcatttggaaactaaacaaatacattgatgggtaggactaacagctaagatggttattgttgtatagacattaaaggtagtaagcagagccagcagcggagcgctcggtagggcgaggcatggcgcacaccatacctcgtgccggccgcgaccacgagtaccagcccctctcaccgcgctcccgctgggccacagcggccaaatcataaaccattgctggtccacttgtgtcgtgtatttgtctaatgtttctcatcgagcaagttgtgacggcggctgacgcgatggcttcgacggcgccgtacattccggtgagcctgcatcctggagactgggacggaagtcggcagcggctagcagtacgagccacgctcacgtgtggagctaggcagcagtagcttagttgggagctttttcgatgaaagaaagaaacgaaacaaggaatagaggaacaagaccccaattttctagcatccatctatcactgttaaataaaacattggtagtttgccaaatttcatgtatttgatggattagtagatattgaagttggatgcagaatcatatactatatcatagaaattagaatagctgcatgtcacgatctaggatttgtggagaagaatcgggatgaatgggggtagattggattatagtagatgaagtaacaaggaatggtcctgaacctaaacggcgcgacgttctccgtcgcactgagaaggcaggccgatgggcactgagataaatcttgatctaatgcttcactgatctaggataggatccctccttatatagatggaggactccttaatctaatcctaacaaaccttatctaatcctaacaaaccctaatcctatccaatgggcctaggatgcccggcccaaagaccatgacactgcagaatctgcagtctagcggcatggtgtcggttgttacagtaggtaacctatggtaaaaaattcttattaaaagtttacttttaaagtctccatccacaatatttgcatcaagcgttttcgtttagcgtgcagctttttcgatatcatattattactaagtctccatccacaatatttgcatcaagcgttttcgtttagcgtgcagctttttcgatatcatattattactttgtagttttttcgctatatgtttcatgttcataatatgaactttgatctattataagtgcaatctcgaatgataaggattttagccctcacggccttgccatgcctcattttttgtccgtcccccgccactgagcagagcaaacattggattgaaagtttgaaacaaataaactgttggtatgtatgcagacaccaaaaaagatcaaaagactggattattttggctaaaagaagctcttaccatagctcgtctatgactgagaagaagcatttaccttgcatgatatcattagcaccataacagaagattgcagaaattgatcttttcctaccagatacacctggtaaataaacattaaacttccgatcaataacacacaattaaattggaatacctggcttcactaaaaaaaatggagccctctttgtgcaaaaggccaaaaataaacagttcaaactcaaaggtggtagttgcactaataatttgttcattgcctcacataacaaagttggaaagtacagaaacagttaagtcctaccggctactttaaaggtcgttagcatttaaggagacaggcagccaatgctagtttacgacagcaagtaaaaggggaatgtgatgctaggcagatggcactatcaaataaaatagtgctgccttggagggaaaaagctggcatcacagatttcacaggtaccagatagtgtaccaagggaaatcatggagtaggaaattgagatatgggaaatcaggaggtgccatgtaacacaaggatttctacaattgtgtgtttttgcgagcagtgacaaatgaggctttaactattaatatgtcgtattgattcttttggaggctatccattcaaatagtaggataccttcatcttttaaagttcagaagaatcacataaacaagaaaaacacaacagtttcttaggaacgtagaaaataaaaacataagggtttgctcgttatctttaaaaaaaaagtagttttctcagctgtagtactgcttaaaggggggaaattattacctcacttgccaagttagactctctccatattatcatacgtgtcaatatttaactatgagctataaaattttcctcacactgcagatgctgtgacaattttaaagaaatagtttggtggttccagaatgattttgccaacctaccatgcgtcaataaattccaatgtgctattctgatcgatatgtcattttactatgcggttcaccattgggccatgggcacaataacaattagcatgcaatgaaacgtagaagttattacatttaaaaacatccatttatatagtatgtgaactctagctacttcataattgcttcgataatgaattcaaatcattaaatcgttactaagaatagcaattctgcgcaaataatgaagctctcggcggtcaattatcgcatccattgctcccctacttggacaataaacgtccatattaagatgaacgaactaaaaaaaacaatgggaaattgtctggtagaggagacacgcttaccttcttcaaaatgctgggtatttcactggccacggtaggaacatcgccgctagaaagagcgaaatcgatccctctgcaagcgcaaacaacgcgaataggtcacaca

SEQ ID NO: 46323 - DNA, 1425 bp, Oryza sativa
tatatatagtcagatttatctttttatcagcgagttcgtttctaagcgatcttatgagcaatttagttgtaaaatagtcgttgaaatcaaagagttggggtaatcgatatgtaaaatgcgtattttccatgttagaattgatgtttaagataattagtagtgtggtacttttgttttactttaagagagtaactgagtatgtctacgtaaagacatgttagaatagatgaaaccaagtttgttatttaactcaacaatgtagtaagttgtagccaattggttgttatagttttattcattttgcataaatgcatgtagatatcgattctttagttattcactaaaattatggttctcgtgtgcaacattgacaccaagaattaaaaattgctcttttatcactcgagctgtattttagacgtgctcaagggtcatactggcttttcctacactaagctattagtccttttgtttatatcatgatcttccatatgactttataacttaattaaatatttttatgaactataattcaaaaacatagcttgttgtacaccacaactaagaaacgtcatgtacgaaaacaatcttatttgtcacataaaacttgctaccaataactgcgatgacaccaatcggtgagtcatattcaagcacaccaggctcttaccctaaaaataagtcatgtggggttttaaaaaccgcttgatagtttggcaccattgtaatattaacggctagtgaatagtgcaacaactagtacatttgcgacttgtgatattttgttgccttctctacatgtaaaaatctatgcgacattatacattttatatattgccattgtgtatccatgtaaatctggagtagcagttgacatctctcggtttgtttgacaaataggtttagaaaaaaagatatttccaaccatacaagggtaaggttcaatcctaaccattcattcatttcacctcgtttaatcctaaccatctactcatttctattttccaatcccacctttcataacttatttgccaagcaaagcctaaccattcattcatctcacatcatttaatcctaaccattcactcatttccgttttccaattccacctctcgattcccatttgccaagcaaagcctaacttttcgttcatttcacctcatttaatcataaccatccactcatttatattttccaatctcacattttataacccattttccagaaaaaaaaagcctatatggttagacatcgatcctcgatactttgtaataatagaaggttagaggcgatatgatattcaaccatgctcaacccctgggaccctggtcatggagagagagagagagttgcctattgccatggcatacagatggatacctgcagcaaaaagatccaaaactctaggcgattactccctccgcc

SEQ ID NO: 46324 - DNA, 13343 bp, Oryza sativa
taatttttatcttccttggtgagttccaggttttgacatatttccggttcctgcttttcctttcttatcagaaggcttaaggatctggaatgagcatgtaagagaatcatcaatgctcatcatcgcccccgcattgtcaaactcgccacaatagttgggtgcagagaatatggttacaagctggcgcttagcaaagaattcatagccatcctccacaacctgtcagagaagatcccagcacaaagcagtgagtggtaaataaagacaatcgctcaataataacaataatagttcactacagcagagattcactgagaaaagatgcatgtatttatttcagcttatatccaaaaacaaattggaataaaccaacatatttaattttccttacactagaaaagggaggaatcagtatttgtaacaagtaattgcatggagtagattgaattatagaagaaatttgactgaaattgatttagaatattttaaccaaatctgtaatgctgaatttcattggcctcaacaaaacgaatggagcagacaatagacaaggatgagaacaaaatgatcatctaatgcatccaatatcaatgggaagttcaccccaagcaagggcatgtatgtagttagaggtttgaacatgatttgcagcacaatacaaaatatctcatgcaatgttgacgccgataagagaattactgtgtggtgattgcctaagtgtagtatacaaactacacacagatgtacaatagaaattctccatttctttttcaataaactacagaaccataagttaggggatttttaataaaatggagaacatgcttttgttgtataactcaagagatggatgaaaatcatttaatcagatattgaacagttcttgatacagcagataaatactttagaaacatcaactcatgtcacaattaaatatgcactttcaagtccaatgaaatgataacgaactcacaggggaaagaccactgttacttgcttgaaaatcgtacaaaaaaattaccatcaaaacatacctggtgagccctgcagatcagatctagatcatgtgtctggagaaactcagcgaccttatcagctccaaaagtgtatgatacacccctgtcattctcaccccaaccttcgatttctttatctgggtctgaccacaacagatcacacaggagaccatggtctggaacatcaactgggcgggcaatgttgcgaatctggtccatgttctttaggtcaggagataaacccccatgcatgcataggatcttgtcatcaataagtgcagccacagggaggcagttgaaacaatcagtaaaaaccttccaaatacgaacattaaacctccttttgcattcatcaaagaatccgtagattcggttgatagatgcgcactcatggtttcccctaaggaggaagaagttctctgggtacttaatcttatacgcaaggagaagacatatagtttctatactctgtttcccacggtcaacataatcacctagaaacaagtagtttgcctctggtgggaagcccccatactcaaataaccgaagaagatcagaatactggccatggatatctcctgtcaatgagtaagtaggcagaatgatggtaagcatgatgcaatcacattctacaacatgttacaaattgtttatagttagaacaagaagttttagcgtatttgtgataggtgcttagtatcttggtatgaaatttcttcatgccacacttgaacaatgatgtgctgtagacaaagataattctatgaaggtgcatcaggatattttttttgttcggggaaattttatttgcctctatagcatgtactgcaattttaaaacatattcttgtctcccaagcgctaacaaaagataatgtggctaaagaattgtgaagacatataaacacagtttcttcattataacaataaaactagcctgaagtttgacactctgaatcaaccttcagaaattctgcggtattctcattgaaactagaaatttcatcggcaagtcaaagcaaggaagatatagattaatcatattctgttgacaatctgccctgaccccacccaaaagaggacaattctgcaatccaagccatatcaatcatcatcaagattcaagttcaacaactacgaaagcaatataaatcttccccaaaagaatcaacatcctaaaatcaccggtgctgtttatgacaacaaaaattcgaagaacacccaagtctaagcgcttcgaaccataaatacacctcgaattagcatcagaaaacacaccaaatattttcccagacacgcagcgttatcactcaggcgaccgcacataccgcaagaacaacacaacccgaggagaccgacccttctcgctagggttttgcggcggggaggggagggggtagaagcagcaggcctcacataccgcagattttgatgggggcctcgagctcgaggaggttgggctgggagaggaagacgtccttggcggcggcgcagagcttgcggatctccgcgtcggcgagctgcgcggggcgcgccgtgcggccgccgcgggcgtccaggagccgccggatcaagtcgtcgagcgccgccgcatccatcgccggtggagagagagagagagacccaaaaaccctagcagcgagtcgccgcgagcgatggcgagcgagagaggcagctaaaccctagctttttgttttccttcgatcggcggagacgaggaggaggaggagggagagcgaacggaaaaaatcgggtgtgaattgcgacgcgtacccgatggtttgtaccagggaaggggtgggggtgggcccgtggtcgagaaagggaaaggctggtcaaggtgcattgcatatgggtcaaggaaacttgtttgaagggtcccttctggtttgaataatggggcctgagaatcaaccttttcgattttatgtgctttgttttgattctaagggcacgtttagttcgcgaaatgaaaatttttggatatcacatcggacgtttgaccggatgtcggaaggggttttcgaacacgaatgaaaaaactaatttcataactcgctcggaaaccacgagacgaattttttgagcctaattaatccgtcattagcacatgtgggttactgtagcacttatggctaatcatgtactaattaggctcaaacgattcgtctcgtgatttcccccctaactgtgcaattagtttttcattttatctatatttaatgcttcatgcatgtgtccaaagattcgatgtgatgttttttggaaaaacttttggggaactaaacggggcctaatgaggttgtgtttagttcatactgaagtttggaagtttggttgaaattggtacgatgtgatagaagttgtgtgtgtatgaaagatttgatgtgatagaaagttggaagtttggagaaaaaaactttggaactaaacagggcctgagtatagtcgcttttataaatctactataaacctaacagtctactagtgtagtgtaattggctctagctaaatttgtttatcttaactcatctaacttactcacgggtagagaccggagatgtaatctatttccattatcaaaaaaactaatgtaacttgcttattcaccttatttagcacttcagtgaacttccatcatattttgtgttatcaaatgaaccaaaaataaaaagggcgagcccttgttcggcacggcagcgagttggcgtctgcgagcaagtggagtagcaggtatggagtcgcaacacgatgtgtaggcgcataagagaagggtaataatagagcccacttcctactattagcttatcttaaagccaatatatataataaattagctataaaattggctacaattttctttttatctctatatctctcagttatacatttaatgcatttgtcttggaccttgtgataagctagctcttgcatgaaagccagtatccttaatttttcactatctctcttctacactaaatttatagtaggtttaaagctcactattatacttgctctaagcagtgaaggggatcagaggctcggagcgcgtgcaagtgggagcgacgtcgcgctactagtgacgctcattttctttttaccggtggttagcatccctattagtttccttgattttaatcgctaaaactgaaaatcgctgcccattttacctgaacggaaggaggaacaagatatttgagttaattttagggctttttggtcttttagtgtacgatttttttttaacatgctaacgtgatgggagttctaagatttggaaatctctaacgggtaggaaaaggagcaagttatagtgctatttttgttttggtaccgggacaaaacctgtgctaccaatattttctccttaagaaaggctcttttttgcattttgacgaacactgaagaaacattgtaggatgtcattagccaaatcaaaattttaagtaggtctcacttgattgattctactctagatatgcctaatatgcaaattggtgattctaataattctcataaattaatgtcattcattttttattttaaattcaaccaaatgtatcactacattgagtgatcatgttgtttgatgaaattttgtcattctgaactaagcaagcgagattattatttagctaagaagctaacttgttgttttgcatgaaatgcatgggccatgcattactgtgcacatcatatctagccaaccatatatatgactcacatgcagtctgctatgtatatgtgtgtgcccaatatatactggtgcatgagccggcaaacaaagactcgagcggcatgtgagcagcttatacgcgagcgctcgtacgtggccttatacctggtatacgtatacatgtacatatatatcagataattttccctggactcaaagcaacggcaagcaaggactagtgcttgggccgcatatgggccggcggagttgcgctgcatgctcgttgtacgtacgcggctggataaccacgcgtatacgcgtacatgaggaggatttctcgccaacggcaagatactgatgcggagataacgtcagataactcagtcctatctggtcatctcgatgattcaaacaagagtaatccgcagcaactaaacccggaagagtcggatcgatctaacgctcggccgcggtggcgccgagggattcgcagtgtgggttagggctccctgcgcctgtaaaaggagaccatcactacacagggctcacacgcacacagccatttcactcctctcttcacacaaaaccatttcgctcttctctacacacacattcatcacacaccatcgagcaccacaacatcgccattgatccttccggcatccacgagctcgtccacttccattcaccacacgtccagccgtcggtgtgacttcgccggagcagcagccgcgctgcgcacttcgccggagcagtacacgcgacgtcagcatcggcgtccatcacgccggtgtccggcagggggacgcgtacctgtccaccgtcaaccatcgcgaggagaaggaccatggctgcacaaggtaaatgctactaatcaaattttatttgcagttcacgcatgcatgagatggcgacgagacgagaatgtcggagcaccgctggacggtgcccgcacgccgtcgttgagtctgccgagtcatgtaagtgctgttcgtcggactggagagcaagtcgccgttcgttgtcatgtccggacgaagggcctcgtcatgctacctcgccggaatactccgcctcgacatcgtgaacgccgcccacggagccatgacgccgccctcgccggagtcgccatgccgaacgcctcgccgaccgtcttcggcggtgttgtcatcttcctcacgccgtggcgccgccggagcacgggccatcctcgcttggctggtggcgacttccacctcacagcgtcttcatcagcgcgcgtcatcatcctcctcacacgcgctgtcgttgagtccggccacaccatcctccacctcgtcgagatttgctgggttaacccagagaaggccatctccgtgccgcctagccagagcatgttgagaatcatcagaaccgccggaaacgtcgtcaagctgccgtcattgccgtcgtcgtggtgccgaggcgtcttcaagccgtgctgttctggcccgccgatcgtcatcggtacaggaagaaggaggctgtcggggcggtcttgaacgtcgccgaactgccctaacctgagtcctatcagagccgtcgccaagccgccgctctcgtctacaccgccaggcgatggagatcgctgcccatgcgatcccgctggaggtcgccggcaagccatcgtcgttacgtcggtctccgctcatgccgtctctatggagcgccgctgttagccgggaggccatgtcatccactttgtcgacgacgccctgacgctcgtcaagccaccggtgacgccgtcgtgccatcatcgccgcaccaccgccaaactccgagcatgtctcgtcattgagactccactgaccggcgacgctttcacgctcgtcgcggtccctgaggcgctgccgatgttcacctgatcgcgcttgacggcgctgcctcctcctccacgtgttctccgttgctgtcgttgccggcgccatgtcattcacagtgccgcgggctgccgtaaagccaatggccaagcctgcagaaaagcacgtcatctacagtaactacggcaaaaatcatcacacactagtgtttcacgtgtgcatgcatgccactgtgtgcacagtgacaagcaaaccaaaatggcttattgctaagctatactcatttggccatgaggatgtgtatcgttatacactaatttctcaagtgcaagaacagttcggtggtctgcatagaccatctctgtccaagctatgcgattccatgcatgtcttcttcaagcaatctacaccaacacgtcgttcaagactgacgaggctagacgacgggggcgggcgaagccgacgcgaaggctacgtcaccaatatcggcgcacggaccgacgaggccgtggaccgctgccggcgcccacatctacatcaccatcacaaccatgcatggagaatgcgaaacgaagacgatgagatgaccactagcagcttaatcggaggttctcttgcaggcctagacctacagaggtaattaaccgggagctttttgaggccccgggaaccaggagaccacatcgcacaaatctgtccaacgacaggttattaagcgcgtatcattatatgggaatttgtatttataatccttgagattaataaagcgcatgttccctatgttttgtttattgtgtacttagttacactggcacacatgcacatatacatatctctaaacatagagatcataggcgttatttttcaccctaaacacattttccacataaataccgtcagatggataagaccataacattataatctttcccaatatcatattttcatactgtatagtatgtatatgaatattaactgcatgccttttttttccgtagtgacatcccaacacaagttgtttcgaaaaagtgaaacccgtgctttcttatgttttcttcctttaacaataaatcaaaacaagtgaatttaatttgtctatttccatagaataaagaacatatgcatataatgtatgggtaccattcccaatcaaagacatcaaatttagctcaatggttggtcacttcgaaaaaagtcatgtaaactttagctaaacattaaacctaaaaattccgtttgctgaaaaaaaacagaagaaaaacgaaaacaaataagggtgtgtatagtttttttgggtgtaaagtttttaagtatacggacacacatttaaattattaaacgtagattaataacaaaataaattacagattccgcatgtagactgctagacgattttattaagcctaattagtccgtcattagcaaatgtttttccgcatgtagactgctaggcgaatttattaagcctaattaatccgtcattagcaaatgtttactgtagcatcacattgtcaaaccatagcgtaattaggctcaaaagattcgtcttgcaatttacatggaaattgtgcaattggttttttttcatccacatttaataccccttacatgtgtccaaacatttgatgtgacctttttataaaaaatttttgcaatctaaacaagggccgtgtttagtttcccctattcccaactttccatcacaaccaaaactttcctacacacataaacttttaacttttttttccaaactcctaacttttttttaaacttttaatttttttcagaaactaaacacctaaaacctaacagtataacacggcatacatagatgtaaccttggaagaactcttcaatgccgtgagctcagcatcctcaaaatccacgcacaaccgaaagcaaaacataaatgcaaccccccgcgcggcggacgaagaagcgaggaagaagaaagaaaaccgcaaaaaagccacaaacacccaacgcgtcggcgtccactccctcgctcgcccgctggatgacacacggcgacgaatacacgaaaccactgcgagaccgcgcgcgcaccccggaagaagcaaaaaaagaaaaaaaaaaagctggcgaaacccgcaaaaaggcctcccaaaaccaaaaaaaacccgcacgagacgagacgagacgaagcaagcgacgcgcgtgcgtgtgcaagccacccacctccctctcgtcctcagctcgggcagagcgagcagcagcggaagcagcaaggcatgggcgcaacactaaaaagaagcggccgcacctccccaaaaccaccaccacctccacctcctcctcttcaccttcttctcttctcctctccacttctccccaccaccaccaccacctcgatcgcatcctccgttcttggctgcggcgcgcgtggaggaggaggaggatggacgagcagcggggacgcggggggttcgacgaactggtgctcttgcatcagcagcaggagcagcggaggcggagggagcagcagcaggaggaggaggaggaagaggaggtgcggcgccagatgttcggcgcggtggtcggtgggctagccgcgttccctgcggcggcggcggctctgggacagcagcaggtggactgcggcggggagctgggcgggttctgcgacagcgaggcgggcgggtcgtcggagccggaggcggcggcgggggcgcgcccgcgcgggggatccggcagcaagcggagccgcgccgccgaggtgcacaacctctccgagaaggttggcgaccccggcttttttttctccgcacacgtacgctggtgaataagcgttcttcctgcttcgcatccttgtgatttactgttgcttttttggtttttgggcgcagaggaggaggagcaagatcaacgagaagatgaaggcattgcagagcctgataccgaattccaacaaggtgatccgtcgcaaaaaggcgacgtttaattttaacgttcatgaactgggattctgttgggtttgcgctggaaatttatcagtgtttgtgtgctggttttgtgggttgcagactgacaaggcatccatgcttgacgaagccatcgagtacctgaagcaactgcagctccaagtgcaggtcagcagatagatcatagatgtctggatgatgctaaaaattgctgatgcattgagtttggtctcagattggtagaaatgtggttgtaggattgcagtgagtgcatcctgtcttacagattattcttccaatctatgtcgtgattagggtgcgccgtagatgctctagtgaagaagaatccttatactttcttgttcttgcaggattttagttgcgatgtgatatgttcatgcaagatgttagaagggtccactatgtacatagacaacagtacttgatcaatgccaaactcgttctgtcccttaagtaaaagttataccattattacattgggtgccaatttaagctcaaacctctttggcctcagtgcttgtttgtcaagacttattctttttaaaaaaataaaaaaaggaaaaaggaaaaaaaaacataatcatatcaacttgcttgaccccatctcgtcatgacgagcaataaaactagtggactgtcaaggcatgcaaactctgcaaaacatgaatggtgagatatggctcatccaatgtggacaattaaacattttggagctacctcttgttctgcagtacaattggggatgggcacaaagctggtttaacagtatttgctttgtctagtatgctaagtgttacagtatgcggtaatatagtctgattgcaaaccatgattgctgcctttttttaatacttcacgatttcacatgaacataatcactatgggactctgcgtggtaaggtaaccatactattggttcatgttaggggattctccccagcactttacaaagtggtttttatacattcagtgaaaattttttactaaacctggttgttgacgacatttaggatttttactgttgacttgcttagattgaccatgaagcttgctgggcgtgctggtttatactaaggcaaggactagtttcctagggtgaatgtgttttggaatccacatctattgatttactatgctgctgggtgttaataactaaaaattatatatatgagttttttcctctgaaatttgttacagatgctctcaatgagaaacggtgtttacttgaacccatcttatttatctggagcacttgagcctgcgcaagcatcacagatgtttgcagcccttggtggtaacaacgtcacagtggtgcaccccgggacagtgatgccaccagtgaaccaaagctcaggagctcatcatttgtttgatccattgaactctcctccacaaaatcaaccacaatctctaatcctaccaagtgttcctagcacagccattcctgagcctccatttcacctggagtcatcacagtcccaccttcgacaatttcagttgcctggatcctctgaggtaatataagagaaaaattatctggacttaactgtttgtatatatatggtattgcagtttcacaagattttgtttttacatgtacttttatctgtaaaagatggtgtttcatggagagataatgccaaagcaccacctatcatcacatcaagaaagtctgccaggtttgtgacactatttttaactagcttttgtcaagatttctgttcatttcactaacacacacacaccccttgtctttgttcttttcgctgacttttgtcttcatcctctcaaaggaaacgagatgaactccatcaggaaagaatcatccatgttgaacaccaataattttgatggtgtctcacttagcaaagagcaatcataggatatggtaccaaaaagtacaagacatgcataggtatgcttctacaatgtcaaatcaaaattttcaaacaatctgagcttttttactaaaagttggatttgtggtacaacttcatgatggaaaataattccttgatttgaacaaacttccttgatttgctggcatgttatctagcatgtgtttagatcatggatgtacaaatttgaaaattgttgatattcagtatttagtcctgggcttcctctaaatatgttgtagtcaagaatgacaatgagatggtgcttaaaaatggagtagatcgacagaagtttgttggccttatttaatctactccatgattttcatcgtaccatgaaagagcatattttttcagataggtgaactacccaatcttgctcaataaagtattgtgctacttcaacactcctacttcatagacatttgataagatagttcggaagaacaaataaaataatttaactcacttcctgacctaattttgtttcttatcctagcatgttccactatacctaatgaaaccttgacaaagttttagctaacattttgtttgttttgatctcttgacagcttaggacgtggttgctggtggcattgaaatcaggtgcgaaagaaggatgacgtgacctagttcagtagtctaacagacaggcagactttcagaattgcttacctctatcaatagtgctattattcttgaagcgacctgaatgcttcacaaaactagcatgtaatcgtaatcgttttaatgaagtccattcgaaaactagcatatagatgagatcatgagaccatgtaatcatctacgaaatgtttagtgaagagcagcacgagcaaagtcctctttgtactggtctaagcatctagtagcactcctgtgaaggatcagagattcacagaatatagtcgtctactgaaactttttaagactgaagaaatcttcgtggtcccccttttgtcaaatattttgagcaatcattggtggtcagttggtcacccactttcgactccatgaatttcatcacatttgttttaaaaatgctcttaccttgaaaaaaagaagtccatttggatcatgacagttttcttcgtatatgcagagattgaataatttgatgttccatattgtaactacacgagatcactacagtgtaaaccaaaggaagagaaaaaaggctatgcaaactaaacttttcttataaaactcttacaaacgatgatatgccacagtgtgattaaccaagatcagttttcggtctaaatcacattgtttgtaagagtttcatgtgccacattggcactgctctcaaccaaaaaaagaggcaaaaattattacttcatttatctcaaaatataataacctacaatcagatgtaacatatcataatcttataaatttgaacaaccttagccacatagacccatattagtgtaaaggcctgattttacccattgtccagaaaaaataaatttaaacaacatgtccaaattcataataatatattctacttcctccgtttcataatgtaaagtcttttaacattgtctaaattcatataaatattaaatcattcatttgaatttacccatggctaaaaagtcttacattatgaaaagagggagtagtatcatacgttgctgctatattacgagacaaaggatgtaaaatttaaaagaatctcgtacctgctccagtagtcgtgtcaatttggaaaattggaaagccgtggggagatgaggagatggaggggggcgagtgggcgaccaacgcgactgcgcacggacgcgtccgggcggggcgggggcgtcgtcaacgtcgcgtcactgctgcgatcgcctcccctccaatcctccacaacaaaatctcctcccgtatttccgatacatcgacagcgcaaccaccaccaccaccatgcgccgcggccgccgccgatgacgccgcctcccacca

SEQ ID NO: 46325 - DNA, 20848 bp, Oryza sativa
aagctctcgtccctgtaccaggagctggagcaggggaaggtgctcgaccacggccagtacctcgccggtgacggcgacgggtaccctcttctcccctggctcatggtgccgttccgggggccagcggtgcccggctcgccggaggcggagttcaacgccgcgcacgacgcaacgtgccgcaaggcgaggcgcacggtccggagcctgaagggatggggcgccatcgctcgcctccgtgacgaggagagccctcgcgccgccgtggcgtgcatcgggacatgcgcaatgctccacaacgtgttgctcgcgagagaggaccactcggcgttggcgccggaggagaccgacttgccgccggcggtgcagcgccgggcggacgacggcgacgccgccggagtggaagatctcgagatccataggcgcgcatcggcgtttcggggcgcattggcggcgacgatgagacgccggtgacatgggtgaattgaactgcctagctctctggtgatgaactgatgattgtttagcattagcaacgacagatctatgcaattgttgattcttttggatcaaattgtttgtatattgctagctgctgaattcctgattgttccattgatcccattgggttcttttagtttgttgcctgctgaataaaatggagaaataatttgatggaaagttaggggccgtacctacgaattggagaccccgatgctagatgagagatgctataagtacgattcttttacaaacgatgcttgtacggcgtaatggttctctcttaaggcccataatttggcttttttcctaataaaccaaaacggcttattagggaataaaaataaatttataggtaaaacttatatttatatatatatatatatattcttggtgacttaaaggctaatactaaaaaaaactacgttgaaaatatctcaaaatcaatctcaaaattaagtttgaatttttaaatttggctttttctttagcttattaggccatccgatgggagccttagcccgtgacatttattgtctgtttcatagtgaagcaattcatatcattcaccatctgttcacaatgtaggatcgtacgtagaaatcggatgaggctttacgacatgtcattggccatgtctatctgactttacgtcagaagagctcgctccgtagaaatcatatgcattgtgctaaatctttaaaagacattatgtttagaaaatatcatttaaacaagggacaattgtaaaatagtagatttcactatatagactatataatggactaaacctccacagtaaaccgaggctataacaggttcacatactctaccataatgatactaacattacaaacactgacgtatagcacaatagaagagtgagactcacgtatcagtaactgtaatagtgataacattatggtggaggatcctctcacccggctataatcactttacattaaatgcaatatattttacaattcatttgaaagaggacccaacgttgtgttttgctcgtttgatgatcttctatctatattaaaagtcctactatgtgactaataataacgaatagagttatatgaaaaaacacaacaaaaacatatggttgactaagaaatcttagcaagaatatcttcgaaaaatcattatatgtatagaaaagaatcttcaataactaaaacatgcatttatattgttgtcataagctatgggtatttaagaataagtatgttttagctgatcggtggtgaagaagtgaaacttactaagtagaaaataggataaaaataaccttaaatatattagaattagattaaaaccaaaactcatgatggaagtggatgcatttgcagagaccaaagtaggagaaaaaaatgtcaattagatgcgtaattaaacagaaacttcggagagagcaagtctcctctgctcttgcttccggagttggcgtctcggacggcaaggttcgagctatcctgttgttttacaaaatgccccctgattcatgtctatactctataccaattctcttatttttgcaaaataacccctactagttctatcggtcctgctattttgcaaagtagtcctcctctcttccgcctcgtccccgtcaaacccttgccggcggcggccgccggccggagaggcggatggcgtcgtcgatctcctgcgcgcggccctcgcccgccgccgcttcatcgcctctagctccggcagcctgacgtcaccgtccctcccctccttggattgcagcagtaggctaacaagatcatgaaacgagctccccctccaccccacattccggcgatcccccccaccctacctgacctaggccaatgagagtatcgtccccgtgccgtcggtgaacggcggagtaagattcgccggcgaggttaagtattgttcctgactttcttcttccaaggtgacagcctcgagaagctgtccccattgaatccatgttactgctacccaacaaatgtggctgggtgatgaacagaaacagtgttggcgttttctcgattaagatgagatcagtgcgggttcaaggtgtgaaagcggaggatttgaagatgcagttattcagctattttttccttgcatgatcttctgattcaggtaatccctttttccttgtttgtttttcctagtttttgtcttgtgttcattgggatgtgcttgattgggcttcaatcatgccaaaattagaggtagagtgtacgttatgttccattgcaagatggagtccacactccacagcattctgtactttgtgttataaaagctggaagcttagaattcatctcttcaattctgcattctgtttgatgaagcagcttttaagttacaaagttgcagtacatatctgacagggccagtttagtttgacttttcagctgtttccttctattagaggaaaagaaaatgttttgtatagctgctatgttatttagcttgttgtctgcgccataaattccgtaataagaatttgggcttcttttgtaacagattatttacatatttcaggccccacttggaacgccgggaatttcttttttcagttccagttaaattcctattgttaaaacgaggccttcagtatgcaatagatttgctggttaggatccaacctttcactccaaggaaaaaaattataagcatatactggaaacagaggcattttaccactacatgtttaattagaactgggtgttcatacaagttggtacgatttttacacgtagggataagagaatgctctcgacaacatttctaagggctcttattcaactagttaaagcacatcacctagctgggagccatgaaaaatgtcacctagataattacagtgctggccattattccaccagttaaagcagattttgaaccacttggctcatgcttggtctttggctcctctcctcttccacgcatgaaactgctatctttaacatcttgactgcttgtgaataattaaactctccttccagtctgccatcaacaaactccaagagccatgactgatcttcgtttaccaatttctctttgagaatatcagcagtgcgtttaacgcccagttccaccttctcaccctcaaccatccatcttgaaacccgaatccccttcactaactcaagaagcacaactccatagctgaaaacatcagccttgcctgtgatcggaagatttagaacccattctggtgcaatgtaccctctagttccatgcactcttgacaacattagtgcagttccttgcttaagtagtttgaccagtccaaaatctgcaatctttggctcaaagtctttatctaacaatatgttttctggtttgatatcgcagtgtacgatccattcaagacactcatggtgaagatatgccagtccttttgctacgccaattgcaatattgtaccgttggttccattttagcaaaggaaataagttctgatggtcaaacacaagtctgtctaaagaaccattctcaatgtactcagaaaccaagagcctacttgtcttctctgcacagaacccccaaactctaaccagattcatatgatatattcttcctatgacacttagctcagaccttaactcctgctctccatagatcacatcatttagctttttcactgcaacctgcctttcatcatcgaggactcccttgtaaaccacacctgatccaccattcccgctcttcctgaaaacaattggttgccttgtgtaactccttgtagctgaatcttcggaattggctagaaatgatcatgtaaccttcgtcagtaatctctgatattgtctcccattttttaacaactgaaaagccagcaacaattaaaaccacttcaatcaaaagcactgttaacagagaagaaaggaagtaaccaaacatgaacttggatgggacatcttcgagcatttgtgatgaagggtaggctaatttttcagtaactccacaagaatgggttagtctagaatctgattctttggtaaacggcacccccttaggaactttcaggtagatgtcattgtaaggatctgggaagctcctgccattgaaaagcgtgtactttgggtaacataggccagttctccttcggtaaccgaaggcttggcatttagcgttggccaggcacatatttctacagtttgagaacggcactgactctgcgtagtccatgtcatatccccagaagtcagttccagtgttctttctgaatgaaaagtcccggctgatagtgttgtttgtatttgttctattccctttatcccagatgactgtcatgtctgccttgcgcttgcaccctttgctccagtcactcggatcaatcacctcgaagccttggagtcaagaacaatggagtctcgggatgtaattgcagatgctgtttataccacacactccatgcatttggcataatctagagaatgccatccaagaaactgaccagttgccactggtctcgtttaggctgtacagcctaagatttccatcgtaatccagagtcaacctcctcatgacatgatcgccaagatcagagtcttcaaacttaaataggtcacttgatacaaaacgacctgtctgatttagaaccccatatcggcgactgtcataagttgtccttccattcttccatggcaggtgaaccgaaggatttggccaatatatgctggcagtgtcagggccattgtagacgagagtcaaaatattgttactgtcgaagagaaagttgtagaagcctgaatataacaaacccctggcagatgcagataccagctttacattcctagttattggttgcaacggcagaagtgtgtctgttggcgagtcgaagctcctccatagatgctggccttgtaggtccatgacaacaaggtttccattgttgagaagctctgctcgatttgcttgagtggctgttgtgttggtgctccatacaactttgccattgtagtcaagaagggccaaggtcccgtcgttctggaaggtgagcctggagcccttgccattcaccggagcatcgcggttcgccgtccaagcgacagtcttctctgacgacctggaaaaccagatggagaaggtgaaggcgttggtggccaccttgtagaagccacaggagaaatcgtcattgggggacactaggatggcggtggtgtcatcctgggttgaaatggatgaacgcctagtaagaaagctcttttgatcttttgcaacagcagtggggagcatgagaaggaaggatatcactgtggtgaaaatgcagaagcctctcacggcgacggtaagtatttttttggtcatcatccaagttggtgtgttttagaatcaatatgtcatatattgtagtgttctatcacccttgttgagtcctaagcttgcaaatgctgtggctgtttcctgttgcagttttgctacggcatgcatgaacttaaacatgaatgatgaaagcgagcaaacggccagtcgttgattcagcatgtccaggacggcgttgccgagtaccacatgcctgcttggctccgttgctgtctgattcccccaggtgtctggtgacaaacagaacgttgtattggacagggttatggcattcaaaccagaatatttgactggtaatttctatgtaatatgttaggaatatttatagaaccgttatacttatgatagataagtattatgaaagtgatgtctgagaaatatactgggataatttccctgtaccaaatacgaatgtttactccattccatccgtttgcaaatacttctcaatttttaccaagactgcatgttgagtaactatagccaggccagggccacttctgtttgtacagcacatgatagccaaactaaatctttgcaacccaaatatcagcaaattgaacgtataaacactggctaattttgaatctggctggcgttaccaaaaaatttagcaggaaaaaaaaatctggccaaagctgtcaaaaaaatatattggtagtactagcactaatacactaccctccttcccgttataagtgcatttttaaaagctagtgaggaaaataagaggaagaaagctagtgaggaaaataagaggaagagaaaattaccaaagcgtctcctattaaatgagcaatggtagagagtgaaaggacagttgagagatgataggattgttcatattttgggacttactccctccgtttcaaaatgtttgacaccgttgattttttaatatgtgtttgaccattcgtcttattcaaaaaaattaagtaattatttattattttcatatcatttgattcattgttaaatatactttcatgtacacatatagttttacatatttcataatttttttaataagacgaacggtcaaatatgtgctaaaaagtcaatggtgtcatgaaacggagggagtattttatgacagagataatgcaagtttctcctgtaatggtgttaagcccaaatggcccaagcattgcaattagaagcaaatgggccggacacaatataccacttggatcagcccagatgatgaggatgcctctcgaacttcgccacggcccacggagcagcagcgctcccggcgacggcgaggagcggcggccaccgccctcgcggcggatttggggtaccccgctgccgcccttgcccatggcggccgccgttccggtgccctggtcgccggagtcggagttcgacggcgcggaggaggcgccgtccggagctcgatgccgcaaagagagccctcacgccgcagcggcgctgataactggtaagaggggattaatcagcatatgtagttactggaggagtgggaggaggagtccgaggctgatttggaggtttgtgtgcagtgcagatgatgccggagtggaaggattcgagatttgatgagcgcatcggagcagcgccaacaatgaggacctggtggtagattcctttaaactatcttgcggttttttttttctagttcttttggatcatacggcttgagtggtactgaattttaggctccaattatatttgtttagtttgttcctgatccataaatcaatcggtaatactggaaagaatttagattcccagttcccacgtcttcgcagtcttgacaaatggcaaatagacatgttcattattaggctgaatacattcaagttttactatcgtctacgttgttagactcaaagggttggtcccaaaaaaaatggatttctcttgtacactatatagaacaaggtttacatgcatagttcaaatggatgcatccttggagtgggatgatgctaggattagttatgtttttgctgttctggctggttgtatctctggaattatatcctagcttgcttatattttctgttgttgaactgtattggtagctggtaaccgataatggtttgtcagatttctatagaagctgggccaagtggccttctatctttaaaaatggattcatcctgtacataaagaacaaactacccaaacaagtataccactataacggtttattatgaatgaatactggatactatactttaatactcttttgagggaatgcgaatactaccacagaactactccatgtaagacaggcgctcattaacttctctctgcaacaacataccttatcattttctcacaatagatagaaatgcagcaatcacagtagtggacattattccacaagcgaaagcaggacttcaaccacagtatccatgcttggtctcatgcgcctatcttcttccagacataacactgctatctttagtactgtggccgcctgtgaatagttgaattctccatccagcctgctgtcaacaaattccagcagccatgattgatcttcgctagctagtttctctctaagagtgtcaacattgcgtttaacagccagacctacctcctccttgccatcaaccacccatctggaaacccgactccccttcactaactcaagaagtactactccatagctgtaaacatcagccttgccagtgattggaagatttagagcccattctggtgcaatataccctctagttccatgcactcttgacggcatttgtgctgcttctggcttaagtagtttcaccagtccaaaatctgcaatctttggctcaaagtctttatctaacaatatgttttccggtttgatatcgcagtgcacgatccattcaagacactcatggtgaagatatgccagtccttttgccactccaagtgcaatattgtacctttggctccattttaggacaggaaataagttgtggtagtcaaacagaagtctgtctaaagaaccgttctcactgtactcagaaaccaagagcctctttgtcttctccacacaaaacccccaaattctaaccagattcatatgatatattcttcctatgacacttagctcagaccttaactcctgctctccatagatcacatcatttaaaattttcactgcaaccttcctttcatcatcgaggactcccttgtaaaccacacccgatccaccacttcccagctcttcctgaaaacaattggttgccttttgtaactccttgtagctgaatcttcggaactgactagaaatgattgcgtaaccttcatcggtaatctcaggccttgtctcccattttctaacaactgaaaacccaacaatgattaaaaccacttcaatcaaaagcaacgttaacacagaagaaaggaagtaaccaaactcgaaattggaagtgacttcctcaaacatttgtgatgaagggtaggctaacttttctgtaactccacaagaatgggttggtctagaatctgattcttcgcgaaacggcacccccttgggaactttcagatagaggtcattgtaaggatctgggaagcgccagccattgaaaagagagtactttggataagattcaccagttcccttccggtagccgaaggcttgacagttattggcggtgaggcacatatttctacagtttgagtatggtattaactgtgtgtaggcggtgtcatacccccagaagtcagttgcagtgatctttctgattgagaagtcctggctggtagagttgtttgtaatattatgtctattccctttatcccagattgctgttatgtccaccttgcgcttgcatcctttgctccagtcagtcggatcaatcacctcgaagccttggaggcaagaacaatggagttccgggatgtaattgcagacagcgtttgtgccacacactccatgcatttgacatactctagagaatgccatccaagaaactgaccagttgccactggtctcgtttaggctgtacagcctaagatttccatcgtaatccagtgtcaacctcctcatgacatgatcgccaagatcagaggcttcaaacttaaaaaggtcacttgatacaaaataacctgtctgatttagaacaccatatcgaagactgtcataagttgtccttccattcttccatggctggtcaaaggaaggatttggccaatatatgctggcagtgtctgggccgttgtagacgagagtcaaaatattgttactgtcgaagagaaagttgtagaagcctgaatatagcagccccctgcagatgcatataccagctttacattcctagttattggctgcaacggcagaagtgtatctgttggcgagtcgaagctcctccatagatgctggccttcaggatccatgacaacaaggtttccattgttgagaagctctgctcggtcggctcgagtggctgttgtgttggtgctccatacaactttgccattgtagtcaagaagggccaaggtgccgtccttctggaaggtgagcctggaaccctttccgttcaccggagcatcgcggttcgccgtccaagcgaccgtcttctccgacgacctggagaaccagatggagaaggtgaatgcgttggtggccaccctgtagaatccgcaggagaagtcgccattgggggacactaggatggtggtggtgtcatcctgggttgaaatggatgaacgtctagcaatgaaggcttgggttgaaatggatgaacgtctagcaaggaagggttttctatgatttgcaagagcaattgttggcatgagaaggaagaatattgtggtgaaaatgtagacgcctctcatggctatgacaacatagaaagcaattgcctatgatcatctaacgcaaatgggaaccaatgtgctgtagtccattatatatctagtttccagttgggtcaaaaataaaaggctcgcgagcaaattcggtcagcttcacgacaactttgacggggctcgtgttacaacttgattgggctcgtgtttgctgtatagttcctccctttttttttctggctagttgctacatatgatatacttgatgtactagcttagggaaagggacctaaaattaagccaaccctttgtttcgtcgagcatagcaaatgttagggcatacacatgaatttcacaggattttcatagtttatttcatcaaaattcacgtgaaattcctcaattccaaaggatgcctttgcagccaaaatagtatcagtcgttaggtcttgttcttttcggcttattgattgtggattatttggtggtacacttcctaagtttctaaactttcttcatcggtatttcttagaaagcttttttataacaattttttgaacttcataacatttaattcattcgtatatgtatttaaataattgttgtaaactcagaatcagccatcaactgattcaagcgggacctcaaatccgatcaatcttcgtttacgaagaacaacgagttaggtacttgctagtggctattactttgccgccctaccatttctttgttgcttcacttatcactttccatggccacgtgcccacatcgttgacaagaagtcaacaaggaccgggtggccatcaggcaatagtagtagcaatccttttctctccacgctaaaattaaaagtttaaagaaattaaaatgatgtgacagaaaagttgaaagtttacttgtgtaggaaagttcgatgtgacgaaaaagttgaaagtttaaagaaaaaaagttggaacctaaacagtacccaaatgagaaatccccattgggtgtaacactatggccatgtttagggaggaaagatttggagatgcagctggtctcactagctcgtgagaatatgaaaaactaggtattcagtttctcgtttttaattaaatttttagattttataattatagattctcaagatctgaatgataatctaaactataaattctgggagaagccacttcagaagctccccaaacatctgacatcaacggtgccaccctgagatgctgggacctttggcaatatattttttttaatatattgcagcaggcagcaggcagcagcagtagggagcatgagaaggagataaccgtagcgaaaatgcagaagcgtctaatggcgacggtaagtgtttggtcatcatccacatcaatgcaggaatatactcgtactgattagtgttgtggagccagaagcctgcaaaggcgcttccatcatttaccctttaccctttagcttataaactatatttaaaattaaaattttaaaaattaattttaagttgattttagagcttttttctgtcattgtttatttttccagcatttatttttatatttttaagagcacatataaaaaatatttatttataaattatattcttttattgataaaacattgctgcttataatcaccgtaagcaaaacgacgaccgctgtcgtggcggctctttgctgtagacttgcagtgcatgataggacatgcacgaagtagacatgaatgatggaagggaccacatgccaaacggccaatatttgagaaacacattacaagtgtaggcgtccacagccgcgtacactcgtatgcacatcctacctaagccggtatattttaatattggtaaagtaccacaaacacctcgctggcgacgtactacttaaaaaaaataatttaaactcgaaacctatcgagtaaattagctgcgcccaaacggccaatcttcgattccgcatgtttcagaacggcgctgccgagtactgcagctgacaacaattcgctagtgtccttttactgttctcatgcgctttgttttaattaatttgttgttgaagttgtaactaactaactaacggtgcccgttcggcggccgtctcactgatgttttgttttctttttgctaaatccaaaggtctcccatctaaatgaaactttccagcggcggcaggcggctaccttgttagtttttctaataataaggtcatactccttccgtccctaaatatttaacgctattgacttttttaaacatgtttgaccattcgtcttattcaaaaacttctatgaaatacgtaaaactatatatgtatacataaaaatatatttaacaatgaatcaaatgatagaaaaagaattaataattacttaaattttttaaataagacgaacggtcaaacatatttaaaaaagtcaacggcgtcaaacatttagggacggatggagtattttttttttcatgaatttttcggcacgtttcacccttggatggatattgctttgcagccgcctgtttctgggccgcagcgcacaccggaagagaataatgtaatggggatggtcgagttggcagctaaatacaaatactaatctttcagctggggttcgaacctgcaacttgcttgattttcgttagcataccattttataaaaaccaatttctagatagttttttaaatcaaataaatgtattttttaatttataatacttaatacttaattatttataattatttatgtaccaatgagtcatttcattttactagtcgctagacgctgagtaaaggtcaggtccaacggagcctaagattaggtaagtccaaatgtttttaagtatcatggcatggttgaggatgaggtttatattatcgttaatcaccttgcctactaagatattcctattctctctccgtctcaaaataggttaatatagtacatgatataatatattctagtaatatgaatatgaacatatgttatctatcccttcatctcataaaaaacccaatcatcaggattggcttcttttttttttgacatagtagtatgttcatattattaggatatgccacgtccctatcaaattatttttttatcagtttaatttattttgtgacggagggagtacatgataaaagtgatagtatctcttgtatgaagagttcacggacaagtgagtcatgtagttttttttccactcaacatgggtacaccatatcaatgcgccttgtaggataaagaaggtgacatattgtctttggggttgtaggtacttttcaggataatatattagttttagggttgggcctaactataaagacatgatgatgatatcaatctaataaatgatgcatgtcataaacttgagtcgataattatgtacctttttgccaacttcgaatggagattcttgaatggaattcagtaattgagggttcttttatcttatgttggtgtcttttagtttgtgtgttctttacattattatgtcagaagtgtggactttgtaataattggttataacttgttgagcaaagactgaaatgttattcaattaaaaagataaaaaaaaaggtgacatgcgccatgtagggataaaagtaggctgtacgatgcaaaccctctaaggagataatcgacttgctctttaggagtgaatagattgaaaagattatcatttttcacacgcacactttccgaagtactaaacggtgtatgttacgaaaattttctatagaaaagttgcttttaaaagatattaacttaatttttaatacttaattaatcatacgctaatgactcgtctattttacgtatacatttcaagacacatcctcaaaggttttgattatttagggaggtgccatgcgtgttgttgtagttgagggagcaaaggactcagccgatacttgagggaggaagcatagacatcttcccccaaagaatattggcacatgcttctgtttcaatgggcttcaagcctaatagactccaaatggtccagacataatccctcacttggatcagcccattgccccactctccccgtactgccgccgcaacgagagcaccgtcaaccacagcagcagctcatggcgccgccgctcccggggccggtggtgcccgggggtcgccggaggcggagccgaacgcccgcgcgcaaggctatgtgccgcgacggccggtgagcgcgctgcccgtatcttgctgcccggtgggggcggcacggctcggcgtggagagccctttgcaatggtaagaggggattttactactacgcatttgctcaggtggggggagggggccgaggttgatttcgggggggtttgtgcgcaggtgatgccggagcggaaggattattcgagattgatgcgtgggcattggctggcgtcgccgcgcgcataataaatggtgtgtgattgattcctaaactattgctgtcagtttttttagttcatttggatcatacagcttgcatgatactgaatagttggcggctccagtttaattgttttatttgtccctgctccataaatctagtctaggtagtaatagtgaaaaaggaattagaatttcatttcccacgtcttggtagtcttgacagctactacgacatgtttgtctactttgttagacttagacgcactcatctgtcgaataatgtaatggtatacactgaatatttagtggaaatcgatgcatctcatacatatagatcaaaatatccaaagtttcagacaagtacacttatgatgaatattactactccctccgtttcacaatgtaagtcattgtagcattttccacattcatattgatattaatgaatctagacatatatatctatctagattcattaacatcaatatgaatatgagaaatgctataatgacttacattgtgaaacggaggaagtactatactcttttgagggaacctgaactgtactactctatgtaatacggagtaagtattaagatgatatgtgttcatgtgtctgtagacattttttacataaaaatatccgcccagtatcttctctctgcaactacatacgttattatttttctcatattacacatatcagcaatagccgtactgaccattattccataagtgaaagtaggatttcgaccacactgttcatgcttggtcttttgcgcctatcttcatccagacatgacactgctgtatttagcactaaggctgcctgtgaataattgaattctccattcagcctgcagtcaacaaaatccagcagccatgattgatccccactagctaatttctctttgagaatatcaacagttcgtttaacagccagttccacctcctcctcaccatcaaccacccatctagaaaccctattccctttcactaactcaagaagcactactccatagctgtaaacatcagccttgcctgtgatcggaagatttagagcccactctggcgcaatgtaccctcttgtcccatgcactcgtgataggatatttgtgcttggtcctcgattcagtaatttcaccaatccaaaatccgcaatctttggctcaaaatctttatctaacaatatgttctctggtttaacatcgcaatgcacgatccattccagacattcatggtgtagataagccaatccttttgctaccccaagtgcgatattgtacctttggctccacggtagcacaggaaacacgctctgatggttggataaaactctgtctaaagagccattctcaacaaactcagaaaccaagagcttgtgcgtcttttcggcacaaaacccccaaattctgacaaggttcatatgataaactcgtcctatgatactcagctctgacctgaactcctgttctccgtggatcacatcatttagtttcttcaccgcgaccttcctattatcatcgaggattcccttgtaaactgctcctgatcctccacttcctagttcttcttgaaaaaatccggttgccttctctaactccttgtaactgaaccttcggaattgactggaaattatggtgcagccttcgtctcgaatctctggtcttcttccccatttgtatgtagcccaacatccaactgtaactaaaatcacttcaactacaagcaatgtcaatgctgaagaaaggaagtatccaaacttgaatttcgaattgctaccctcgaacatttgcgatgaaggataggcgtctttttctgttaccttgcagatatgggatggtttagaagccaatagttgtgaagacgacgcctccttggaaaattttagataaatatcattgctaggatctgggaatttcttgccattgataagcaaagccttcgggaaacattcaccttttcccttccgatatgcaaaagcttcgcagccatcatcgttcaagcaaatctgtttgcagactggcaatgcgacagatggggtgtagttgaagtcatacccatagaagtcagtcttggggatctccacgaatatgaatttttgctctgtattgttgtttgcgttatgatcccctttgactgtgatgttttccttgtgcctgcacccttggctccagtaactaggttcagtcatctcgaaaccttcgaggcaggaacactgaaggcttggcatgtatgtgcagaagctgtttatgccacacagaccatgtatctcacagagtcgagggaatgccagccaagagactgaccatttaccattcgttgcgtttaagctatatagccttaggttaccatcataatcgagtgtcaacctcctcatgacatccttatcaccaagatcagacgcttcaaattgaagcttgtcactagctaagaacatgccttcctgattgagaatcccatattggctgctgttataagtagtcctaccattctcccacgaccgctcataaggattaggccaatatatgctgctagtcttagggccattgtatatgatactcaatatgttgttactgtcaaagaagaaggtgtacaagcctgagtaaggcaagcccctggcagatgcagataccagctttgtatctcgagtcatcggctgcaatgggaggagcgtgtcggtcggtgaatcgaagctcttccagaggcgatgaccggctggatccatgacgacgaggttgccgctgtcgtcaagctctgcacggctagcgccagtggccgtggtgttggtgctccacacaaccgtgccgttgtaatcaacaagggccaggctcccgtccttccggaaggtgagcttggagcccttgccgttcaccggagcgtcgcggttcgccgtccacgcgacggtcttctccgacgacctggagaaccagatggagaaggtgaaggcgttggtggccaccttgtagaagccacatgagaagtggccattgggggacacaaggatggtggtggtgtcatcttgggtggagattgaggaaccccttgcaagggagcttctctgatcttctgcaagagcaatggtgagcgcgagaaggaaggagatcgatgtggtgaaaatgctgacgcctctcatggccacggcaagcaactgctttccatggaatgcaagggaaactggtacatatgttattatatgtatcaagattgtgcccattattactgtgacaacttgtcgtagatcgtgtacactaatcctgttgctacagcctaatattcccttcgtcccaaaataaattcatttgtgggtttttatgtctaacgtttgaccgtccgtcttatttaaattttttttatgattagtatttttattgttattagatgataaaacatgaataatattttatacgtgtcttattttttaatatatatatatatatatatatatatatatatatatatatatatatatatatatatatatatatatatatatatatatttcaaataaaacagtcaaacattgaataaaaaacccataaatgaacttattttgggtcagaggtagtagcatttacttgatgtactagcttttttttttaatatttgatgtactagcttcagaaagggactgataaacggccaaaactatcatagataaatgcttcaaagtcctgtatctgtgtgaatgaatatagctgttttatttgcacgctcagcagcctcagctcgattccccgtccaactcaaaaagtcagaaccaatatctccatcatcataaggtcggccttgcaagtactccagcaagttggctagcagaacgaaacaagaagcttccatggcaatgtagcaaaaccagtacttatctgctcttaaccatcctagttctgaagttcatgcatcatttccctccctccccacgtctctcctctcccagtcccagcccaagttatcaagattctctctctcccgtctagtcagagggacattgccattgacatataaattcatggtataagttctacatgttattgatcacgttatgttgtacattatcgtcgatggagctgcttccgggaaagtgttttcatccctcgaatcccttgagagatgaaaatgcatctcgagctgctccccactaatacgccaccctgatgaccaccgcaatagatacagtagcgaacgcgaccctgcaagttgcagcagctgcttcaattgctgcatccctgtgcgatgtgtggctagctagcttagctacatcatgcatgcacgtcctcgatcaaccggtcaagtacggcattaccgaagttgtgaaagctgcaagaaagataacccttggcccttggccgacttggcgacttccagttagattcatcatatgtgaggacagtaacaagctggtagtcctgtactgttcatgaatctcgctgtggcccgctagaagaagggctgtttggttggcaactaaatttatcgcatctaactttaggcaaaccactttttagtggatagtgtttggtttctgccataattttattttgtctaactcttaatcacttggtacacatatcatacactctattttcttatctaactttgtctaagcttagtttgttatcttgtttacacaaaagtatgataagactaagcttagtcacctaataaaaaatatgtggcaacattagtcctcaaccaaacaggtctttaggcaacattagtatcaagtgccaacattgctaaatgttctttttaatccataggcaagctctccaacggtacgatttctccaaaaaaaaaaaatgttaccatcagctattttgaggagaaaaaataaataattttttcaactttctattgtttaattaatccgtttgtacccaaagtaattattgcgaagtgagcatggctcaaccgtttaattttcttgtggtgaaactagcccacccggattcaaattctagacttacacgcgtattcgcatttacggctaattattcttcaagtggcaggcaacataccccactcctgacagcaaggcgtctgcggtaatttcatcgacccactctttcggatgaggtcagcctctactagttcgtccccgctctcgcttactcattgcttatcatttttcaaatacaaaataaggcccattttaaaagaatttcttttgtccaaatacaaaataggcccatttcaaaagaaaaaaatagtaaggcacgcgtaaataaagtttttactgttgttttaccttcttggtcctatttaacactgccccgagctacattataatactccctccgtttcaaaatataaacattttagctttagattcatagccaaaagttgttatattttgggacggaggtagtactactacattgacaagcaatgaatgattcgttaaccattcgctcttatatttccaggatattttaatactgacagagtagatatcatgattatttgtctgctttttttttctgttttccatagttcacaccgttcttaaaaatccttaagctcatcaaagtaaggccccgtttggcacagctctagctcccaactccaatttatctagagctggagctgtgccaaacggtacaaattctctgttttttggagcggagttggcacagcagctccataaatttgtactacggggatggagctgggtttttgctgctccagagctccactccaccctaaaagacccactaccctttaaaattttgatgtatttacacataaatgccattgaactacccctaaactccttctcccatcctctctctcctctcccatcttctccggcaagattcagcggcaaccgacggcgggcggactggcggtggcggcgcacgggctcggcggcggcgtgcgg

SEQ ID NO: 46326 - DNA, 7303 bp, Oryza sativa
tgcagttgccccgcttcttgccgccaccgctccgcctgccctgctccgctccgaccgcggcccgccgccgccctgctccggtccggctaccccgctccaccggcccacgctccgcccgcggacttgctccgctccgactgcccttgctccgccggccaccccgtccatcgcccgctctggtcgccgccgcccgctccaccgatcagtgaggagagagaggggagatggggagagaggaggaagaaaaggggtgaggatgacatgtggggcccacgtgggccccaccaatttttttattaatttgtgtgtgaaactgacatgtgggtcccacgggttttattatttttcggatcgaattaccacgtaagcgccacgtcaataccacgtcagacaaagaccgagtcaaattagccacgtaggcgccacgtcagccaaaaccaccctcaaaaccaccaagggacctaatctgagccggttttgatagttgagggacccattgtgtctggttttccattcgagggacgaaaatcggattcgttgacaagttaagggaccttagatgaacttattcccttagaaaaaggtaaagcccacatgtcaatgctataattgcatgggagagggataaacggatgagaagtgccacaataatcctcatccaatataatctactccatttatcctaaaatataagataatctactctaatcgtctcaaaatataaggtattttaaaggagtgtggcactttactaggaattgagtagtccatatgagccaaaaacacgctagaggattgaacttgaaacaccgaaaatccctaataatctaaagacgcgtgcagattagcgttgattttagacagctcaaacggcgtggcgcgccgcgccgcggcgcctaatcaatcaggccgacccggcggcacgacgagccgcgcggcgtcgaggcgcgggctcagccggagcgcgacgcccctcatgtcctccatgccgcgctcgtacccctccagcgcgtgcgccgcgagctcccgcttgtgctcctcggacagcacgtactcctgcaccgccgccgccttcgccgccgcgagcccgcgctgcgccttctcctcgacctccttccgcatggcgtccgcctccgcggcggcgtcgcgctcccgcgcgcgcagcctctcctccagctccagcgcgtagtccagcgagaacgtcgcgtagttcgccgcctgcgacatgagaacgagtgaacgcggcggcggcgacgacgacgacgagcatcgcatcaatggcgggatgtggatagcgaaacctggagcagcgtgacgtagctcgacgcgacgacgtcggagggcttcgccgccgggaactggcgctcccgcgacggcgtgacgatgccctgaagcagctgccgcgcggccttccagtcggccgtgtcgccgtcgtgcttgtcgggcacgtgccccggcgtacgatcatggtcgctcgccgtcggtttctgcgcggagaacataggcttccgatcttggtcgctcgccgtcggcttctgcgcggagaatcccggcggcggggaagacaggccggaggccgagcacgagaagccatggggagtaggtggcgtcccgtctttcgcattggcctctgcttcaaacttcctcttcttcaccgacgacggcgaacaccgcggcgtgtcgctctccggctcggtcttcaccttctgcgccgtcgccggtgcctgcgccgcggccgccttctccgcccgcatgctcatcatcatctcaaagactgacgggtccatccctgcaggaacacgacgggagttataaattcgttaatgtcgccggagccaggaaggtgttcgacactttaccttcggccctagtagaacgagaaggcggcggcggctgcggcgacgcggcggcggcggggttggaggagaatgcggcggcgaggttgctctcggtgagatacgtcctgagatcaaccgcggcgcggtgcttgtccagaagcttcgccgcccatttctcctcctcaccggtgagcaccggatcggcgatggagctcttggacggcggcccaccccaccgcacctggcacggccacggcgccgacgacgacaagaagaagaaaccttccttccaacctttgaggtgtgtgggcatccccgtgaagagcaacccgacggtgtccttgccgcggaagtggtaccagccgttcgacttgaacaagcacagcttgaagaagtgccggaacacggcgagcgacggcggcacgccggcgtggtgggagagcacgaggaagccggccatgatgcgccacccgttgggcgtgacctcgctcggcgcgaggccgaagtgccggagcacgtcgcaggcgaaggggtgcagcggaacgcgcatcccggcctccagcgcgtccttgtacacgcacacggcccccggcggcggcgtcgagcacgcgcggaggtcgccggcggggcgcgcggcgaaccccttggggacgccgtgcttcttgcagagcgcgtcgacggcttcctgcgtgcgcagtgacgaggcgatgcgatccgcgatggacctcgagggcgcgggcggtgagtcgacggcggcggcggcgtcgtcggcggagggagaggagaaagcgtcggcgtcgatgatctcgacggaagacgaggaggaggaagaggaggaatgcatcgtcttctctcgtggtcaaagcagcagaggtaccagcgggacacaagtttactcttgtaggagttgaaccaaggcgacggttggttttcccatgatggttctgcccccaaatccaattccccccctgctccccccctctctctctctccgtctcctattttgactacaaaagattttaaggctgtgtttgctgggggaggttgggaacgaatcttcttcgcacggaaaacggagcggtccattaacgcgtgattaattagaaattagctatttttttttaaaaaatgaatcaatatgattttttaaagcaatttttgtatagaaactttttgaaaaaaatacaccgtttagcagtttgaaaagcgtacacgcggaaaacgatggagaggtgttgggaacccttgggtccaaacacaggctgtgttcttaccctcaagtgcccaattcatctatcttattttccgcgtacatatttttcaaactattaaacggtatgtttttttaaaaaaaatctatatgaaaacggcttaaaaaatcatattaatacatttatcaaaaaaaatagctaatatttaattaatcacacactaattgattattttgtcctccgtgcacactgttccggggaacatccacatatcctatccttcagagtacaatgaatagatgatgtgtcacattcacccaaaatctctttatattagaattaaggaaaatttgagaaactatatacaaattatttctaaaataacttatctagtacaattaaaactagcagatttttcacacgagttgaagccgcgattcagagatgagcttttatatgtagttgtggcacaggcgttcgcaaactgggtaccattcctgaactcctcaattctatcggatggacttacaaattgaggagttcatccgataaacacggaagatactttatcgtcgctgtcacttacaaattacttatcatttttttttcaaatgtaatgtttgtgtaaagactatactaaattttatactggtgttctgtgtttattttaaaaataatggaataaattccaacctttgatactggtgttctgtgtagtaccttagttatccctgcttaacgttgctctaagctgcatttgttatacacgtaagagctacacttaatttttgactcaaaaagctacgttgataaccaatgcttcgttatcgttaaccattatttcctacattttcatcaggatactgaattacaaatatcgctatcatttttcttcctttttttttacccctttcctacccttcttgatccttaagcgcataaaaggaagctcgttttttttttttatttcacatctttgtacaaaagcttctgctaccgtgggcttcaaatccaaacaggcccaaatcttccatcttagcagcacatgggccagcccggtaggcattggcatttggatcagcccaaatgacgttgtcttccagatcaactgatcaaccaaacaccaacagcgcttgtgcccccagatcgccggagagttcaacgccgccgcgaccggcgaggcggagcttgatgggcgccgtgtgggggttccataccgcgcggctccgggaggagagtcccctcacgctggtaagaggggattagtggattggattactccacactgacaccgaggaaggtgacggggttatgattgattttttgggggcaatgtggtgtggtgtgcagatgatgctggagtggaaggattcgagatcgatgggcgggtgatggcttcgcggagctcgtcggcggcgtagtggcgcacgatgaggggtctgtgagcagccgcgacgaactggtgatttatttcctaactattccctgtaaattttattttattttattttcggttcatagagttctcgtgctactgaatatttcgctctagtgaattgtttagcttgttgctgctccacaaatcaaatagcagtaatactgaaaagaaattagatttccagtgtgcacgatttggtagtctaagaatgcatgcactgaataatgtaaaggcatacattatatattgtggaaatagatgcgccttatgcatatagaacaaagtatctaaacaaatagactaatggttatggtgaatattacaatttgatggaatacaacaactactaaaatcacatttgacattttaccttaaatctggcgcccattgacttgtcttttcaacaccataccttattatttttctcacaacacacatatcagcttagatagagttgtagcaatagcaaggacattattccacaagagaaagcaggatttcaaccacactgctcatgctcggtcttctgcgcctatcttcttccacacatgacactgcaatttttagcactgttgctgcctgtgaatagttgaattctccattcatcctgcagtcaacaaagtccagcagccatgattgatcttcgctagctaatttctcttttagaacatcagcggtgcgcttaacagccatttccacctcctcttcaccatcaaccacccatctggaaacccgattcccttttactaactcaagaagcactactccatagctgtaaacatcagccttgcctgtgatcggaagatttagagcccattctggcgcaatgtaccctctagtcccatgcacttttgattgggtttctgtgtttgatcctcgactaactagtttcaccagtccaaaatcagcaatctttggctcaaaatctttatctaacaatatgttctctggtttcacatcacaatgcacaatccactcaagacattcgtggtggagataggccaatcctttcgctaccccaagtgcgatattgtacctttggctccactgtagcacaggaaacaaacccagattgtcagataatactctgtctagagaaccattctcggcaaactcagaaaccaagagtttgtttgtcttttcggcacaaaacccccaaattctgaccagattcatatgataaactctccctatgatacttagctctgacctgaactcctgttctccgtggatcacatcatttagtttcttcacagcgaccttccttttatcatcgaggattcctttgtaaactgctcctgatcctccacttcctagcatttcttggaaacaatctgttgccttctccaactccttgtagttgaaccttcggaattgactggaaattatggtgtaaccttcgtcttgaatctctggtcttctcccccatttgttagcagcccaacatccaactgtaattaaagtcatttcaactacaagtaatgtcaatgctgaagaaaggaagtaaccaaacttgatattggaattgttacccgtgagcatttgtgatgagggataggcttctttttcagtcatcacgcaagcatgcgatggtttggaagccaacaattgtgaatagggcgtcgccttgggaagttttagatagaaatcattatagtggtcttgggacttcctgccattaaaaagcaaggccttcaaaaaacatttccctatacccttgtggtattcaaaggcttgacaatcagcattgtccaagcacatccttttgcactgccagagtgtcactggcttggagtagttcaagtcatagccatagaagtcggtgtggggtatcttcttgaatatgaatccgtggttagacttgctgtttgcgttgttgttccaaatgagtgtggcgtttgccttgtaactgcacccttggctccagtcacctggtttaaccatctcaaagccttcgagacaagaacagcgagggtctggtttgtaaatgcacaaactgtttttaccacacactccatgtatttcacatacttgacagaatgccatccaagtgacagaccattttccagtggtcatgtttagactatacaacctaaggtttccatcataatccagtgtcaacctcctcatgacatccttctgaccatgatcagatgcttcaaagttgagctggtcagtagctatgaaccaaccatcagagtctagaaccccatgtcggctactgtaataagtggtcctaccattgtcccatgataagaaggcaggattaggccaatatatgctactagtctcagggccattgtatataagactcagcaaattgttactgtcaaagaaaaaggtgtataaacctgaatagggtaaccccctagcggatgcagacaccagctttgtatctcgagtcatcggctgcaatggcagaagtgtgtcggttggcgagtcgaagctttcccagaggcactgaccttctgaatccatgacgatcaggttgccactgttctgaagctctgcacggctagcaccagtggccgtggtgttggtgctccatacaaccgtgccgttgtaatcaacaagggccaagcccccgtccttccggaaggtgagcttggagcccttgccgttcaccggagcatcacgtttggccgtccacgccaccgtcttctccgacgatctggagaaccagatggagaaggtgaaggcgttggtggccaccttgtagaagccacaggcgaagtcgccattaggcgacactaggatggtcttggtatcatcctctgtggagacagatgaacctctagcaaggtagcttttcttat

SEQ ID NO: 46327 - DNA, 6852 bp, Oryza sativa
atggccatgggcaaggaattgcctgtgaatgtgatcatctaatgcaagggaaaccagtgtgccggagtctcttgcatataaatcaagattgttgagtaaaaagagccagtaattaccgtgaaaacttcaggtggctcccgtttgctttacgtgtttgcttgaactacagcttaggaaagggaccaaactgcaaatctgggccttattaatttgtcccctggagcacggcgaatgctggcaccacaaagcaatcgggccctgtttagttctagcggtgaaaagatttagcgtgttagatcgtatatacggacacatatttaaagtattaaacgtaggctaataacaaaacaaattacaaattccacctataaattgccagaaaatttattaagcgtaattaatccttcattagcaaatgtttactgtagggccacattgtcaaatcatgaagtaattatgcttaaaagattcaactcacaatttacacgcaatctgtataattagttttttttctatatttaatattccatgcatgtgtccaaatattcaatgtgatagggtgaaaagtttttgcgtgggaatgctggcactacaaaacaatcagaccctgtttagggtgtgtttagttcacgacaaaattgaaagtttggttgaaattggaacgatgtgacggaaaagttggaagtttatgtgtgtaggagagttttgatgtgatggaaaagttggaagtttgaagaaaaagtttggaactaaacaagggcttaggccccgtttagttcgcgaaataaaaatttttgggtgtcacatcggacgtttgaccggatgtcggaagggtttttcggacacgaatgaaaaaactaatttcataactcgtctgtaaaccgcgagacgtatctttttagcctaattaatccgtcattagcatatgtggtttactgtagcacttatggctaatcatggactaattagactcaaaagattcgtctcgcaaattccccctgactgtgcaattagtttttgtttttatctatatttaatgcttcattcatgtgtccaaagattcgatgtgatgtttttaggaaaaactttttggaaactaaacagggccttagttctaggggtgaaaagttttagcgtgtcacatcggatatacggacacacatttgaagtattaaacgtagactaataataaaacagattacagattcctcctgtaaagtgtgagacgaatttattaagcctaattaatccgttattagcaaatgtttactgtagcacaacattatcaaatcatgtagcaattagacttaaaagattcgtctcgcaaattagttgtaatctgtgcagttagttatttttttagcctatatttaatattttatgcaggtgttcgaacgttcgatgtgatagggtgaaaaattttgaggtgtgatctaaacacggacttagtcgtcagtcgtgttctgaagggaaccgtatcctctgacgttacacagtaatgtcacgatgcgacattccttcgatccacaccatccattctaaatcaatggtcgtagattatttgacatgcaattaatcaaactaattagtagattgtgtggctataattttccctagatcagatattgcattttcaagaggcaaacatcgttgaccggtggaagaatcggcatatgatgataattatgtttcacttacttgttagatgcagcgatttgcacattatcctggaggaagtgaatcctgtgcatcaattttgtgctgccatcctccgtcaaaacggggcaattctgaatctacaagcggatgggttaatgtttaatgaagatgaagagactgctttagtgctaacaaaacaaaatccttcccacctattaagtacatatacctacataatctgctagttagtttgattagttagatgccaattagtatgtggccgttgatttagaatgaatggtgtggatcgaaggaatgtcacgcggtgaacttactgtataatgtcagaggatatggttccgttctgaagaacagtgggctcgctttccctgaccacatcgttgacgattaggaagtcaacaaggaaagaccaccttgttcagcacggtgatactacgttttggtgttaacctgaacatagctaggcaatactaacacgtccttactatgttgctaatggtcatgggttagtggctaggacttgaagatgctgaaccaataatacatcaaagtgatatcaagacctggatcaaccggtcaaggacggcactactgaaagcaagccgctaccgtgcaaagatgatcctggtggagctcctcctgtcgtcctgtgatcctgtccatgcagctcactcaggcttgttcttgtttactgctagattttggccctccaattctttggcacttttcaccgacgttttctagatatttgaatttgtgccaaattttaccaacaccatgtattaggtaatagcaactttaccatataaaatttggtaatgcctaaagatgccgaaacttttgaattaccaaaattatggtagagaatcaaaccaaaatagccatcaggccgagccaaatcttctcatttcgcagcaaatggtccgggagacccggacagtgtcgagaaagcaacacagtattaatcgcaggaaaaagtacgccgaaggtccctcaacttgtcatcgaatcacaaaatcgtcccccaaccacaaaatcggatacaacgcatccctcaacttacaaaaccgtgcaaactaggtccctcagtggttttgaccccggttttgtcccacgtggcggctgagtcagcgtgggacccacgtgggccccgcatgtcaggtggtgcggccgcgacggtggctcccgggtggcggcgcgagctcgccggcctcctcgtccccctcgtgcggtcggcgatggaggcgcgcggctgcggccatcatcaccgagatcgactcgacgcctctgccatcaagtcgctgccgtcggtgatgacggtgcgcagctgtggccaacgggggaggcagaggaggtacgcacggatgccctcgcccccgtcgtcgccgccgccaacactaaccaactgcttgagacgtcgcacacgtcatggagaagaacaccgccgccagcgggcaattgatgacctcctccgcggaggcgacgccgtcgtcgccgaagcggccggcggggcgaaccaagttccaggagacgaggcacctagtgttccgtggggtgcgatggcgtgggtgcgcggggcggtgggtgtgcaaggtgcgtgtcccgggcagccgcggtgaccgtttctggataggcacgtctgacaccgccgaggagaccgcgcgcacgcacgacgccgccatgctcgccttgtgcggggcctccgccagcctcaacttcgccgactctgcctggctgctccacgtcccgcgcgcccccgtcgtctccggactccggccaccagctgcccgatgtgcaacgcgctgcctgcaaggccatcgccgagttccagcgccgggccgggggagcaccgccactgccactgccacctccggcgatgctgcatcgaccgctcctccgtcggcacccgttctgtcagccaaacaatgcgaattcatctttctttcttcactagattgttggatgttaatgtcaaagcttatcagcagtagcagagcaaaaggatcgttgtgcctgcgaaaaaatcccatttcattttgcatggttacaaattcttacactgctcttttgctcgaatacattatattgcagatgaattcaatgatcgttttaatccacgaattatcaaaatatcaagtctttctgctactaaccatgataacacaccacctttttcaatggaggaggtaggcgcggacgccctcgccatcatcgtcgatgtcgccactgatgacgaggtccgcgccgctcaccagctcgcacgcctcgtcgtcgtccatgctcgccacctcggtccagcagctgaaccgcctggcgacgtcctctcacctcagtcctccctcccagtgagcgaacaatgaggccgagcggcgcagagtcgttggcgccgctgctccccatccgcagccgcgctcgcctgctgctgtcgccgcctctccgccaccgcgctcgcccgccgacgccgcctcgccccgccgccgtcctccctttctcccatgtctccgccgccgcgtcgctgctgccacatcgccggcaggctgtcaaacctccctgctcccacgtcgccgctgcgatgcaagtggagactggagaggccccggggcatggtggaggggcacagcgttctccccctatcggctggctgtcgcactccctcctgccggccgcggcggccctcctaccccggcagccgtcggtgcggcactcctcccctgccggttgtgctcctcgagaggagaaaagtgagagaggaaaggaaaggagggagaggggctgctgggagagagggagtgctgatgtggcatcctgacatgtgggacccacggtgactcagcagccacgtcggacaaaacctgggtcaaaaccgccaagggaactagtttaccctggttttgtaggttgcgggatgcgttgtgtccggttttgtggttggagaacgattttgtaactcgatgacaagttgagggaccgtcggtgtactttttccttaatcgcaggctcgcagcagctaacacttgatccactgggccgtcatgcctgaatcggcccaaaggagggagccagcagatgatcaggtacagcgcgggacacgacagcgttggtgtcgtgtggtcatggtcgcctccaaactccaaagtctccaagactccaactgtccaacacctcatgcctgccggtacagttttactcgtcagcatccccctttttttttttttgaaactgtcagcatcctctctccggatactccgccacctgtgtgtatcttttttcccttggagaaaccgttttgctgataccagcaactgcccggccatacaataataatatcatgtccagatactcctatacaattacaaaatagcttgagaatgaatagttctgctatcaattattcaaaaatagagggtgtaataaacatagagttgtatttatcttggactctcaggctctcagcttaccattttatatattagtttaatttgaaatactctgaaatattaaaatacgcaatgtaccgggcggacgactggtattattactgatcttgctcaaaatggtcatcgtaatttcagaacgaactgatcgttcaaacgttcctcatgttgcgcgtgtgctgcaactactgcacggtaaaagtgataggaatcggtcggaaacagtattaatgtttttattatttttacaaaaacgaattgaaataattggaaattttcatatttatatattaaactattcagtatcaacttcaattcgacgtcaatagaaattagaaaagcataattatacacagtaataggcgttcaagatattattgttattatttagttttgtggaaatggtatcaacgtgatcggaaaattttgtacatgttttcaccctgcgggatatctcaattccttctcctccctctaccgccatatcagcacacgttttagagcaccaatcataacccataaatccgtgggctactcacttatttaatttatatgtgaattcgtgacctgactcactcacatactatcaaaaatttgtctcagtcacccatctccttctttcctggtccgataagggtttatcctacggttcgacggttatcacgatagtcgtgcggttactgaggtataccgtgatttaaaaatatgataaagttaccgcaggttttaactgcgcggtttggtaaacctgttcctcctcaccaaccttctcctccggtctccttatgtgtctcaccgaggcgagccgccgcgagaccgcatggacgcggtccacgcacctggcggtgcacctcctcctccccggcgaagaagacgtggaggagagtaaatgagcaatcaggcccacggcccaatcgccgtccaccacccaccaccctcagcgacccaaaaccacctcaccaacccaactctgtaccgtactgtacccgccctcccctcccactgacactccgggcccacctgtcggcgcgactcttccacggtccccttctctcctcagagattttttccacgcattttttaatttttttttctgcagttcacatgctcttctcccactcttccgccgcgctatataaaccgcgcgaggcgtcgttgcctcgtcggcgaagtcaatccggcgatccccggcgagcgagagatcgaagcaagctgctacacagatctcacgacatggccgaggcggcgtcggcggcggcggcggcgacgacggagcaggcgaatgggagcagcggcggcgagcagaagacgcggcactcggaggtcggccacaagagcctcctcaagagcgacgatctctaccaggtaacccgccgtctccggccatcccctcctcgccggaaaacctccgccgccgtggctgaccttgcctgactggctgactcggtgcttcgtttccgcagtacatcctggagacgagcgtgtacccgcgcgagcacgagtgcatgaaggagctccgcgaggtcaccgccaaccacccatggtacgccacgaatcccctcctcctcctcttgggccccgaatcggagctcggcgacatcgatttgattcgattgggagggatcgatgttgttcttgcaggaacctgatgacgacgtcggcggacgaggggcaattcctgaacctgctgctgaagctcatcggcgccaagaagaccatggagatcggcgtctacacc

SEQ ID NO: 46328 - DNA, 9396 bp, Oryza sativa
cgatggacatcaaccgggagaactacgagctggggctcccgtcgatcgagaaggcgggagtggcgcacaagatcgacttccgggagggacccgcgctgccggtgctggaccagctggtggaggaggagggcaaccatgggtcgttcgacttcgtgttcgtcgacgccgacaaggacaactacctcaactaccacgagcggctgatgaagctggtcaaggtcggcggcctcgtcggctacgacaacacgctctggaacggctccgtcgtgctccccgccgacgcccccatgcgcaagtacatccgctactaccgcgacttcgtgctcgagctcaacaaggccctcgccgccgaccaccgcgtcgagatctgccagctccccgtcggcgacggcatcaccctctgccgccgcgtcaagtgagcccgccgccgccgcgagtgcgactccggccgatgcccaagaactagtcattttaaatttataaattataactaaattgtataatttttgccttttttttttaatttgcaagctactggaaaatgttatttaatatatgtataaatgtcgagacaataatattattgcattataaattgacctggtttttgttagctttcgttgcgcgtgagaatggtgagtgtgtgctgctgatgaaactcgaatgttcacttttgttgtcttgtccagctttgctaaactttggcagcattagcaaagctgttttgttctgtttctgaattgttcttggattgaaatctctaatattgacttgataattaaatttgaccggtttttggcagtaaattccttcagtattggcagctcaaactgaattcttctactaatagtttagtgcttgtggagagtgtagtcgtgtagagtggactggactaattcagatctttacttggttagctgaagatggcatccgttatctgaattcttcagtagttggtggataatgacaactcgatgtagagagataatttgctgcatgttagtttggaagtagcttcaaaggatttaattctcagcgtccgaagtcttaagtacagttggtttggagagctgttcctgtgaagacttttatgatttgtgctagttatggcatcacatgatcacttcaattatcacttatcgatctagtgagaccaaccatacataccatacaaaggtaaaaagtgttcaaactggattgaacaagttctgtctccatatagatcctactaaaatgcatacatgttgtagcaatcccatttcatccaaaccaaacaaaatctctttcattcggctctaaccaatcaaacagagccatttgtatcccccgaaccaaaccagccgagcatggatgagggatcgagggcatccgagcaaccaaacaggcccaaagtgaatgctttggtcgattttcgatttgttccctacgaatccaattttagtccttcagccagaaaaccagatacaattgatccctcaactatcaaaacaagtgcagatgagctccctcgacagtttggacggcggttttggttgacgtggcgcctacgtggctaatttgactatgtttcatctgatgtgacagtgacatggtgcttatgtggtagttcgatccaaaaataataataaatctcataggacccacatgtcagtttcacacacaagataataaaaaatcgtgggacccatgcggccccacatatcatcctcactactcccctcttctctctgtcctctctttcccctcttatctctatcatctctctctcggttgggaaagcaacggtacacgggcatcggccggtgggatgataggagtggcgcgagggcgccggccggcgagaggagaggagccgcggacggaggctgggaggaggaaaggtcggcgagatataggaggataatgagagggagaaacggtcactacccgtggctcctcctcccaccgaccggagcccgcgcgccgctcctttcccgccggtcgccgctcatgtctcctctcccgctcggctccaccactcctctcccgccccggcgaggtcaacggctacgacgacattcttctcatccacccgcgccgctccacccctctactccgccgggacatcggggaagtggatctagaggcagaaggggttgcggcggtcgacttctcgctccgcttcctctcctgccgccgacgaagacgacgacgacaatggcgacgggttcgaggaggcggaggacgcgcacctcatcatcgcagccgccgcccccgttttcgttgtcctccgcgacgccctccaatgttgacagcatcatcgccatgggcggcaacgccaccgccgccgaggatgatgacgatggcgacgggttcgaggagcaggaggaggagaacacacagctccgctatggtttgtcgccgggcggccatcactgtggtttgttgctggcccgctccgccccgccggcttcgtgcgccgccactctgcccacaccaccccgccggcttcgcatgagagagagagagggggataggatacagagaaaagaagagagtggatgagggaataaaatttgaatatatacctttgtttttaaccttttgcgtttatatacatgcataggaaaaaattgtgaaaatatacctctgccacagagtggagatgcgggactgagatggtgccactcgctcccgcagaacggccgcgtggcaccgtcgctcccgcggaatggccgcgcggaaccgtcgctgccgtgctcgctcccgcgcgcgacgcgcgacgtcacggtcccgcgcggcgggtgcgcgcgaccggcgtggcatgcatgcaccgctgtgcctgcatgcatgcgtgcgcttgcgtggccgtgttccgcgtcggtcccgcacagctattctgcgcgatcgtcggttccgcagaatggtggtgcgggaccgtcgtggtagaggtatatttgtgtgaaattttatagcatatgtatataaacgcaaaataaagataaaaacggtatattttcaattttttttctactagacggtagccacggtcccgcacaaccagtgtgcgcgaccgctacggttccgcagaaccagcgcgcgcgaccgccacggttccgcagaacctgcgcgcgcgaccgccccctgttctgggactgcaacggtgccgcacacccaacgtgcgggaccgagtttcccccggccagtcccgcagtccaccgcggtgccgcacggccggtcccgcaatccgccggtggcgcacgcccggtcccgcaatccaccccggtgccgcacggcagttatgcgcgtgcgcctcggtaccgcacgcccaatgtgcggtaccgtcgcggtaccgcttctccagcgtgcgccaccgctccgggatcggtcccgcgccgccaatccgcggttgcgcttcgctcccgctgccccgccctgcggcttaggtataatttcgcaattagttgccatgcatgtatataaacgcgaattagggaaaaaagaagtatattttcaaatttttttcctggatgaggtggagggtatgggtcctactattttttatcttttatctaactgacatgcaggctcacatatttttgttttatttttaaaattgttaaattttgcttcatgtgccatgtcggatgaagaccgggtcaaattagctacgtaggcaaaaagaaaaccgccgaggtatctcatctgcacttgttttgacagttgagggacccattgtatctgtttttttggttgaaggatggaatcggattcgttgacaagttaagggacctcagatgaacttattccatcaagaattctcaagctttaaatatctcccagtattaggtgataaggatttttgttgggcctagccttcactgtcctgctaggtgaaacgggatcgatttgggctagaaaaggacagataccatggtgcacttttgttatccattctggcctagtggcctacatcgaaatgattaggcttattctgcttcaaatcagacgatcacttaattctctgttttagacttaaccttatggaagtgtaagttcatcagattaaccatcttgaaaagaaattgtgtccatcatagtgtcatactgacaaaaagtggcatcttataggacagttcgatcgaagcaactactaacagagtttgggttgggttcgtgtcattgtctccctcacatgtttttctcaacgcttagttggtgagatgtttacatctggatgcgttatcctgatggatacactcacagagaaatgatttttcttttaaaaaatatcagatatgcaaagaattctcgttcaatttccgtatagaaataataatgaatccataaatctgtatagtatacatttattctgtatttctgtatgcgcactaatgtacaagccaaaatatacacaacacaacacatcagcacaacgcaagggtcatgtaaaataaaacaataaatcaacacaacacaaagaatcaagacacagcacgagtccctttcatgaatcttattcgattcaaaagtgaatcattcacgaatctttctttctttttcccatttactttatgaaatggatggtatttttcatcaggtctttcatgagacctggacgttggcattgaggatctgagggatggacctgatctgcagcgccggtctgatggcgagaagtccggcgaagctctccggcggcaccctcatcccgccgacgttgatgcactccagcctccggcagccgccgacgagcgccaccaggccggcctccgtcacgtggcggcagctccacactatgatgctctgcatcgccggtcaatcgcaatccacacaaaaaaaaaaacacgaatattaggaaataacctaatatcaaataattagaaagggtgagacttcgaatccaggtcgtctagcccaccaccttatggagctagccggaagacttttgggcgtttctcgcaacctaggactttttttttccacaccaaaacaaagtcaagcaaaaaacaccgtgcaaatgtgactagagaattgatatgtactttgtcagtgtttttattaattcgtacttaatctgtagttcgacacttcaagtaatctaagcgtgtggattagtatcaccatgctgtgtttcaacgctagctcttgatgacgataaatctatagttatatttcaattgtcgtaagtaaattttgctggctatgtaagtgtgatagtgatggcatagttctaggtaattttatctgatactatgtgaagaacatctagaagacttttttattttttaaaaaaaagaaagaaagaaagaaagaaaataagatgccacagatgagcacaaatgatcacatactagaaggctttagttgcctaggattctatgaccatcttaagatgatcacgctcaaagatgttacttctttcctgaacatatcctcatctcctactgataccagaaccgatgagaagcttttctcttttttttttgaaacgcgaactgatgagcaacttcaagacaggaacaggcataattctgaagcaattgatcactgatcagtattgaagtctttatcatagaggttgagattatatagtagtacatggcccaggtatggtgcaagaaagaacaagatcatcaagatgatatattgatataggttcctatcccccaattaagcatggcacagctcccccatcattttttccaaaagaactacagtacccttttaattctaaaggcaggggtgtttttaagcagaaataatagcaggatcgcagccactaagataatagcagaaataatagcaataactgcatacatatcctgaccacacgaacctgagaataaacctcaaccagtaacatcatttgtctacttcaattcaaagaacaagccatggcgaatctgccaaggttgtcagttcaaccatcattcttttccccatgaaatgactcatttcaaagtatcaactactgtaaacacatcgtacatactgtagacagaatatttgttgacttctaggatcttttttatgtggtaccttgtcatgtttaatttgcagacacgaaagtgtttccagattaagaaacataccttcagatttatacaactttttgcaactgcatacaacgattcatctgtgataaatgttccaccaatgttcaggtgctgcaaagaatgcgctcttgaaacctacagggaaggttgacaaaagcacagtatttattacgacacatcaaagatgtccttcggtagtgcagggtaaattatgaaccaactgattattgttgcaattttcggatatgaacagtggattattattctgaatgaaaacaacacgttaacaatgcatcatgagttcatgacaacatcctgcaacactataaattcctatccaaatccttattggcttcttatacactatgatagcaatagccaataatcaataatcaattgacataccattgagtatgcccttgaaacatctaagacggttttattaccgaaacaatgacacaaacatagcacaatcatgagccaagttgccaagtctcccaacacaaaacagcaaattttttgcctgttttctccatgtttccaagtaagacggcttaaaagttcaatcagagacagggcacacctgcctggtcaatcagaaaattcccaatccttaattgcaagatgaacataacttaaaaactactaatcttttagacggggatttgaaagaaatgattaccagctggatgacgccattatcggtgatcccagccaatccccagagagagatggaggtgaggttcttgacgcaatcggcggtggaaatcctgatcaatccttgatcagtgatctggcagccccagcagcttcgtgaactccaagaacggggaaacaaagttaggcaaaaaaaaaaaaaaggtcacaatctggcagcagcagcagcagcagcaacaagaagttttagcttgatcgattgatcattcgagggttgtggctgaataagggggaatcaatcggctactactcacatgtcgaggtctcggaggttgacggcggcgcggacgaagcgcgcggtggagtcgtcgccggtgcgctgccccgcgaagctcatccgccgccgccccgccagcgacctctccaccgccctgcgccaccgccggctcactccccccgccctgcagccgagcaaacaacacaagcaggtcacgccacgccacggcgtcgcgcgtcgatcaccacgagcagagcaagagcgcgtacatggagaggtcgtggaaggatgggaggagggagagcacgtgcgcgaggaggtcggccggcagccgctcgacgtgcggctcgggctcctccgccgccgccggtggcgcgacgccgatgacgaccccaccagccatggctcgcttcggctcggttgcttctcctcgcgctcgccgtggaggcgagaaaggcggggggcggctttgcttatactttctccatggtcgaggtcgccatggctcacgtgagcttgacgcgacgcgacgcgcgcccatcgcttggaattttgctgcgcgctgcggccgaggtcgcatgaccatgtggacatcctcgcgccatcgagacgcccaccgaatacgcctcttgccaaaattttcaaaaaaaaaaaaagttcacacaaatttgttcaaattttgttaggatttgtagtgaaactgccttagttattggtaaaatctgctataagacatccaaagtttacggtttttgccgctgaaggatatcgacatatcgtctgcctccattggttaatgatcagagttaatccacaaccatccactaatgttgcgggtgtccagcgatcaattgcccctttttagcccctccaaagaaaacatccttacggtgttctctaccaaaaagcacacaaattgcgtgtatcctatagaaattttttgcctaattcatacgtaaaaggaggccttgactttgaaattggtaggggagcaaggccgatctgggctgggttccattgggccgaatgcatcgaggacccacctgtcagacgggtccatgtaagagtctccaagaccaggtgcacgcagccacgcagcggagcaccaccagatctcccttggaccggttccatcgtctccgccgtggaccagcgccaaccctcgccaccgcacgtcgccgggctccggcgaggccgccggagtgtcgtcgggaagcggagggcctcctccgtgccgcgcctccctccgcccctcaccccttcctcctcatggctaggtcctgacctgaggtggggctccgcggctactgctccccgcctcgccccgcccccgcccccgccccctgcctctccgccgcggcgccactccgggctccggcacctccctctccgtgcgctcctgcggggtaagccggtgagggacgcttagtggaattgctagtgctcttactcttgcgttagttagaggtagagctgcttggagtgaggaattgatgttgcttttttttttgggaagaaaaaaaaatctactctgaacttctgaagcaagtaggattgcttgatgttgtagatgaaaccagtgctaaggaatgtggtccttttgtttgttctgtattgtatcccagtttcacgatgttgtttagattccagcatttgcatactccatagctttgttaccagtctgattatgagtgaaaccatggagctttccgtagtatatatgaaaattttcctttcttttctcagccaggaatgccaatataattgatagtcaacatcctaggatatgagacatgttgcatggggcttcagtttagtggatgagtgatcactctaacaactagtacggtagtaccaactagtactgccagcataattgaccacgttgcatttgacatcttatataaagtaggggattttattacgacgcatatgctgtagatttctcctttctatcgattttgtgtttatttttgtaccacctgtggattttaagtggaacaattctctccttttgttgcagaagttgtgtggagctatctctgatgctgtttatgcaaagacttatgctcacttcttgattagaaatggacagtagccgagattctgaagaagaaaggcctcaaaggaaggacaatggcgaagaaactgaaaatggggaagatggtggaaatgctttgagcctcaaggatgttgccaatgagcttcttggttgtgttgtccatagtgaggaagaggcatacaaactgtattgtgactatggacatagaattggttttagtgtccgcaagggtaaacagtcttacttcattggcacgaagaatattcgtacaaaagattactactgctcaaaagaagggcttaagtacgatgagccagttacagaagcaaattttaatcgaccagacacaagaactaattgca

SEQ ID NO: 46329 - DNA, 922 bp, Oryza sativa
aggaggaagaaaaggggcgagaatgacatgtggggcccacgtgggccccaccatttttttttattaatttatgtgtgaaactgacatgtgggtcccacaggttttattattttttcggatcaaattgccacgtaagcgccacgtcaatgccacgttagacgaagaccgagtcaaattagccacgtaggcgccacgtcagccaaaaccaccctcaaaactgccgagggacctaatctgcgccggttttgatagttgagggactcgttgtgtctggttttctgttggagggacgaaaatcggattcattaacaagttaagggacctcagatgaacttattccttttctaagcactgctacacatacttattttttcttataaatttttactaataattacggttgatttaggtagatagacgttataaatattcaagatgcaattacagcattacatattagtgttagtgttcgtaagaatttataagaaaaaaattactactagtacatgtactttttcttttacacagcttttagaagttcagggacggactacacccgattttacggaaggacgcaggtaaaactcagacctacacttgagagacgtaaagtgaacttttttccttagggtgatccaagtgtcactgcgttttgctctagattgcgtagcggcccattttccgctaaactgaaaggtttcgggcccgtttgcgtttgaaggccactgcagcagaagcttttgctccttctgtttccgaatacaaagcttaggccccgtttggtacggctccaaactccaactctcagctctaaactcctactccagttgaagctagctcctattggagttacagaccaatcaaaagtgtttggcaaacttttagctccagatctgaaaaaaaaaagaaaaaaaattttaaa

SEQ ID NO: 46330 - DNA, 32470 bp, Oryza sativa
  unsure (1)..(32470): unsure at all n locations
cattcacaattgagcaaatgacaagaagaaaccatgcttcacaacttcaaaatacaaacatgaatagtaccaatttatcatcaaatgtgaacgaatacaaaatattgtctgaagagaaagctaagctagttgctaacttaaagcaaatgaggtgtcatggttggaaaagttataaagcatatacgaattttagtgttgtcgcaaagtttttaaaggcatttttatgataaaaccttgtacgcacacaacaaacgtgcatgaattattaaatgaactcttgtgagattttatttttcaactctacactttaagtaccttcatttagttttaatgtataagaacttataagggagtgtgaataatgacatcatttaccatttccatcggggtatagaaatgagtatagatgtcacttatttctattttgctttgaatggcaggaaattatctattcataataatgagctggtttttatctacaaaatgactgggaaagttaaagttttgccaaagataaaataagaaagatattgctgtaaagtgcccattaatactcattattgtttcctaagtataaaaaaattccccctatatattggtcactattctcctttgatagtatgtcagatctaacagatctctcccttgtaaaacagagtgaacatttgaagaacggtttgtgtgtgctgagatcttccaagcttttgttaatttttgttattgattttctttactgtgcttgcaactggtatctagactatcttgtatcctcttgatttgaccgcatatatgttcttctgctataagcatgatttgtatttgttggttttttggatcgtgttctaatataaagtgatctgcatatataagctagacctgcatgttatccatcttttgtaatactttgccacgtactttgcataacatgttattatacgtagtatagtttctgtatgagggaggaacaaagagccggtaagatttttaggtatataccgctgaagtgtaaatatggtatgtgccatatttacttcacttctagttcatcctaagtatgatttgtcaatttatgtattagagaaaatgttgtacatctaacctcaatagatcttgactgatgtatcactgactttgtttttccttccattttctatccaggcaaacaaaaccaactgagggtctttcacatgggaaagtacgagccagaggcgccaattgccacagtggaagatcccatatcatcgcatgataagttagaaaacactgagatggtggccagcctagagatgctaggtaatatgactgacaaaccgttagcgccattggagatgctacccaaggtcaaattaagcgtggagactcctcctgctccaatgagtctacctatgaggtttggtaatggaggttgtcacattgatctgaatgatcaaccaccagaggtagagaagttagttgatgaaactctgaagatatcaggagaagagatcaaagccaacatagagctgcctgctccagttagccctccaaggagctttggcactgggggttgtggatgtgatctcaatgagatgccagaagataatgatgagtcctaaaaggtggtattatttccttaggaaccattgcttggggtgctccaatcattcatatgtgtggtttttctcttaggtttcgaaattgtctggtgaactggttggttaccttttcttcattgtcgaatttcatagcctttgatctttcgaggctggaatttagtaagaattgatggcaaataaattatttacagttgcttttatgttcccttttcggcttttcctatgggttgtttttgcttgatatatgttcttatgtgcaaagaaaaaaaaaagacacatcttgcattagactctgttgctaccatttgaaagggcaaggatttcgggatgagtatttgaagtaaacaaatgcttttagtccagaaaaaagcaagatgctcttaaatcaaattaaaaactgaagtttttttttgaatgcgcaaaaggattgcatgttatttgattaggagaaaacatttaggttacacacaatccataggccggagttgttagaattatatataccccggaatgctcccagcgtaggatattcatcatgcacgtagcagggagagaaatcttatcttagctaaaaggagctacgagtattacagcaaggagcgctacaaaggaaaaaaatacagtccaaggggtaaggaagaaaggttcatatgctcccaactaggctcctaacttagatgcgtcggacatgaccattcccgcccctcttgcaggattaaatcgatgacggcaagcattgagaatagggtcccattaagacgcgagcattacactccctccacagttgccaagaaacaaggagcacaaatgagttgaaggcacgtcggaggttgggtggcagctgctaccacgcatcatgctgtcttgagcccttgacgagcgaccgagagcaatggcagcccagccaagtaaggaaaacaccctaaactacaaccggtgagcaaagacaaactacaagaggtgtggttgactgtttactgatcctaggcacagaatggacttgtgcagtggctgtccataccccacacagcatcagagataagtggtcaaacaccatctttgtagcgccagccaaaggaagaacctgcacttccgcggtccttgtgcatgccatagaagattggcacatgtgaagaactgctgcccacgaaggatgcttgcagtagaagaaacaaagaactcggcatcacttgtccatcgtcaaagaaggcagtcccccacatcaggctgcaattggaatagctgcactctttaaaaaattgaagtattctttcagatacatccaattcaatcattttactttataggttacaaaaagcctatttaactttgtgatcattcaaatattgttccacatgatattcctttgcttattctttacatatttattctatgtttgatagatcaaatgattgattgaaaaaatcctatggacactagcggctcctactagaagaagaaataataaccattagctcttcaaccaaaaagatttcaattccataaatccataaaccaaaccttgttttttcaatttgtactagatactgctgttgttatttgaattcaatgagtggttggttgctgacatttagatacaaaccagcaattgaaaattatttgaagaacactaggaaatgggaatttactaattcttctctatgatcgtatgcctatcaatcaattccaacaacacgttccttgtgcagctagagggtagtccctaggagtgctcgggggaacccaagctcttctctctgctagattggttcaagtcctgttgtttctcgtcaatgtgcatgcctttcttagaggctatatatggcttatatacattgagatgctcccttgggggcaccgacaaatctactattacataaatcatggctctattatttctcgcaacgtgctctaccatcttgctagcctgacacctttggacatgctctacagtgacctcttaagatgtctgagatgggatgcctacttttcccgctcctgatggtacatggaagttgtgagagggggcggaaatatgcctaatgaagcttggcaatgcgacatgcatcataaataaggaatgacaggatgtagtgtgcacactccctattgcgtgtgcacggtgagtaatacctctgaccacgtcaagaccggtcaaagctagatgacttccacgcctctttatttggtggtcgtgggccaccatgacatgtcatggaagcttgattttttaagttttaatttcttgttttgtaagtgatgggaataggtagagttttggatagagaactaggttttttattacgatggagtgccaaaatttgacatgataagataaaggggattgaaaaggagagatttattttgaccggaactcttgtctgcgttataagcaaggggttcccatcacacctagactaattccatgtgggcagggggttagcccctgaactcaaaggcacaaaagacagtccaagaataggcagagcacaccacgtggcgcagctgccccctgagcagggtaggtccaatggttgccaaacggaggcagctagaggtcttgtcgatcgagtgagaatgtgccaaaggataaccatctgatctgctaggccgaatagaggacgaagcattaaaaggcccatctgatctccttggtcgctctcttgtagcagcgtagggcatctatgtcaactaccgaagggtggctagaagttaattctataccgagtcgaacaggtttcttcggttttagcgagaagcttcggttttcatatggactttcttcaattgttggtttgcatcctcttgaaccgaactcctagataaaactgaaaacaacattgtcagcagctggaactagggtggctgttctcgatccggttttcttggtcggtctataaaaagttcagtctttgcaaagtaatgacaaaagttagcatgaacatttgatggaactcgagtccagtctttggttttctcagtttggtctttggtcttgaccgagtagaccgaagtgaagaaacttcaacaaaatcagacaaacaaattgaacgaaaaaaaaccacaaatcgactaccacatataaatgaattagagcgaaaaaaatgatctatgatgttctgtgttttgttgtagggatgccagagtggctggggagacacctgtcatcacggggaggacagtagcattatgccttttagcacagggaggctagggaattatttgtcgttgtggaccacagcggaggagtcggactggacctcgcaaaggcaaagcgccttgactggtggtggaggcgtacgtagttggagatagcagcgccgccaatgcacgccgcaagtagcagccttgcaggccatgggatctcatgatgccttgacatgaggcctagcgccctgacataggtaggagtggcaatttccaccagagtcgaggacgggaaatttggtcccatgggtggattgggacagggccccgaggtaatatggggtggggatggcgacatgatttggaatcataccatgcacctatgttggcccgatagccctattagaggagttcacatacatttggagaaactctaatcgtgttatcatcttgttcccttaccattgccgcatgccaagtggatacacgactcagcttctgctatgctcggtgactccgtttcattgtcgcacccaattagaggtgggcactcggtttatttggtgttctataagttcagtttctcaaaatttctacctgaatatcctcattagaaaataaaaccgagaacaataaacctcattcaatttttgttttataccgaactttatggtataaaacggttagtatgcacacacgtacaaatgtgcgggaattattaaattgactcctgcaggaacatattttttcaggtctattatttagttgactttcatttagttttgaatgtacaagaacttattaggatgatgatgaatcatgccatttaccatttccgtaggtgatatagtatggatatagctgccaattatgtctcttttcttttgaatggtagtaattaatttgtttataatgaacaagacagtttttatctaggaaattaaagtttttccaaagacaaaatagaaaagatattgttataattaatgtgttcattagtactcattattatttcatacttataaacacatttacccaattatatattggtggtcgttctcctttgatagacacttcgaacatctatcccttgcagacagagtaaacatttcacaaacagttggtatgcaatgatatctctcatgctttttttatccttttatcaatgcatgttattgattttgtttactgttcttgcaattgatatcaagaggatgattttgtatctcttgatttgactgcatatatgttctttttacataaacttgatttgattatttttgtttgtttggattgtgttctaacatgaagtgatctgcatatatgagacctctatattatgcatcttacatacttttgcccactgtatagtttctgtatgaggcaggaacaacaaggcatgttatgtttttacgtttataccaccaaagtgttaatatattactttacttttagttcaacctaaatatgatttgctaatttatgtacttttgaaaaatgatttatgtctagcctctttagatcttgattaatttcactttgcttttcctttatttttttatccaggtaaacaaaaacaacttaggactgttgaatagtcccacattggttgtggaagggcaaaggacctaagatataagtgggggagcccatcacctcaatggctagcttttggggtgggaatggccatttacgatcctacaattggtatcagagcctggctaggttaacatctctggcccgatggacacagtgtatgaaggcctaatggaccgtgggtgcctgcggggcccatatacctgatggactgtgggccggtggggcccgtatacggtgaaggggcggtgaagggctgagggacaccaatgtgtgaagggagagattgttgaatagtcccacatttgttgtggaagggtaaaggacctaagatataagtgggggagcccctcacctcaatggctagcttttggggtgggaaatgctctttacgatcctacaaggaatttcaacatgggagtgaaagatcatgtttcgtcacaagatcattttgaaaacatcgagatggccagttcagatatgctgggtaataagaatgataagccatcaggaccattggaaatgctccccaagctcaacttaagcatgggggactcctgctccagtgagcccacctatgaggtttggcaacagtggctgtcacattgatctcaatgaccagccaccagtggaagagaagctagctgctgaagctgtgaagatatcaggagaagagaagatgctgatcaaagccgacaaggagtatcctactcctccagttagccctcctaggagctttggcattggggtttgtgggtatgacctcaatgaaacgccagaagagattgatgagccctaaaccaatagatgtttccttatgaaccattgcttgggacgttgcagtcattcacatttgcaattttccgtttatgtttttaaattgtcttgtaaaatggttggttagctttgtttcattgtcgaattttatagactttgaccttttgaggcaataatttcgtaagaaatgatgggaaataaattatttacacagttgctttatgctcccttttcctgtgggttgttagatatatgttcttatgttatgtcgcaaaaggaaaagaaataagacatcttgtattagactcttcttttttaagattcatgcatttatttacaatagcatgcgttagaaacaaagtgcatgaccttgccttagactctgttgctaccatttcaaagggcaggaatatttgggatgagtatttgaaataatcaaatactttttgatacaggaaaaagcgaaatgcccataattaatcaaaaaaaatgaagtattcattcatatacatctaattcataataggttacagaatccacaaccactccatatcatctcccccagagcccccccccctctctctctcacacacaaaccagcagacggattgagatcctttgacgtaacttccctctgacttggttgcctgacatgtgggcccgagagtggtgggcccacatgtcagtcactgtgaacagtaacgccatggtgaacagtaacgtcaaaggatctcaatccccagcggaccttctacctctccctcttctcagagcgtgcaaggagaagggccggtggcggctcagcgaggaggagggccgacaacggggatggcttggcgaagcaagaaggagcagcgaggaggaggaggaggaggaggaggagggtaggggacgggagcgactcacgatgcaaggaggagcagcgccgaggaggaaaaggtccggtggcggggtggctcgtctcggtgaggaggagcggtaaagagaaggagggccggcggcggcggcgacagctcatcgaggaggaacgccaacgagttggaggctagcggcagatcggctcctcccctcccctccaatcccgccggcggcagtggctctacgacgaggaggaagggcggcggcttggtggagatagtgacgaccactgcgccagcaagggcaacgtacagcgacggcgaccgcgtgggaagagtgatgtcgacagtctctagacctcctcagttgttcttcttcctctagatccagatccataattttttttctctttatttctgtggaatatgtgaatcttgttcttctcatttgcatggtgagatttgatttgatttgcatcgtgcttaatctgtgcaaatggcagctgaatggggatatttttcaaatgtatttttttgcccaaaaatatcttcgtaggtggtctgctttaggtgtccacctcgaaaatgattttcgtgggcggacagggggtccgcgcataaaatatttttcctctagtagtgttatttcagtttgtactactagatattgttgcagtcgaattcagtgagtggttggttgctaacagttagatacgaagcaacaattgaaaatttgaagagcacttggagttggaaatttactaattcagagatcgtatgcccttcaattaattctgatcggcacatacccctgtgtagcgagagggtagtccaggtgtgccaaagactacccttcagttttggaccagagaccacttccaaaaaatcatcaagcctatgtttaggtgctgttaagtttagaaagcagtgcggcaagaactctcaggttaagtttagaaagcagttagacttttcctgcaattttctgtagtaagctttaggactggctgggtcaaagtaaggcatgaagttctttttccttttacccaaacttggctcaatctgacaatggtgtaccccctccataaaaaaaacaaacttagaataaaatatgacatatcctaatacagtgaatctaggggcggagctagagcgaaacaaagggtggtgccacttgcttaatttactctactttagatcaagtttaagctcatgcgagtgcctaagtttgcattgagggggtgcatacatagtgaaaatatatgaggtatagctaaaaaattttcttaaccagattcctgggcacccccctaatatatactagctccgcccctgagtgaatctgaataaccttttatctagattcactgtattatgatatttcacatccgattctagatttgctctttgggacacagagtacctactaatgctagaatcctcctacctgttatccacaccaatcctactagggctatttggcttttttttattactagctctgtcccataataattgtgtttctagaattcaagtttgttccaaaatagttgtcacaatagagtactaattatcttattaatgaattcccgttcaaatttctccctattcaaccctcaaccattctcccactcttacctatgcatcacttaatgagaaacaccatattctttcttcttaaatcttaatatatgctaaataatttataattataattattttgggacagtggtagtatctcgttgtctatttacagaaaaaaaaatatctagttaggaatctaaaaagagaatattggggatatatttttgggcttttgttcgaaggtccttcacatgcatattagaggcagaaaaatgaatgtgcgtagtgagtctgcaccttccccttttttcccctctatgatgtttgagacattgtatttttcataagtactccctccgtcctataatataagagattttatagggatgtaatatattctattactacaaatctagagcggatgtgtcacatccctctaaaattccttatactatgggacggatggagtactataatggcccgcacggcgacacaccgtgcacactaactttgactacggaatacttccgttgaacgcaacttagctatcgttgatcaaatgttttccattagttcaactactccaaaaggaaacattcaaaacgtatttatatcatgcctatttcactacttaaaaacaaatatgtgcgggccaaaacaggttttcccgtgaggagctctagcccatatgttcggaaggatctgtgaaaatctcgtttctctatgcgggtggcgcacccgtacatgaaaatcggattttcacgtgcgggtgtttatgtcaaccgcacaccaaaacaaaaatccaaaaagaataaagttaaaatcacggaaagaatcaaaaccctagttgccgccgcagctcattttcgccgttcccgtcgccgcagctcgtcgtcgtcatcatagttgccacagctcgtcatcgccgccagatccgcacgggggagggcgggagagaggcgacgccgccggatccgggcggcggaggggcgccaccatggagggagcatggggacggccgccaggggagcagattaagttagtgtccgcctccgctcctagccaccacctcctcctcctcctcgtcaacgggggcggcgtggattcgcagggccaacggtgccactcccggccatctcgttgtcatcgtcagcggtaggggtgacgtagttccggctgagtccgctcagggccctactcctcccgccgtcgcctgctgccgagccgcccaccgttgcctactaccgacctgcctgctgccgtgacgcatgagtgcgtgagaggagaggagagaaagtgagagacatatgagggtgaggataaggatgaggaggtgagatagttggagagcggataaggatgaaatttttgaagtattgagagggaaaatgagggatggtattttcacgtacgattccttaagggtgtgtttggttgcttgcattgccttagcctggtccatctctcatatccaggctgagtttagcctggctaggatgatacacatgcaactgtttggttggttgcattagttcatcctggctagtatgagattttgtttggttggttggatgagatatacggtttggaagggattttgtttggttggttgttggactttgaatatagttaccttctcttgatggggtagggtgaggttacctccataatatcactttcactgtttatgaaacaaaaaatcgcatggacaaattaaggaagaaaattgaaaatatactttattttttcatattttgcgtttatatatctggctgtgattaatttgtaaaaatatacccaatccacggaacggatgcgcaggtgcgaggacgaaccgtagactggggatgcatgagcggaacccgagccggtcacgtggacccgggatgcgcgaccgagccggtcccgcacgactggactgcgggatcgagtcggtaccgcggcgccattgcgcgggagcgatggagccgggatagcgagtcggtgccgcagaacagcggcgcgggaccgaggctgtcccgaggttccaacgcgcggaaccaagcaggccgcgtgttgttggagttgggttcttcccttaatttttccaactcatccgcgcgcacgcttttcaaacttctaaacggtgtattctttttgtaaaaagtttctatacgaaagttgtttaaaaaaatcatattaatccatttttttaaaaaaaattacctaatacttaattaattatgtgctaatggtctgctccgttttccgtgcatatgagatcggatccaattcgggtaccgagatggtgggcggcatgtgggagcaccggtcccacacgtccggcatgcgggagagttgccgcgctcacccagccgcaggaccgtcgcggtaccgcggtaccgcgtccccggccagcgagaccggctggtttatccttgctcccgtgcaaccgttccgcggattgggtatatttttacaaattaatcacagccaggtatataaacacaaaatatgaaaaaataaattatattttcaaatttctttcgacaaattagatgtatttttaacacatacaaaggctaatatcgttgtgcaaaaaaacacaacatcgcacacgtcagcacgcacagtgaaaaaaagttcagtgtggtgaaaaataaagagaagaagtggcgttcaccgcttaaaaaaattctaacagaataagaggttaatcaccggatgattaataaaaccaaattacttggtaaaggctacagatcatcaccggctgattaaattagttaggaaaaatagatgaaaaaaaaagagagaaaggactcgaagtctcccagcctcgtctgtatcgccgttgaacacaaggacgccacttttcccctgcgcgcaccgccgtccgtcgccgttgttggaatccatgtcgccggatccactgcaggcaacctccaccgctgctttactactcgccgaccaggcacctgccgcacctcctcctcctcctctgcgccatccccttcttcctcgccacccacctccccaaccacaccgctctccactttcatctcctcccctccattgtttgttgccatcggtggccagatccgtttgccgtgagctcatagccaccggatccggtggtccggcggctggagaaaggaggggacggcggtggcagcgaaggggatcgcgaggaagatggtggtgatggggcgaccgtcggcctctggatttggcacgtgggagcacatgaagggaggaagcaaccggtgaggaagatggcatcggcgatggtgaggaggggaagaagaagacaatggaggcgccgccccttgacctcgagcatcgactctttcctcttcctccttcctgaatcgtgtgtcgagcaaatgtgagagaaggcggtgaggggatccgccaaccccttgcccatcactgcaccagcccgtcccacacttgcactcgtgcccgcgcctgcacgagccgggcctggctgaggagcgaagctcatttcctgcgttcctcctcagcctggcccggagaggcattttgcacccgcccatccttgctcgctcctccatccaggcaaccaaacacatctgcagaaataggcttatttttatgagcggatccttaaaaggcccatctataaaaatcgattttcacgtacagtccttttaagagtctgcacgtaaaaatgggaggacgatgattttttcagaacgcgaccaattacggtctatctgtaatctaaacatgtccttgtacaggaaaatcgtttttagtagtgtgtcttaaacattaaaaaataggattgcacatataaatactgtgatagcaattggtctataaataattaacagtcaattaatatatcagttcaattaaattgggaaaaattgaagcacacaaaacgcgtgtaacaatacaatttggctcatgtgataattattaattcagccaaattttatcaacataaatgaaatgaaatgttccttttttttttgaaagacccgacgtgaatgaaatgatgagcctaaaccatgtgagaagggtgctttgttagggaaagcaactttccttccacacatcttgggttccaatgagaagaaagaaattgagaaccattaacttggtgttccaccccaaagggaagcacaaatttatggttttcagtctattgaacaaagtcgagcacacataagggtatattttacctggcctctacatccaaccggatatatgcaaccatttaaattagaaacttagccccacaatgatgacgctctctctctcgtggcccgatcttctggtgaagggataactctcgctttgatcgagtgcgacgtttgcgacgtggctaccaaccagaacaagtccaggacgccatgcaatcgctacaccacaaaccatgtcgtaccaactgtgacgcgcggttgatgatccctgcaatgcaaacaagagaacactgcaagaacaagataagatccaatcgaaatattgcgaataggtgattaagcacaaaggaatagttgcgattgaagtgatagatctaatcgacccggcaaatcaacacaccaactattaggggctctgaatcaatagtcgccgactaatcgagcgaggactagagacaagatgaatgacacttggcaaaatttaactaaacaaaacccaaatgtttttgaggatgtacaaagctatttatagaggaaaataaagctagggttaagtgctaattcgtggaggtggagggagacacttccgagatgggcctattctattacaaggctcaaggcccaagtttggtttcagcaacaacactgtcttgttttggcgattcccgttgactcgagatgaatttggacacgagaccggatgtgtttgaaaggtagcgagataagctttccacgaagtccaagatcacctaaatcggagttggcatgaaggcgctaggtccgtttgaagtcagtgctgtctccggaggccgaactagactggacttggaattaacattagagcgtgtgaagttatgagcgtatccgacgaagtgatgttctcatcacacaatgacctaatagtctagtgaataaagtcgagcacacataagggtatattttatccggcctctatatccaaccagatatatgcagccatttaaattagtaacttagccccacaaatgacctaacctgaaattcgttcatatgaagatttaaactctcctatgaatatttgaactcagggccttggggtgctactcagatcattacaaccactaggctacatgcaatttcataacttttgtcgacttagtcacataatttgaaaagagtaagaaattgttcggcatcaccttgaaacggatcatgatctcctggaggactgcttttggctgaaacaatacgtttaagagaacaaaatgactgagttgagattttcagacgctgccatatcctacctatgttaacaaagttttgggaacaaattcaagtagcaatgtatcacattgctatcatagcatggctaatcaagaaaaaaggggagtaaattcaactggaggaaattttacctctcattagcattaacacaatacatgtttatgccagccatcagcccaccgtatgctgggccttggaacgacgcatgctaggccacagcccactatatgctgggcctctacttagctatgacgaaataatttgttagggcattcccaacccaatgactagaatggtgtccatagcattaaataagctgccacctaagatgaaaaatgacgtgacaagtgaataaatgagaaaagagaagaaaatcatgtcttacatgagacatgatttctacacaacatacaagacattatgtgagataagtaacattaaatttaagtatggaatagtagtgtttgtattggaagagtagtgtctagtacgagttttttgatgatgtggagtttatgaaaactatgtctagtgtcttgggttgggaatgcccataggaatggttcgccaactcagcatatactcccctgtcctattttattttaagtgcaaacatgagtttccacgctcaactttaatcgttcattttatttttaaaaaattataattagttttttttgttgttatgagatgataaaacatgaatagtaatttacttatgtttttaaatttttttaaaatttttttaaataagacggacgatcaaaagttaggcgcgaaaaaatagactggagggagtaccaaaaaccgcaaattgcaccacatcgggtctacgtcatcaacttgcttgtgactaacggtactttcttttcttttcttttttttttgtcacaaaaggtaatcccagacatgagttttaacggcgcccttccgtcagaaggtcatctcagaacacagtttttatgagatttggcaagttcttgacggaagtactttgtcaaggaatgacagaaaccgtggtagtgatggcctcggctatatattagcatctgtgggcacagcataaaaccaccttggtagttactatataggggagaagtaaaaaggaaaacacagggattatgtgttgttcatgaaaatttgaaaaaagaattacaagaaaacgatatgtagctggtacttacagctagctgggaaattatttcataccattttcaaattacttttattttattaaaataacaagatgtttacgatgtttctttccttaatcttcgttgtgtctactagatatagaaataagaagtatgattttggtgctgaaaagtaagagacaaatagtagaacagggatttgctaaataattatcgacagtttgatttttttcaaccataaaaattgtattaagatgcctgcaagtgagatggaaaaaaccgtcagattcgcattaagatgtccgcaagcgagatggaaaaaaccatcagattcatattgagatgcctgcaagtgagatagaagaaaacagtgatcgatcatgtgggatgtaagctgagtggacctagccaaatgaacgtaccaactttttattattttatacatgagttacacatgagttacagtatactacactatgacctatatactacctccatcccaaaatatttgacgccgttaatttttttaaaaatatttgaccgttcatcttattcaaaaaatttaagtaattgttaattctttttctatcatttgatttattattaaatatacttttatatatacatatagttttacacatcacaaaagtttttgaataagacgaacggtcaaacatgtttaaaaaagtcaacggtgtcaaacatttagggaaggagggagtaatttagtttagatataaaaaggcacatatattttgttcatacttatgtacaagttatattacagttatagtatagttatggtgaaattatattataattatagttacatttgaaagtttttcaatcgaaaaaacttacggcggtactttagatagagccacgtactagaaatcccaactagcatgttagacatgaattattcaaatttcaaagccacgatttgcattttgtcctaggaccctaaattcctaaagactactactggggaactcatctttagtcccggtttacaacccctttagtttcggattgtaaaccgggtgggtaaagatcacttcttctctagtagtagatggccctgcaaaatataatagttttaaaataagaattccatattttttcttagcagtctaaaagctaaaacaagtaggaaaacaatgagaaatagaataattctaaaaatcaaactctaaaatactccgtaaattgtttgtaacaatgacgtcgttacacgtgtatatatacctagatacgtttgggagcggcggcgactgcacacgaaactaaagggcatgtgaggtgtgaagcgagaaagagacgccgacgctgtggctgatcgccgctttgaattggctttttggctcggcgcagctagcccgcgaccaaaacgtacacgagcaagcgagcggcgccttttccacttaaattggaacgatgtgacagaaaagttgaaagtttatgtgtgtagaaaagttttaatgtgatgaaaaagttaaaagtttgaagaaaaactttggatataaacatggccagcttaagtgcaacaagtgtcaacgaagatcttcatggatggatggatatgatcatcaaaccaaccaccacaaacccacatgccgccgcgggggaggcctacgctactacgcgcctgtcgccgacgcgtgacgcgccaacgacctcatcaccgtaatcgttttcgcataaaaaaaatgttttactcgatatacaaaataaacttttttttttttgcaagatcctcgatctgcgattctgcatgcattttggtacttattgctggttcgcctttgaatcgcaatgcatgttttgatgaagatgatgaatgtcattagtgaagggggcatcattgaattggaaacttttctgcaagaacagctcgagtttctgacctgagtatgatggagtaatacagaatgtgagtggagatatattcttcgtgctctgatctgggcccatgatagggggtgcaagcaggccaacccgcgagtttaaataaataataatttcgagtttaaataattaataatttattggttttcgcatcgcggcccggcttgccgcatctaaatatacaagtggatcaatctataaacctatttataagtcaaattcatagttaacccgctagtcaaactcgcggattacgctttatttttgcctataagcagccacttgcacccctagcccatgataacatgtcgtcttaaaactcacgcggaattggaacttgctgaatttgggtctggagaggtagtggcaggaatggtagggggaatgcaggatgtcatcatgatccgagtaaaattcattcagggtgtgtttagttcatgttaaaattgaaagtttggttgaaattggaacgatgtgacggaaaagttgaaagtttgtttgtgtaggaaagttttgatgtgatagaaaagttaagaagtttaaagaaaaattttagaactaaactcagcctcagtttgaaatttctaaattaattctcacctgtgcattaattcaacacttgagagcaagcaagcaaacaacacatccggcaattacgtagtatgtgcgtaatactcctctttctgaccttgtttttcatgcagaataaaaatagctaccgcgtgacagagcggctagctgcatgcacctgagccagatactttctccgtctcaaaaaaagacaaatcctaagttttcgtgtccaacgtttaaccgtccgtcttatttgaaaaaattatgaaaaaaaattaaaaagacaaatcacacataaagtattaatcatattttatcatctaacaacaatgaaaatactaattataaaaaaattttatataagacggatagttaaacgttggatacggaaagctagggtttgtcttttttgacagagggtgtagaaaaatagggtgatcaatattttttttttgagttgagggtgatcaatatttaagcctctggctggcagctggatggcttgtccaccgacatgcatgcatgtacgtatggcagcaaggctgagtaccgacgaaccgatcgaacgatgtcgtggttgagtagcacaagcaagcaagcaaccacacgagaaaagcgcgcgcatgttaccgcaacatggattcgaatcgtggatcgatccatccaccaaccgcaccagcagcggagaaaaggtactggagtacgtgcaacatatagctaggagcaatgcaagctacttcatagtagtatttccgtcggcaaatttattgtattgtattcccaatcagcaggatacatgcatggaacatggcccgctcgcacgatcgataccgcgctcagctcgatcggtcgctccctccatcgccaccgccaaattccgcgtccccgtccgtccgtcgcatgtgcgcaccgcccgcgcgacaccgaagctcagctcgatctcgcgcgtgcaggctgcaggtgcagatgcaggggggaatgtctgtcgctgccgccgcacgcccgtaccgaccgcgcgcgctgacaagggggacgcatttgccttgcctgctggctagtgaatcacctcacctagctacctgcagctacgcccacgaaggcgcaggggcctcctccgatctattcccgcgcgcgaggtggcgacggctcaacgcgcgggggcggagatggcgtggaggcgacggaggtcacgcggtgggctaaatccggtggctaccgacgatgtggaggacgatggcgacagtgcgaaggacggcggtggtcatagggtatgcgaacggagggaggcagctccggcgcatctctcctccatgccatcgtcgacacttggccagcagcaagtgagccgatgcaagagaggagccgtcaaggagatgggaggaggaatgtatgtggggcccacagttggccagtgacttttggcttgtcaagtttggctagtggagggttctgacttagccatctggttggagaggctgttgaaggatatattttggctggaatggctaaaatttggcttagagagtcatttggagaagctgttggagatgctcttatgctgtgttcggctatttatattgggaactagtcattcacgcacgtaaaacgaagcaaggcattagcgcatggttaattaattattaactttaaacaaatggattgatatgattttttttaaaaaaacaactttactatagatttttttttaagaaaagaacacaccatttagcaatttaggaagcgtacgcatttaaaacgagaggagagagaatattggctaccgaacaaaccttacaatttagaatttgtctaaaaattacatggacatatttacctagttcttcattccaaccaatatttataacccctcttatttaattttctcatatatttctgtgcatttcaaccaatcacgatcattcctcatatacttcacttttaatttttcttttaaaaaaaggttttatgttcttaaaagaggtaagagggggagtacagtacattgatgcctgccgcacctatacatggatcggtggtctgcatatgccgatatgcgtagcctaacggtgccgttggtgccttgtccctagctaatcatttccttctcatcaaggccggccgtgctctctctctctctctctctctctgattggagttctgcaaaagggaaaagccggcgcgtcggctgctcgatgatgctgatatctgcctcaatttgtgggtggtgatcgatgatgatgatgcatgatcgaccatgatcagctataggaggggcgtgatatgcatgttacggagcgtaaacctaccggacagcggaacatgcatgctttggctgttgttcgtagattcgagccggccagggcagattctcctccaaatatatattatcttctgtcttttggataagtgagtgggaaatcatcgataatcgatcgatcgtatatacacaccttgctaacagggtcaacgacctccatctgctagctactgcccgagcgatcctaccatgttgcccgtcctgctgtctgatgatgctggtggagataaaatcggcccattttgtttttgttttttaaggtaagcacgggacaccatctgttgccactaagctttaaatatattaattgtgttgtttgtaatttcaaattcaaggctgtaaagtagaatgatgaagaaaaaacacaaattaacactaaattaagttcaaattttaaattttgtctacggctgataagccaataagcaaacgatcaaaagccaacattcactactagaaaaaaaaatttttttccagacggactaaaaaagttttcgcaggcggacaactggttcacctacaaatgaacgcctataaaaatagttgattttcacaggcggacaactggtccgcctgtgaaaagagctcctagcattaaaaaaatgcgcagccaccgcccaccgccgtttccgcaggtagcaacagcttccctttctctgttctctatctagttcccattcccccattcaatctagtttccgttccccatcaaaccaaatcaaattcacaaaagcatcacaaattaacatagaagcatcatagttcacaattaaaacaaacgaatcacaaattaacattcactatcaaaacaaacgccatcgccgtccacgccgtcaccgccggtagccgccgccgcgaccgccctccgcgccgccggatctaggaagagggaggggagacgccgccgcctccaccctcctcgccgtcatcgccggtagccgccaccgcgaccgccctccgcgccgccccggatctgggaggagggaggagagacaccgccgcctccaccctcctcgctgtcaccactagtagccaccgccgcgaccgccctctgcatccgtgtaagttcaagtgctttaatttggtttcggtgattaatgacaaatctaattatatgagactaacgtttttatgagcctttctttgactagtctcatttggatatggaagtaaaaatgatgagaggtatgtattaaacttcacatattctaacttggtctctcttgtggatccaaaatatagtatgagcttcctatttgatctttattgattatgtgcatatgcgttccttcatatccatatgtatgcacatcttgagggggagcttattctatattttgtttattataaaatttctatcttgatttgaaatcatttttcatctcatctctctatattgtttatatcgggttattatccatcaccaaagagagaaaagattaaaagatattggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcaaatgttatcttatttagtctcatttacattgagaacatggagatcatgaaggtatatgttttatgttgctctacatcattactacatatgccttctctatatgtataggataaacccccattggtcattctctaattgtgcatacacttgcatctcttgtatatttatttgtatgcatatatttagggggagcaaatcctatacatttattgtgcatgttctagatccatattgttcacctattatttatatcggatctttgcacttgagcttgcatacgagtatatgacacttgtgatgttaatgaatactcaacaaacatatccatatctttcatatgcaaccggttggtcatcaagtgaaggatgacaactgatttgttgagactaatgttctcccttgaggtgtgaaaaggaataggtcacactacgatgaggctaatgaatgacaccatgggttagtggtcaccaagccaaggacatcgtcatgttggcaagaatgaagtcaagcttgtgatgagaataaagtcttgacaaaggatggacaagacctcagcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagactggatttgctagataggcgccgtactatcaagaggggtctatgaagcgagcttgtggatgatcttgtgccatattagttcatatgcatgtaggtgcattttgtgggcttgtctaaccaagtgtgatgagttttctcaagtcctaaaccaagagaagtgggcatgtccaataggagtgagtgacatcttgtgggtatgtccggtggatatcctttggagtgtgagccctttatccttgacttaagttgtgtttcttggatggatttttcatgggttgaatggccctttgaataagctttccatagagtccaagaacgccaaattccgagacccgagtcaagagatatcgccgttttactaacggtcggttgagctgaaaagtgacatgcggtctgaccgtgggccttaggccggtctgaccgggtctgttagccggtctgaccggcgtggtaaggccggtctgaccggccccactggtctgttgcactggtctggtttttggtggcgatacagagctgccagagccgcaaccggtcagaccgagctgacggcggtctgaccaagccgtggacggtctgaccggccactacactgcggtcagaccggccaggttgagtaggctcaatgattgccctgtaacagctagttttctagccgttacaaagtagtccggtctgaccagcctcacaacggcggtctgaccggcagagcacaaagttggggatttcggttccaacggctagttttggtggttgggggtatatatacccactccccagcagcaagggtaaggttttggcactccattgcattatcttgaacccttgcaagagctctcacacccttgtgcacttagtttatctagtgaggtgttagagagtgagttaagtcaatccaagtgcgttgcttcattgttatagctagtgtggcacttgatcatattcggcaagcatcctagacttgttactcttggaggttgccgcctcctagacggcttgtggaggtgttgcccggtgacctctccgaggagattgtggaggaggcccggcaccgtttgtgagtggtttggagttcaccaccttcggagtgaaggaaaaactaccccgagtgatcgaggcttgggtagtcctctccgtgggccggctcccgccttgcccaccccttgacgaagggggcgtgcggttgcttcgtggttgagcggtggagttgggctcgcctcaacggggattaggaaaccggcgagtttccgaacctcggtgaaaaattccttgtctcttgtctcatttatttgttgcatttacatttgtgctatttacattcatagagacatatttgagcccatatcacttaggtttgcaaaacttaacttagttacttagttaaccttgcacctcaccttgcctagcaacttaggttagttttgtttaagtgccattaagttttaaaaccgcctattcaccccccctctagtcggcctccttgatcctacaatccgccgctgcatgccgccgcacggacgcgccccgccgccgtccaacctgcgccgctggccactggcctccccctcccccctctggccagatctgggagggagggaggggagccatcgctaggcgagcacacgccgcgccccgccgctatccaccccgcgccgctaccggcctcccccctccccctccggctagatctgggagggagggaggggagctgccatcgggcgagcacacgccgcgcaccaccgcgtcggggtgtgccgccaccgcccagtagccgcctccggccggcggccagggagaggaggtgaggtgaggggaggggagaggagataagaggtggaggttagggggaaggggaggaacgggagaggagaggagaagcgagggagaaatcggacttagaaaaaatcgtcccaatgtcgcctctatttatattccacgccaattttcgcaaaggtctgcttgcaaaaataaagggtatttttgtaggcggaccggataagtggtccgcctgcgaaaataaacaacgagcatcaccccggtttaaatttttgttggcggttatttggctccaagggtcatgtccacctgaaaaaaaaaccccatgtctaaaaaatgctttttctagtaatggtttccaatactaatttgaagaaaaatcgattttaaaattttggactgaaacttttggcatgcatatggtttagatgtgatttttcaaaggttcgacatattaaatacattaattaataaaataatccattataaacattgcaattaatgataaataagaaaaaacattgaaaataaatcagaaaacatcgtggttgtaaaataaaggaacattgcagtaacaaataggaacacgaaccgacattcagttgattcataacactatataaaaaattatataatttgaatttaaatctaagttattcttaacagtaactaaattctagcaccgacaaccgctacatgaccatttcaatcacttttaattgttgcaacttaccaggatatccatttttgccaaagtatgttttacgattaaatgaaagacacaaatgcacacatttgccacagtcgcacccttagcagttagcacatgctcaagagatcgacataggtccaacgattacaagtgatttctaatgtatggatttcacaaaagaaataaattaaactgggttctacaaattttataagaaaacctaccacgtgttctaaccaattatatgttatcgttggtatatatccacatgtttctcttaatcaattgatctatcattttgtctatcttatctacatatgtctgccgtgtattttcaattttcaccccaagaattagaaattagtacattaatcagagggggcaaaaggcccagtattgtcaatcatggtgggtctagattataactgtatatattgactaatcaaaataattatatgtaaaatactaatgcatctatacaaatataaaaaaaagaatggtatgtcaatcgtaatttcatattttaaaataaatttaagctagctttgcgcagaactgggcatgaaattaggttgcttactggttagctctgcaatatatttttttaaagaaaatttgattttttttttaatttttttattttgaaaataaattgtcccaaaacttaatttcaaatttaaaccttttagccatgtcatctaaactggtgccagttaaattggcgtgccgagacaatactagtggggtgcattgccaaaagggttggatttgaaaataaattaattttgggagtgtttacttttaaagttaaaaataaaacacgtagaaaaataatacaattccgtaaacatgctgatgatgagcccagcagacaatggtaaggacctaccagttgcgtaggagcagtcctagaaatatataaaaaaaagtattctgtatggtgctatatactgatagtactgtagtaccaatagatatgaaataagtcgtccggttataacaagagaaaatttcttgtgtacacctaattctttctattctttctatgtccctgagatttgctcatttccttctatacccctaaattttagtttggatccttcccataccccttccattagctgattgttagttgaccgttaaatttctatcataaagtctattttgctctttgctatctagaaaatataaatttatgaagtatattgatgaagcgtataaatttattgcatgtgactattatatgtatgagtttattttgtgagatattatttaacaaaagtaatattttagtttcgcctcacgaaggaaaaacaaaaataatgtttatctatgacaacccctttggtatcaagaaaatataaatttatgaagtatattgatggagtgtataaatttattatatgtgactatcatatttatgagtttattttgtgagtccattaatatacttcataaatttatattttctttataaattaatatactttatgatatgaatttaacagtggtatagaagggatccaaactgaaatttaggggtatggaaaggaatgaacaaatctcaggggtatagaagagattggatgaactttcaggggtacagggaattttctcttataacaacgtaatactaatttgctaattctctatgattaggggtaattttagtgtttgcgttttccctttgttttagtctcttatcactcaagtgctcttgccatgtccctccgtttccgttcttgttgtcggcaatcactcacgattggatggcattcgtccatgtatgttgcttcagtttgttctccgcattctccgttcgtcaggccattcacaatgcgcctaggtggagttgggcctcaacaccaaaagtgaaatattcgctgccacgtcgtctatcctcgcggcctccttaggaacgcggagcaaactttagacacagattcctcgtcgtgggcgttgcaggtgggacccatgctcgtgctccgcaccgtcaaggaagagagagggaggaagatccatgccgccgagctagtcggctaggggaaggagggccaccgggccggataagctcaccggctcatcctactgccctcgaccccgccttgccggcaagggcctcctcaagctcgtcctcctcctcctctccgcggtgctgggctcgtcggcccatctcccagatctaagctggacatcatcctcctcctctccgctgccgccgaagaggcaccatcgtcctcctcttctccgccgccatcggagagaggagcgcaagagagagagaggagagggagatgcaccggggtagaggggcaccgacggaaggggaggaagagcagcgcgggcggagaggagcgctagtgtggaggtgctgaggcgagcaaagaataggtagggacggctagggccgcccggcatcgtcgtcgccgctcgggccgcccggcgccactcgcgccgcgcgctgccctcgatttgccaccggcgctggcaccgctagggccgcttggcatcggtgtcgccacttgggccatcaggtgcctccgtcgccactcgtcttcgtcccccggcagcctcagttcctccggtggggaataaaaaaaagagaggagagagggagagttgaaaagtaaaaaaagatggtaccggtggtacaagcaacttgcactgtggaacatgtagcttaacacattcttgatctacgtggcacatgaggaacggcaaatacaagcgacgcactgctaatgccctcatcatcatcatcatcatcatcatcatcatcatcatcatcatcatcatcatcatcatcaccaccaccaccgtatgatctcccaggcgatgaccccgattgtcccaacctagcaaccataattgtgtcaaaggactcttttctcatgacctcgtgcacatgcgtcaacctcctcctcaaccataactgagctgaccatctcctcaccgctaaccatgcaccgctattctttttttttattgttttagtgagaaaatttttgaaaaattaagaattctagtacttttttattccttcagatatagataagaactagtttggtgaatcggaaactttttttcaattttatagaaaattgaagtaaaattttcaagtaaaaattgcaatttcttttctgaaaattgatctttgctgggtggtgaaaaacagtattagtcacagtttgaatagaaaccgggactaaatatcatttttagtcccggttaacaaacccaccgaaactttttgatcttcagtcccggttggtgctaccaaccgggactaagaatccgaaaagcgcgtcgggtcgcacgcgcgcgcctccccgcctcttatcttctcgatatctacacgcctagtcatctgcgtctcctcctctccctcgagacgtgtctcttcccctccccttccttctcctcctcctcctcacctcccctctcctccttcctctcccctcctcctcctccccctcccctcccctctgtcagcgacggcncaaccagnaggaggagacgcggtgccagctgcggctgtggcgggagagggagcggcagccccgttggtgggagcggtgcggcggccggcaaagccgctggggacctcctcctccccatcccctctcctccccctcctccccttcccctcgtcggctgcggcagcaaccggtggcctcctttcccgccggtctccgggtcgacgtcgccatcggcgggagggaggagcgtcgggcctgggccagcgacggcgcgaccaagaggaggagaaggcggtggcggccagcgaagcctccgggggccctccttctccccctcccctctcctccccttcccctcgtcggctgcggcggcatgcgagtgttggtatttcttaacgatattactagaaatagtcatttcagcaatggcgctagaaatggtccttgtatatttatggtcacagaattaatccgcaaacgcacggatataccattgtagtatttcacccggaagtatttcaaggtattgtatttttaatcccaagggaagataataacagtgaactttactaatgcactttatacatatgttacttataattgtcagagcataagcaggggttaaatataatataagggtagagtgacacaaagcaaagctatccaatcctcgtaacagaataattctaactaagtggaagaagaaatagaaagcactcaatttctatacttctagtatacactcgaatcctaacttacatctactaatgtacaattttgtggccaataccccttaacagtgtcctcctggtacttcaagagaccaccccgggttgccgagtttcttacaacaacctgtcatggctgtccaactggggctaaatacggaggagtaccctccccaggaatttgtcttagaaatatatactaacgtggaggaatatccgtactgagctgtcaccatcagcagcccacctctactgtcccgcagcatatatgcccaattaatgatacttaatagcctacattattaaatactactatatatccgcatgcccgacatatatagagtaactaataaatcagacattaaacccgcaccattacacctctctggaaggctacccacacaatcaacataatgcagatataaagaaagaccagtactcaaactaagtaaagtaccgaagttatataaagaagagtatttcattaattcggaaagtattacagaagagattacaagagctgctagagccataccgaaaactcttccgaagactccgaggacttttgaacactattctactctactccacttagcactatgttactaatactaaagtatgaagaggaattttgcttgctcgagtgtgttgtgaagtgagctcctctttttatagggccggtatgacggttatagaaacgtgaaatgtcaattttgcccttgtaaccgtcattgaggagtgatcctggacatccacgtggagggccagccggagccgacgccacctggaccggcccagcatgcctccagcctcggcaggtcactgacaggtgggttccttagacggttgtggtagttaaaagtcggtttccgacggttgcacctgacatgtgggtccatcttatccatttggttgcttaggagtgaggttttctccactttctctttattttatttgataaattcctgcaacatgttattctccaagtacaagtggaaatatattatttagaaataaacatgcattgtaagcatagctagttccccattattttagttatattgacggtcaaaatttgtcggtaacgaccgtcaacagcgaggcgtcaacagcgggtggaggtgcacgaaccgccgggatgatttttagatgtgatatgatttgttggatgattttgtgatgtaaatttgtgaatgatttcatgatgtcaatttgtggatgattttgtgatgttaatttgtggatgattttgtaacatcaatctgcgatgttattttgatattggtgcattccatctgtggtgttggaaaaaataattttgatgtttgcattcgatatgtgattgttggaactgtgaatgttggaaaaaaaactcgatctgtgattgttgatatgtgaatgttggaaaaaaacgatgaaaaaaatatgcaagcagctaaaaacaatgggaaaaaaggaaaaaaaaactctactcccggttagtaacaccaacccggattaaagatagccatctttaataccggattcggggtcccgattgcatactcgggattaaagggggttgcgaaccaggagcatagatgcattctccagcaatgatgaccacaccaacttcttccaccccgaaagatctcgtccagcgttggcttcgacatcaaatagttccactcactgctacaaaaatcggcattggtgtcggttggaaacccacaaaggtgtcagattcccagccggcacctagatgtcggcactgatatggaggagaaatagatgccagtttaggaacctgcatctttgagaatccacgaataaaaaaaaagtcggcttgacgtgagctgatgcattgagcagctctccatcatccccatcaaccaatcataatcaaaatcatcactaaaatcatccaaacacaatcacacgagcagctctccatcatccctatcaaccaaacacagtcaaaacatcactgtaatcatccaaacacaatcacaaaaatgaagaaaactgcaaacacaatcacatgccaccgtcgccgtcgtggatctagcctcgcgtcatcaagttgtcgatccggccacccccaccgtcgtggcggctagcagtagagaggaggccacacatggccatggcggagaaggacgtgccccaccgcggcagagaggaggagatccttcgggggagaggaagaggaggagagccgcacggtggggaaaccaccgccgcctcccctcccaccagatctggcggaagggagagccaccgtgaggagcctaccattcccatggggagcccaccgctgctgctacctcccctcccgccgaatatgacggaggggagggcgtcgccgccgcccgtggagtgccgctaccgctgttgccgagacagagagagagagagagagagagagagagagtccattgaggccactg

SEQ ID NO: 46331 - DNA, 11443 bp, Oryza sativa
agtcccggttggtaagatcatctttagtcccggttcaaatgctgtcagggcttgtcaggtccccccgggatctttagccccggttcataacaccaaccgggactaaagtcccacccctatatatatatatgtcttcttcctcctccagctgtccgagcaagcttcaaaatttcttcaaaaaagaggggaggtcatgccaaaatttctagtgaatttattttggtgattatatacaaatcggaggtgcctaaaaggttagcaacttcatcctccaatgtttttttttgtcatattacatttggagctatgttttgcacatttttatgtctccaaaatttagttgtaagttgatgagagagaaaatttgtgtggggaataaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgttattattgtatgactgttgaaagagtttgtaattattttataattattgtatgactgtcattattgtaagaataattatttgtgtacgatttttttttcatgtcatgtagatggattggcaatggatgtacgctgaccggcggtccaaagagtttattgacgacgtgcattatttttgagagtgaccgaagctaacaggcataaggcttttatttgttgtccatgcaataagtgtaagaatcagaaggactattctgcatccaggactattcatttccacttgtttgagttggggttcatgccaagctataattgttggacatcccacggagagcaaggtgttgaaatgcaagaagatgaagtggaagacgacaatattccggactttgctcagtacgttggatttaaaggaaatcaaacgggcgaggaggaaagggatgctgatggtaacgacgttgcggatgatcttggtcagatgttgcaggacgccaaggaggactgcgaaagtgaaaaaggggcccataaattggacaagatgttagaggaccacagaacgtcgttgtacccaggttgcgagcaggggcacaaaaagttggataccactctggagttcttgcaatggaaggcaaaaaatggtgttagtgacaaggcatttggcgatttattgaaactcgtcaagaacattcttccggagggaaacaaattgcccaagacaacgtacaaggctaagaagatagtctgccctctaggactggaagttcagaagattcacgcatgtccgaatgattgtatcctatatcgcggtgaggagtacgagaacctagaagcataccctgtttgcaaagcactacgatacaagattagacgagacgatccaggagaagttgacgggcagctaataaagaagagaattcctgctaaggtgatgtggtatttccctataataccacggctaaggcatttgttcaggaacaaggggaatgctagaatgatgtgatggcacgctgaagagcgtcaacaggacgggatgctgagacaccccgccgatggttcgcagtggcgaaacatcgacaggaaatttaaagactttggaaaggacgcacgaaacatacggtttggtttaagtacggatggcatgaatccttttggagagatgagcagcggccatagcacttggcccgttacgatgtgtatctacaacctcccccctggctatgcatgaagaggaagtacataatgatgtcgattattattcaaggccccaagcaacctggtaacgacattgatgtatacctaagaccactggtcgaagatcttaaactgttgtggaaaaaggaaggtgtccccgtgtgggacgaggacaaacaggaggagtttaacctacgagcgctgctgtttgtaaccatcaacgattggcctgcacttagcaacctttccggtcagtccaacaagaggtacaaggcttgcactcactgtatggatgaaacagaaagtacgtatcttaagcactgtaggaaggttgtgtacatgggtcatcgtcgattccttgctgcaaaccacccggtacagaagaaaggcaagcactttgaacataaggtggaccaccgtacgaagcctaaacattgcagcgggaaaacagtgtttgctatggttaaagatcttaaagtagtgttcggaaagggcctggaagccagcctatagagagcaaagatggtcacgcggcgatgtggaaaaagaacactatattttgggagttaccctattgggaattcttggacgtccaccatgcaatcgacgtgatgcacctcactaagaacctttgcgtaaaccttcttggcttcctaggtgtatatggaaagtcgaaagatacagtggaagcacgtaatgatctgaagcatatggaacaacgcggcgaccttcacctggaaccaaaggagaaaggaagccattacttgagtctagccagctacactcttagcaaggcagagaaggaaagtatgtttgaatgcttggagaaggaaagcatgtttgtatgcttgaatgcttggagagcataaaggaaagtatctgataatccacgaatatcaagcgaataataagcacgaaggagaagaagttcacaaacctaaagtctcatgactgtcacgttttgatgacacaactgctaccagttataataaggggtatccttccagacaatgtccgggcaacaataacaaagctatgtgcattcatgaacgcaatttcgcagaaggtcatcgatccggatagattagaagcccttcagaatgatgtggtgcaatgtctcatcaattttgagttgatatttccaccttcatttttcaatataatgatgcatctactttgtcaccttgtcaaagagatcagtattctcgggcctgtgtacctacacaacatgtttcctttcgagaggtacatgggcgttctgaagaagtatgttcgtaaccgtgctcgtccagaggcaagcatcgccaaggggtgtggaacagaggaggtcatcgaattttgcatagaatttattgaagaccttcgcccaattggggtacctgaatcatgccatgaagggagactacatctcatgggtaacgagacgaacaaccaacaactggccttcctggcaaggggacaatctgggtcgatcacgacattccagggatatgagatcaatgggtacacattctacacgagagcccaagacatgaagagcacgaaccaaaacagcgttgttcatatcgatgacatgggtcacgatggaacaactggcacgtattacagtgccatcgaggacatatgggaacttgactatggtcctctcaaggtccctctattccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtctagcataggaaagaagggcagaggacctgacgagccgaagcgtcacgtggttctcccaggcaaaagaaaaatcgtcggagttgaggacaagactgacgaggattacgattagttggatgggcaaccccctttcacggtgacgattgaccctagcatcctcctatcaaatgaagacaccccttactcacgtagcgatcacaaggagggaacaatagtgaggagaaagtatgtgcggtcaaccgtcaccgccgatgtattgccgtaattattgtgtacacgatgtaaactattttggatgtattgattatccatataaatcaattgttgtatggcatatgttaattacgtacaattattagaagttttaacaattttaaatcatgtaattgctagttatatgcgataattagaatttttaaaagtttaaatcatgcatgtggcatttacatatgttaattagagtttttaacaattaatttaatatcattcatatgctaattatatatgattatttgaatttttattaattttaaatcatgcatgtggcatttacatatgttaattagagtttttaacaattaatttaatatcattcatatgctaattatatatgattattagaatttttattaattttaaatcatgcatgtcgtatgtatatacatatgttaattacaatttttaacaacttaatatcattcatatgctaagtatatatgattattagaatttttattaattttaaatcatatatttgcttattacgttttatccacttaatttactacagacaacaataatttttcgaagtaattgtcattaatttttcgactttaaataattttaatgcattattttctattttagaaacacatatataatggaaattaatattcagtgtgcttatcagtagtcccggtttaaaaagaatttggaaatagctggaaaatatctttagtcccggttgatgagaacatatctttactcccggttgttctcatcaaccgggactaaagatctaggggtatatatattcccgatgtgcgccctcgtcttctccaccaacacttagaagttttttccccgatcgatctctctctcggcttctccttcgctgccactgcctagggcatccccacgccgacgctgccatcgtatctcgtcgtcgtctcgcgcgcgtcgtcgtcgccgcctccgccgccgccgcatctctggggtgagagccgccgccgcctccctctctctctccgacctcgatctctctctctctctctcccaaattaaccaccgctggccgcctcattgccgacgccgccgccgacgtcgtcgcggccgaacacgactccgccgcgacgatgatgccgaccccgacctcgatgtggccgccaccggcgacgacgtcgcgccggccgtgccgacgaagccgcgccacgacgccgggccgcgccacgccgccgcggcggcttgacgccgagacgccacgatgccgccgcggcacgccaccgccgcgccgccacgccaccgccgcacaacgccgccgccgcgccgcgcgccacgccgatgccgcgccaccacgccgccgctccaccgctccactgccgccacgtgaacgaacgaacgatcatgaacgagaacgaacgaacgaacgtgaacatgaacgtgaacgaacgaacgaacgtgaacgtgaacgtgaacgtgaacgaacgaacgaacatgaacgagaatgtgaacgaacgaaacgtacgtgaacgagaacgtgaacgaacgaacgtacgtgaacgtgaatgaacttgaacgaacgtgaacctaacgtgaacgtgaacgaacgtgaactgaacgttgtatgtgaacgtacgtaaacacatgaacgtgcatgaacgaaaagtgaacttaacaataacgcgaacattacttaacgtacgttaacatgaacgcacgtgaacgaacgaacgtaggtgaatgaaacttgaacttaacgacaacgcgaacgtgaacgatcgtgaacgaaacgtgaacttaacgagaacgcgaacgtgaaatacaatatatgttactttgcgtttatcctaatacatctttttgtatgttgcagaaaagacgttgtcgtcgtcgtccctcaagccggagtggtcgctagccctcgaaggaattcgcgcaggcaagtgatgtaaatatatgattgttagatttttaatgcaattaagactattagatttaatatacgacacttagacttagcaacataattagagttttaatacaatattatttgagttttaatataagattattatagttttaatataagattattagatttgtaattagacttagcacataagattgtgtagggttctaatatacaacagttagacttagcatatatgactatttgagttttaatataagattattagagttctaatacaagattatttgagttttaatttaagattattagatttgtaattagacttagtatataattattgtctagggtcctaatatacgacacttagacttagcatagttgactattacagttttaatacaatattatttgagttttagtataagattattatagttttaatataagattattagatttgtaattagacttagcatataagattgtgtagggttctaatatacgacagttagacttagcatatatgacttagcatatatgattgttagcatataagattgttaaagcaaaaatgacctatagacttagcaactatttcttgtatgaacagatggctgatcgtgatgaggaacagatattgtacgatacaatcgcggagggaaggagccagtactggagcgaagaagaggggaatgaggatccaaaccagtacttgaacaaggaagggaacgtggagagggatgcggaggggaaccaggaggggaacgtggtgaaggatgtggaggggaaccaggaagaggaggctagtggaaatcaaccctccgctggacagaagagggcacgcgggcaacaaggtgccgcgaagaagctagagggtcggcacatcataacggaagtggacgaagacggctgacctagtgccccggcggaagcagccaagaactacgtacgacacagcggttgggttgtgtgggataacgtgcctgtcagtacggtgtactggcgcagaacaagggcacgcggagatcatgagagctttgtcccagattcggagaaagagatgctgtggaccacaatgctcgagacattcacccttcccgcgggtacagaggacaaagtgaaaaggtggactctaaagaaaatggcagaacagtttctgagcttcaagggagatctgtaccagaaatatatcctgaaggggcagacaccgaactttgacacattcccaaagctaagggatcactgggacgagttcgttgcatataagacatgtcaacaagggcaggtgatgatggaaagaaacaaagaaaatgccgccaagaagaagtaccatcaccacttggggtcaggcagctatagcgtcgcgatgccgaagtgggaggagatggaggcaagcttgcttgagaggggtatcgaaccggccaccgctaaatggctggatcgatcgaagttctggtactatgctcacggtggaacgctcaacccagttgatggctccctggtcttcagcgatcagatacgcgaggctacgcatcgactaacagacgcagtggaagcctcttctcagggcacgttccgacccgacagagagaaggacgagctgtcacttgccctgcagactccagagcatctaggacgaacacgagggaaaggggtgattccttggaagattggactcaaggaggacatccacacgtacaggagtcggatgaggagcaagagagataccagggcgaagattgcagatcttgagtacagggtaccgaactacgagctcagcatgtaagaggaggtggcaaggaaggttgatgaacgcatggccgcacatcgatcccatgatccccagccgaccattcctcctgcaatagtgagcccttcaggaaatcgtaacagctgcacctcaacggggcagataggatcacagagcatggacgccatgcaaacccaggacaaaaccacctgccccgttgatgacatcactcagcggacaccatgtgagctgcatattcccttcaggaacttatcaataaaggtaagctcgtagtttatagattttagatttgtccattccgcaagttgctccttatatatgttaattactaataaataacctctcaccacgtgaaggtggcgtcaggcatggccatcccaacgaacccttcaggtacttaccactgcaggccgattccagcaggatactccaaggtcgaagttgagttggtcgaaggcgcgtacgaggacctcgagttggattaccctggaggagacggtgagacgcatctacgagacacaagccacgccattatactatggcgcaagcgggacatcatcctccctgggcgacaagctgtgtctcgtgcaccatctcctccggctccgccatctcctccttaggctcctgcaccgtctcctcctcaggctcctgcaccgactcctcctcaggctcctataccgactcctccgcaagctccttatccagcacctttcaagtcaagggccccccaagctccaccgcctgcccccacaagggcaacgaagaaggcaaaaattgacgccgccaagaacaaggacccggggtacgattgcacgcaagaggagcttgacgcttatgtggcatcaaaagtcaggagacaattgaagcctcgaagtccaaaaaagaagattcctatagacccgagtgtcaggaacttcttcaggggtatgtctgcacctgccaaggaggccataaagctatcggactatgagcgaacactcaagaaagcatcttctgaaaagtccaaaccagtccctcagcttggagagcaaccaaaccaggagatcgagccgttggtgaccggtgaagattttggaatagaagaatttattactgacaccgggctaactacagatcaattactacgaggcgcaccaatcgaaaagacgaaagtgaaatacatgtacgaactcagtaaaccgcttgtcaagcctgagcagctgcagtccctacccacacaaatgtacaagttccatcaactgtacatggagatgagcgccaccggtagagagatgatcggagcgaggatcagggacacggacttcttgcaaggagatgacattctctggatcaatttcaagggtatctacgaactataccagctagacgctctcgacatctctattatgagttgctggattttgtaagtatcgttcagttagatttcttattacgtttcctttaattaattaggtccttgtatataagtagactatatataatatatacttccttttatcattgtagaatggagattcaaagggcccgacggcgggggttttcgatactggattcatcgaccctcagaaagtaaacgtcgcaatgctcgaccagtatccacaagccacagaggacaatctcgtccatctcctgaaggcgcagcattacaagacgtttatactattgctgtacaacacaaagttagtttaattttactgtcttcctataccaaatttcattcccgtacgaacatgctaagtgtttcatatgtaatgcatcccacgcacattgcagattccacttggtccttttactcttcgacctggaggcctgcaccgtcaacgtatatgactcaatggataaaaaagaatctacgtttgacaaggttttcgaacttatagacaggtactgtcataagttcctatgttaattaagaatcttgttataattaattgctactacgaatcatagctttaaactccatgtagggctttgtatcggttccgtcatttggtccgcggcaaatggagagaaagacttacgcggaagttcaattttcctgtgagtacacatgctctacattgaatctcccattcaaatgcatacaagtgtatattaattagatctctcgccatttatcatttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattgcgtacatatcgatttgttgtttaattactaattaatttcatacattcatatagtttattcgcatgagagataacctgatcacacacaaggaatttattgcggcggttcaagaacaactcatgggattcatcaacgaacaaatccttgatcccaagggtgaattctactacgacggaaatacaattcatatgtccttagcttctgagataacgactactactacgtcgaaatcgtagctagctaggacatcataatggattgtaattaatacatgtctatttttctatatgcatgtacacattttctttaatgtaaatatatatatatatatatatatatatatatatatatataaaccatgcaacaacagggccatgaaaaaaaaaaggttagctcgttctttagtcccggttggtaacggctcagccatggctgagccatctttaatctcggttggtgttacctcgatctttagtcccggttatttcacccgggactaaagatagtcccggattggtaatcccggtttgaaaaccgggactaaaggggggttacgaatcgggactacaaacgcgttcttcacccgtgagtgtcaatctcaatgtgttttttttgtagtagtgacttccccaatccactggacgtgatgaatttaacccgcccccttgatccacggaagaggcacaatgcgggaggtgataggtgttggcgacgggtgtcaacgtttgcaactgcaggtgccactccgtacgctcggcctaaaataagggcaaaattacagttttttcttttgatgttcatattacgttctctcacatttctactactattaattatgatggtacaatataaattcatccaatctcttggatgtaaagatattaatatgtgttagatttatctctactacgggccgcaaagaggcataaggaaataaactgctaggagaatgcagggtatcgaacaaagcttgaacagaggtggcaatttaactggcaatgtgggcgcgcggagtcatggaccttcttcccaccgatccttacccttaacttgagcttgtcggtgaagctgaatcggttactaaaccaaactaattattaaactctgctgatgagtctcacggccttttccagtttctctatgcagctgaccaacaaatagtggtgtggcttcgaccatctgaggatcagatcgatgtgccgctttttctacagaacacaggaccatctcaatatgtctcatcgcatcgaatgtcctatttggcgaatgacatgcaatgcatgttaatttcctgctaattctaccgttcgcgtgtatatcgatcgagccctgaagagagattaatttaagcgatgattatccgatcgagaccagtcgttgccaacgaactcctgctcaccaagtacatacgatcgagcgagtatatatatacgtacattcatacggccttgacggctggggcccacaccaatcaacgccgaaaaatacaccccgttctacgtacacgccggaacatgcagatgtatatacataccggccaaaatgtgatgcaaatacaataaagtaattaatagtcgagacgtcgacgcatgcatgcacgttgcagagctcggaattaaacataacatggcctgtcaattcttaatctctcgatcactgaata

SEQ ID NO: 46332 - DNA, 1936 bp, Oryza sativa
actgttttgtcctaaattagctagaaatataatttttatgggacggagggagtaagaaaaagaacatatataattactcgtaaatacgattatctatatagagtcagagaattcgaaccaaataagctacatgagtaggtttctactcgcaaatatacatgtccaactaaagaaacctaatcaagtgagctacgcttaaccctcacgacgacgacaattttcatgttctccgagctttgaaagaaaaagggtttgaaaaagaacacaccaagttgctagtttaaggagctttcaggcaatttaagcctaacactttccatggcatgtgctgacaacgagctgaggcgagaggccccctgatttggatgaagactcatccatcaacttaatttttctaatccctttatagctgaaatgttggacttggcctgaactagtccatacacacacacagtgcgcacatatttctgcatgttatactagctgacctgacagcctaatatactgtacctaattttgcttttgtgtttgggtctaattaattaaagtggagcccttttcagagggggggtttggatgcatctccaggagtagtcatcgtctttagctatttggatccacttctacttggaataataacacaataccacattgtgtgtgaatttgtctgctctcatgcatttgaggccactaggcatgtgggatgttgtccatctttgcgtgtcctcgagttcacatatttatttgggtattaattcatttgcaatatgaggctctgggtcctatcaatgtatgtgtacgtatgggcattgctcctgccgtacagtcccagactttggctgtctttgcagcttaattcaatttatttttggatacgtcgaccacaagcaaattaaatcatatgtcatcatatacaagcatgcacggttaatttgtgatcagtagctatatatacaattaagtagtgatgaagaatggctggtcaatttcttgacgatggcttgtttgaaccggataaattagaagcaaattgttcgtaaattggtgctgatttcagtccagtttctccgacgacgacgacccgaatcaagtggaactaatgtatcccccacttgagcgaattcaaccaaaacaaaacagagaattacgtacgctgctgcatttctgttcttctgacttttggggggaggaagaagaggaggaattagcggctaaactaatcatggtactaacatggccggcacatgtgcttttgtggccacactagctatacaaaagttattcccactttcatttgacaccgacactggtagtatcctcattcttccccttgttgcaggcccaaatgatgagcacgaaattactgccagtgattgacaaactctgctttcaattattggagtacctgcatcttgcctctctgctggacaaacattgtaggagtacgctacagcaagtgaaatatgatactgctctgaattaatctattagaagtttagtactatataccttcgtttaaaaaggaaaaaaaaacttcatttatgataatgaatttgaacaaagcactactttggtttaattgattagttcaaaataagagtttatgtaagtgcaaacatgtatactcactgtaacagatagcaggtagtagtagtgtcaagtacactaatcaattaacccaaagtacattccggtaagtaactgctacagctaccacttttggcaaagatctgatcacaaggctcacaagcaacctcagcagttacacctcctagctagcccctatggttggttggttggcaaagttgcttgtactagttgctactctatctctctctctcacacacacacaaacaagaaacaactacagtacaagccctataccaaaagcaagattggctctaggctctagtctagccacaatgcacttgccaag

SEQ ID NO: 46333 - DNA, 12793 bp, Oryza sativa
actttatatctaaactcggccatagtatctcgatactgaggccatgtttagttccaaagttttttttccaaactttcaactttccatcacatcaaacctttcatacatatacaacttttctatcacatcataccaatttcaaccaaacttccaaacctcggtgtgaagtaaacacagcctgactacgggtgtatttagttcatgtcaaaattgaaagtttggttaaaattggaatgatgtgacaaaaaagttagaagtttgtatgtgtaggaaagttttgatgtgatggaaaagttagaagtttaaaaaaaaatttggaactaaactcggcctaccttctggtggtaggggctgcagctgcaccatcttggttgctagcatctctcttattaactcctatcaactgatccaccctcactgatcactcttgtagagtcttggtgtacatttactcctactgcactgcactaccaaactctccttcggccctcacctcacaccttctgttactgttagtgggccccacatttgcaaccttctctctctaccactctcttgcgcaactcctcctctatcgatctccttcctatatatacatgctcacttggacacaacacattccatctcccaaagcagcagcagcagcagcagcagcaggccagcagctagcattatcagagagagagagcaaagtgtgctctcttcttcctcttctctgctactaatcaaagctagccagctagagacatctatagcttgggagaaagaagaaagctgagagctctttcttgctagctagctagcaatggcggcttctgctgctgctccggccaccgtggcggggctgctggtggcggtggcggcgataatggcggcgtcgccggccggcgcgcagccttcgccggggtactacccgagctcggtgcacagggcaatggccttctctcgtgactacaccaacaagtggggcccgcagcaccagaccctctccgccgaccagtcctccctcaccatctggctcgacaaaacctgcggtaatttgtttcattagataactaattaattatattagcagctaattatttgggtttagttttaattaatggtagtaatgttctcgtcggaggaagagaaaaattctttaatatactttgtcgtgtcacagcgacaacagtcgccgggcaatccatgtgggtcatttgacgtgcccagacttgtgttttttttttgtttttttggtgacagttacaacactggcgtaatgttaatgtgggtttttgtttgtgccttctgaaactctgaaaaaggagggggaagcacacatggttttctctgtcctttttactgtttccagtcgtgtgtggtccacgtcagaaaattaaacagaactcttaacaatatctcgtgtttgtatatcctaatctttatctaaatgtggtagcttataaattaattaaccaagttcaccttttagtttacgtgaaagaagaaatgggtaatttgttggttaatcctgccgctaattgtgatggtaattgatgcacagggagcgggttcaagtcaaggaagtcgtacaggaatggctacttcgccgctcgcgttaagctccccgccggctacaccgccggcaccaacaccgccttctacgtaagcttagcatatttcatcaaatcagcctcaaatttcgacccaatttcaaacgaacaacgggtgaattcaagcttaatttgaacactattgcagctgtcgaacaacgaggcgcacccggggttccacgacgagatcgacatggagttcctgggcaccatccccggcgagccctacaccctccagaccaacgtctacgtccgcggctccggcgacggccgcatcgtcggccgcgagatgcgcttccacctctggttcgaccccaccgccgacttccaccactacgccatcctctggaaccccgacgccatcacgtaaaacccgatcacaaatacttgtcagttttgactattaaacgttcgtcgctgacgtaaattgattggttcgggtacaggtttttcgtggacgacgtgccgatcaggaggtacgagaggaagagcgagctgacgttcccggaccggccgatgtgggtgtacggctccatctgggacgcgtcggactgggccaccgacgacggccgccaccgcgccgactaccgctaccagccgttcgtcgcgcgcttcgaccgcttcaccgtcgccgggtgcgccccgtcggcccccgcctcgtgccgccccgtcccggcctcccccgccggcgccggcctcacgccgcgccagtacgccgccatgcggtgggcccagcagagccacatggtgtactactactgccaggactaccgccgcgaccactccctcacgcccgaatgctgagctacttttttttttttacactcgcttattttgatttataagtggattcacgagtgccgttgccgtgctgattcgtgtgtgttgtgttcttgtttggattttgggaaaggtaatgtgggtgtgtgtgggccgctgccctaccgctgctgccgcctgtgaggccggtggttgaggcgttggttggtcgttcgtttcgttgttttggcatgtttttgccaaaagggcactcgtcgtttgctatttttttcctctttcttttggcttgtgtttgtccgttttcatttcacatgcttgcgtgccccaaaggggcaggattaaaggtgaaggtgcatgatccgtgatattctcatgcctgcttgctgtaaacacaggatatatatatatatatttgtaatattgatacgtctcgtgtcggtaatgatatttatgaaccactggaattaatgtggttggtttgtgtaacatttgtttttattctctctctccaaacattgatatatatccattttcgtcaattcagtttaaatagaagatctagttacttgtgttccaaggttgtgtaccatatttccctgtctgaattttgatgcatacgcgtcgggtgactagaactttcgtactactaattaattatcgatcaactagtaacatttttcaaaacatcatttgattgatcctggatttttggatgactcagtccgatggccagacacctttcttcaacctctcttttttctccatttgctctatcttcttatctaccatcaattgagctttatactaaccctgtacgtttcacttacctattgtctcctcaaccactactgattctttcctcgatgatggcaagcaccaaagaagttagggcattggggtgttgcagctaaagtacatatacatggaggccttgagcagtcggtaaactagtggcggtcagcgatgaagacgatacaatgtggagaggtgaggtggtgccaccggagctatgagtaaagaggaccggatgtaggcggtgttggcggcatatgaaattcaaagcaacttaaggagtatatattaggccatgttcttttctccaacaaaaactggataaaattttggatactcgtgacacgcttttcaaactgctaaacagtatgtttcgtgcagaagctttctatatgaaagttgctctcaaaaatcacattaatctattttttaagtatgtaataatttaaactcaatcaatcatacattaataccacatcgttttgcgtaaaacatttaatcttcatcttcagaaaaaaaaagaccaccttagtacgagatgggtaattgagcacgtgagagtagctctagtgcgaatctaaaaccaatttcaacgctaaaaatccgaacagtacaatctattttaataccctagggatcgaataaccaaatttttattcggcttttatagaccgaacttgccgaacgaacactagagctgatctaaaaatagatagatgcagagaaaacctacctatcaattgaatgcacgtccaactgccgctatgacacatggacaacctcattgaagcaacattgatgttgctatagctagatttgcggaattttctgttctaaaaccctatttgcataatattctattgatttatcgctgcaaataggaaaatttgaaaagaaataaaaaagaggttgcattgatatcgaggggaccaggatacatgggaagaaaggtgcacaagcgaaaacatttgttgaccatttccagtggcggtgccacttgctacagtacaggcgcaggccctcatgtgtggacccgggcacgatgcttccgtgatacactcaagatgctgtgacaacagtagcatcggtattattgtttcttctcccttttcgtgaagcaaacagctgcgacagtaataactagtctagggttgtgtttagttcagcgtaaagtttagattttgattaaaattagatatgatgtgactaaaaagttgtgtgtatgataggttgatgtgatggaaaagtactgaagtttggatctaaactttagatataaacacagcctagatgaatatgatcgattttggttggtataacccatgtcacgcaccttgtgcttttgggtgtacatatatatacatgcattggctatggtgttttgtctggtacacatgtgcagtagtcgtggcatgtactgtaggtgtctgtactagcttagggagtgtttagaatcatgggtataaagtttcggcgtgtcatatcagatatatagacatatatttaaagtattaaacgtagactaaaaataaaacaaattatagatttcacctgtaaactgcgagacgaatttattaagcctaattaatctatcattagcaaatgtttactgtagcaccatattgtcaaatcatggagcaattaggtttaaaatattcgtctcgcaatttacatacaatatgtgtaattagttatttttttatatttaatacttcatgcatatgttcaaatattcgatgtgacaagacgaaaaatcttgacgggatctaaatacaccttagtaggaaaacactgttctcacgggtactgttttcttctgtggtactccaacgagcaattattgtccgttcatcgtcgattggacgggtgtgatttacgcaaagctagtatatatggtgcgtagttctttgagtttgctcaatggagtttgatcaatctaagtcagaccatgtatggtttttcttgttttggggacgaaatgcaagcctagggagatggcgaaattcgtaaaaattgattgattttgttcaaaattcgacaaatcctgagcagtttgggtgacgaaatcagacatcgttttggtaggtatcgttttcttctactctataatattattacttacacagttcgggaaagtaaaatccccgatccaccgcccaaaacaaaatatcatacataacaataccctaaccctttatccttttagaaggtaagggtaaacggactatcaaaacaaccttgcgaatgaaacagtacaacagtaatggatgtttcttagggtgatcactactagagaaacaatttttctgaatgagaaccctataggtggaccataattgttgccgcctgcaaaaatcgttttccaggggagtgtttcacgagccacatgtgaaatacattttcatatgcaactccttaagaagtccgcttatgcaaatagacttattttttcagatgagcattttaaatgaataaatggaaaaaatgtattttagaaatctaacttacctcctatttttctagtcgacacttcaaattttttcaagtcatcatccttatatcctcaccttctctctcgcatcctctcctgtatatattatctcccactcctctctctccctcgagttcccctctcaagcgacggcggcaggtggctagctagtggtcggtagcaagaggtggggtggcttagtgacctcgtgtcgtagattggattggtctggcagtttttgagacggggagttgactcagatattaagagttttttctttttcaaggattatcctttctcatctatctcgaaacaaaatacccttaaaatgaggcttttcctaatcttacctaatctgttcctccaaccaaacacgtgtcagagtttcgaaaaagatacatgcatggtttggtatacagcatattgggccttggtaagggacagtggcatactcgtgtacatggctgggccttcagtgaagcaggccgtacgtgcgcgtcaacggcggcggccgccgagaccttcggaattgccctctcgggtggcgccaaattggaggtcgcaggatcgcagcctcgcaggtgataaaatcaccagccactagcgcccgcacgtacgtgtcgcgaactcgcgccacggccgcgccgctcgccgccgtcgagcgacaggcgtccacccctcacgcctgcatggctgccacttcgcctcctcctgcatcttccaacgttgatataaagaccagtgtcataccacgccaagattctcgatctctcccaccaccatggctgctgcacctgcacggctcgtcgtccttgtcctcgtggcggtcgtcgtcgtcgtcggcggcgacggcgacgccggcgtcatccggcaggtgacggacggcgggtactggccgccggggctgctcccggaggcccagttcgcggcgttcgtgcggcggcacgggcgggagtactccgggccggaggagtacgcgcggcggctgcgcgtgttcgccgccaacctcgcccgcgccgcggcgcaccaggcgctcgacccgaccgcgcgccacggcgtcaccccgttctccgacctcacccgggaggagttcgaggcgcgcttgacgggcctcgccgccgacgttggcgacgacgtccggaggcggccgatgccgtccgccgcgccggccacggaggaggaggtgtccggcctccccgccagcttcgactggcgtgacaggggcgccgtgaccgacgtcaagatgcagggcgcgtgcggctcctgctgggccttcagcaccaccggcgccgtcgagggcgccaacttcctcgccaccggcaacctcctcgacctcagcgagcagcagctcgtcgactgcgaccacacggtacatcacaaatcacatcacacgcacacgcaacactcctaatctcatctctgaactaatcgagatatggctcgtgatcgttgaagtgcgacgcggagaagaagacggagtgcgacagcgggtgcggcggcgggctgatgacgaacgcctacgcctacctgatgagctcgggggggctgatggagcagagcgcgtacccatacacgggcgcgcaggggacgtgccggttcgacgccaaccgggtcgccgtccgcgtcgccaacttcaccgtcgtcgcgccgccgggcggcaacgacggcgacggcgacgcgcagatgcgggcggcgctggtgcggcacggcccgctagccgtgggtctgaacgcggcgtacatgcagacgtacgtgggcggggtgtcgtgcccgctggtgtgcccgcgcgcgtgggtgaaccacggcgtgctcctcgtcggctacggcgagcgtgggttcgcggcgctgcggctgggccaccgcccctactggatcatcaagaactcgtgggggaaggcgtggggggagcagggctactaccggctctgccgcggccgcaacgtctgcggcgtcgacaccatggtctccgccgtcgctgtcgccccgccgccgccgtgatcgattgatcgatatcgatcggccgccggcgatctcacgttaccgatgtgttatgtgaagtacggagtactactgtatactggatgtgcttgattaaagctttgcttggttagcggtgggagacgtggcggtagtaggtgcttagtactacgttttacaaatggttttacatagttgggttgtatgtcgatctactactagtgaatacagaataacaaaaagttatggacgtgtacattaagctagggtatattgaagtcatcttcaagggctttattattaaaccaacgcccaattgtgttgtgtatcaactatcaagcactcatcgagttcacaatagattttaaacatagctacccctgcaaaaaaaaaaaacattgtaacacaacacactagttcacagagcatttttaatgttctggattgggacccatttagattgcagatcgttgggaaaaatcgttctctcatttttaggcatttttaggtgttctcccatttttaggtgcggtcccatttttaggcatttttaggtgtcctcccatttttaggcatttttaggtgcggacctaggcccgcaggagaaaatcaagagaaaatcaatttttacatgtgagccggttaagatccacacacaaaaataattaaaatttttttaattatttttgtgtgcggatatttaagagacccgcaggcgaaaaaataaattattttttacccgcgggcctcttaatcgtccacacgtaaaaataagctatttttgcgtgcggacccttaagaggtccacatgcgaaaattgattttcccatgcggacatcttaagaccaccgtgcgaaaattgattttcccatgcggacatcttaagaccaccgcacggaaaataccctccctcttttcccctctcaacacttcaaaaaaattccatcctcgtccttatcctcacctccacctccctccctcctttcttctcctctcacaggcgcgactcggcatcccgcgagcgacggtgggaggagcggggcctcgaccgccctgctgccgtcgccgccgccgacgaggtggccgggatccgatagcgcgacgcctctccgctgttcagatccgacggcagcccccctctgccgccctccgtagcccggatccggcagcgccgcccctcttccgccctcccccacgcgacggcggcggcgacgacgaggaggtggccgggatccggcagcgcggcgtctctcggccgcccgtatccggcggcggcgcggcgcctctccgctgctcggatttttatttttgtgtgtgggcaacataaccaccccggacgctaaaatgtgattttcgtgtgcgggtacaaaaattacgatttttctagaccccttagtgtatttaaattacgattttcctagaccccttagtgcatttagagattcatttgtaaaaaagtttttattctgagaagaacattcaaatattggattgaaatttcatgatttcgagcggaaagtttatgaatcttttgaatttatttggaatttcatatgtacaaagttccttcgcaaaagtttctacatttgaaaatttacgtggataaagtttctgcgtgtttttgtgcacaaagcttctacattcacaaaattacatagatcgataaagtttttgcactagaaatttattattactccgaatccgatattcgcgtgcacgtgttcacgcgtgaggattctcggacagttcgggacccacacagccacactccaaaccgcacaggcccagtttgggcccaaaagaacaatcccttccttgagacgtcaccgaactttgggctctatgggcctaacgagctccactgggcccaaatcacaaatgggcccatttcctcccactccataatttttttcatttttaaatttttattttttaatatttacataaatattataacatctaaaatatttacagaaatgacccctgccgcctatgtggagttttgccgccctctgcaagggctgtaagggggcaaatgcaattatcgtcctgccaaaaatacatttttatagtttttcttttcatcttgttcgtccctcatgccaggtctacttctgtaaaatattttcgtcgtaacaatatttctttctgtaaatattaaaaaaaattaaaaatgaaaaaattccccactctagggaacgccgagactgagaacgccccctttcctttccccctcctctcgttggaggcggccggggaagctggtgggcatatggagtgcgcggcgaaggggctggtggcggagccgtgtgccggcgaggcccgccggcgctgcggcggttgcggcgccgtcgcctactgctcgcgcgcccaccaggtagcgcccggtgaaaactttctaccttttctgcccccccgttaaatccgtccagctgttgccgttctagggagggtttcgaatggcgggcgtatgcgtatgcctcgaccaaatctgtgtttcgtaagtaaggatttctgttgggatttcctggaatcccggtaggtgagagtatcctaacgttgtgggtgaagctttgagtttaatctgaaaattttaaggaggagttatttgtattttacatatattttctttgcaactgtgtagctatgtgtaactttgaaacctacaatttgcagactgtgcattggggatttcataaagaagaatgcgcaaggctcgcagagcagatgagccgcatcgatatgctgaaacaatttccattcacgttctctgtggaatctcctgctccggtacttgactcattgtgatctccatttttttttttgcatctgaagttctctccgtgcatctaaagttatttttccccctctgtcataaaattgtttctacctatgcttcctgaaatgatttggttaccccttgtgaaccttgttttgtcccttagtagtattatgtagctctctctcacacttactgttcttacagaatcatacattccctagtctaagatgtttccttttggaatcattcaaacttcaccaaaaaggactctggaaatcagaatgcatatgtgatccagaggttacttcagtcaaggacttaaggtttgcttttgccctgagatctcatgatcccagctaccagccaactcgttaattctataacactagtatatttgctcgtgcgttgtaacagatctcaaataaatatgccataagttctaggcttacacaaatgcataatagttacccccacttttaaagcattcgcatcagattgacctatgaccatatatttgtatgctctaagaactcaaacctctggaaaactatacggttaatgatatcaatgtcttgttgtgtattatacaaactaccaggctttatgtcctttaatttttacctaattttagtctcagctaattttacttttatgctctttctgcatattatacagcaaaacaactgactggagtatgggaagcgccctctgcccatgcacaggtggatatctcattgtaatgaggtggttggcactattttcatttcatggctcctaaaagcatttgattttgtgtacagagcctgaacataatgtatccacacccctgacaagctggaaagactactataggtggagatcgcttcctttgcaatcacctgttgctgttttacttcactgggtatgcacaccacaccaagttttgagaaatattttgttgtacgatcgtagatatacgattctcttgtttgtttttgacgaaaatatgattctcttgtcaatccagaccaaaggttcgaattcatttagacaggtgcaccaagaaataatcgtgttacttatgctatggaaggacagaatgaaaacaagatgcaagcttgtattgtcagtatcaataaaaaagagaatgataatttgttcattatctactttgggtgatgcggtcattggtttttataatttgacatacttcaaatttactgattgatttcattattttgcaaatacatccaagcatgctgtgcttgtgcttgctatattgcctatatatgcaatcttctgcttaaaaaaaaacagttggctactacacttcctgtacgtgggatgttttccttaaaatatttaattgaagcaaatgtcagcttggcagaatttgcgttattaaaaatatggtgatgtttcctatcatgtcttcagtcttatatctacattactagctatttctttgaaaacttcggcaaagaaccagtttactgaagcattctttccagtttacattcctggtcctcttttgttgagaaaatcgccttgatttcctttgtagattcctcttgaccatgtctcttaatatgctgtatactgcatttatagctcatatcatacatgttgaggttatgaatgtgtattgtgcattactgattattttgaaaggagcatcactttttttactaatatctgtttacaccaatgactagtatatttatcgcacttccaattttgcagccacttactttatatcattgcgttcaactatcgcacctccaaacctcaaaatatgatggccaagacactctatgtattcactatttaggtaaagtatattgtgcaactctcttctctgttgaagtacttatatacatatgtaggaatccttttctagtcagtcggtcatttgctgccatcatggttttgggctgaactatttttcgagttttaagattattattatatgccacaactattgagggcaattaactttctggcaaaattcttgtaagtgttatgtcacttgaacgcgcatttcacacaaagtaaagccgcttgtttgtgcccactgaatactactggacacaagccagttcttggatttgctcgatgcaattgtgtctaattgcctatacatagttttggctggcacaatgctcagggtcattatcagtaaatgtatgagcacagatatcaatcattgactagtaaacagtctggtgtgcactgtgcagttcaggacactagtcttgtctatctgcactcatgtatttgttgttagaatgcttcctgttgagcttccttagtctgttattatggagatcacatgaagcattgatagctctaggtactgtcacatgagaggttttgtcttccattgttatagaacaa

SEQ ID NO: 46334 - DNA, 14509 bp, Oryza sativa
agagctgcttttgtaaatcttccattggctccaaagatttaagttgcagtgcagtgacattcaaactacgaaaagggctgtatcatgagagatatagtgatattgtgaaggttctatgcacagtaactctttacttatttataatgtgaagctacccatcatatgtgtatcaagcctttttttatttgaatgtgaagtgttttttataatgtgaaactataaactttcctacttgctacatgcaatctgtcattttgtaatacccaattccgtgtgacaagggtatttgcgtgtattccctctcacaaatccaactaactaggtttagagctactaggcttcttaatattacttgatcatgtcatttgtagcttgaatttcttaatcttctgttcagtgttttcggaaatacttactggaatgttagttgttatgtactagaagtttcattgatgccatatatgatgcactaaatcacaaagagaaattggcatttaattctattggcatgtgtattgtggtcagggaatactagaagctttgacttttgtactgaatatatataattagcccaccaagccaattcatttgggaattaatgatcgagttattttcattcaggattgactttctctgctaatactttgtttcttggtaggattcaaagcctcatctcattgttgccccaaatgctggtatagctgcatatcctagttggattccaactattgtaagtataaatgttcttgattagcaacctcctcccattttggatatgagcatgattggctatgaatttccttgtgatactaccactcttaacttcacaaagttgacattgttccagctagtttcatgctaaagcatacatctggaacttaaagtgtattcttcacaaatcgcaaatcatccctttatctcagttgatgatattcaagtaaaaatcgatgcgtttaattggtcatcttttcttctctaacccagacaattttcaacagacatgttatctatggaagaaagtgttagcattatattgtcctcatgtgaacttaaattaaaaatacaccacactatgacagctttaactgatgattgccagtataacacagtatactctatgtcttagcttgtaacagacttccattttttgtgctcattctattcaattttcatttgaaggaaataattaggaaagttgggattcctgcaattttcacggacttctgtgaagaagctgcacatctagcttcgtcctgcattacctccataactggtcaacccctcagagtcccagtatgtgttctgtttttccatcgtttcctttctgattgtagttatggagtatcaaactaataccatcatcatctatcatctcctctctcagattcaggtaaatcctttcaggcaaccggttgcagtggataatagtgcactatgcttaccatgctactccaactgctttgtttttgggatgcagaattgcaagtttgtatcaccatgaaatgttcagagattcaactcttaacaaataatatcactaactttttcaaagaaggcaaggataccatgaaatattttcatggacgaaattgccacctgtttttattatttagtctttcagaatagatgccttggttacttgtaagaatgtaagatgcactcatcagctcatgcttgtaaatacagttgtcgtataattgtagacctgtagtaacttgtaagatactacatatataataccctaaagttgcagaaagacttgctagtaggtagtagcaatcccatgctggacatggtgaaatatggatcagttatcaacagcttttgtgccaaggtactaatgaggtagtgccgaagaagcttgttggagacaaactttctgcaatagtaccattcatatggtgagttttctgcttttcatctaattcagtacctttagttatctaaatgtccctatcactgcatttcattttaaaactgacgctttcaaatttcttgtggatgagaagtttagatctaactttgattcataaatagaatgaccagcgttaacattttttttgtctatgagaatcatttcttgctattcttgttccaaattttggaaatattcccaatataaagtaaggttcttatggttttaatgataaaacggttaagttttttggtctcatcttgcaaacttttcttctcatccacataaaatctgcatatatgatgaagcagtcataaatccaattacacacactgcctcatataaaaaaactagcattgcacacgccactgcagtgaacacactgttgcatatccaaaactaaaattccacacgccactgcagtgaagtaaggagtccaatcacagagaatcctatattacaaaaggataaactcattttctatgttagttcatcatgttcagtactgttgaggagaaagcttgctgaactcctgcttctgcattctgatgttatgccctttcctggcattcccatctgcaatgagaacatcatctatccatgagacaatattgtaggctaaactttccagcaccctcgagtagctttcaagtattgcctgcccaatgtcctgtagcaaagtaaaatggagacacgccagcattagcaatgatgaacattctttgatccaaaggagatggctcaatcagttatttcgtatatgtttgtatgtttataccatgtatgatagttctaaatattttgtattagcattcagtatacttctgtctcttaaattgtagaataaacacacagtacacttttatgtttttgcttccaacattaatcatatctggtgtaaggaaaatacagatgaactctgagataatctgaaatttgggtatttcttatgtataagcattaccttgttgtactgaatcttgcttgtgtccagggtagtctgtgacaagcctggaaacctctgcttcaagcacaacaacaaactcctagccctacttgcaaggatcagattcttgtccccatcagcattcagctcagtaacattttcccattttgacaccacatgggtcatgcttgcttttctccgccatacgtacatcgcagcctcaacacggtctgcaatctcaagtgcctcatgttctgagctcaagttgaggaagttgaggaggtggtctggtgagaactgatcccctgcagacatgtaccggtatatggcatcacccacgccaaccttcccactctgttgagtagcagaaatgcatttatcagggggaaatgataatttcagtaatcaggaccatagaaagacccagatcaagcagtttctctgtacctttggcagtgtttctatgtatgacagtggaacctgcatttcagagaggatgccgctgttgatctccatggccatcttgtggatttggcttgcttggtccctcttttgttgcagctcacggtgcatccgatcagacaggcctgactctgggacacatggttcagggagccaccacttgtcctcgctgcgctgaaacttcatgctgtcactgaaggactgctttctctgatctatgtaccagaaatctgtcttctcaaagctatccaatatttcctgcaaaaatggtgtgcaattattggtcatacattgtactacaaaagttgttcgaaaggagccttccggaattccgcaaatcgggactttaccaggagcatagtttccagtttttcaagtgctggaaggttcattagtatgtctgatcttggtgaggttgccatcacctgtagaaaacagaaatttgtgcctaagtagacatgccatgaagatgaaacttatcagagtgtgagacgtgatattcttgcaatggaattacatcatgagtgcttccatctggcatggcctggacttttggtgagaattcaacaatgtattcgcagatggagaggaggcagtccatctccctgttccacatcgccttcttctcaggaggcagtggctgcaacctgtggcaggttccaaacacagttgctgcagccaagaacaagcacagaggtcaacccactgttgcctgcatcaaagaccaacttaacagaagattcatctgcaattctcagaactaccatatagattggtgatggcattggagatggccacagccgtgcagacacccttcccactcccagacatgtcctctccaagaagcagcttggtgtacttctccttcatcagctccatctctgaacaacacccatcaatcaaccaccagaaacaccagaggacactaccagaaatcaaaacaggttggcatatctataccttcatcctccagggacttctcgttcacaacttgctgcagcttcttcatgctgagcttgctcaccgatggcgagaggcgtggtgccgtggacgtcgtgcggctcatgcttctccctcgtggcggcgatggcgtatagtgctcctgctcctcgccaccgccattgtcggagaacgacgacacacggaacagcggtcgcgcgtagtcgcgatcgtagccgtgtttgtggaagccagggaagcctgaacctccactcatggttgcagctgttcttgctgcctgcttctgaagacctgcaagaaagacgatgaatgggaatggcacaagaatggaggcatgccaagaacagagaggataggtacctggtgttattgacttgctttcccttttttggtgatcatgtcatggctgtcacttacaagtgtatggaacaataataaaggcataggggctatctttccttgacatgggctgttgcaatcaatatggtttgcaattatgcaggcatgtgagcgatttgcccccacagtgtaggacaataaggttggattggttggatgtcttgcaggtttggtgaatgtgttaactgtcaggaaggtacaaaattttggcacttggtgctgtcacattgtacccagattttgactcacattttcggtgaccatctatttcttcaatttaagtaattgcctctcaaattgtctggtggatttggaatgtatttattgcctccatttatttggaaatgcatggttgtttttcaccgaaagagagtatgcagtgtattcatgtaattacttcacaaaaagacagagtagcctatgaatggttgggacttgggagttgaaacgaatggtgaacatctttaatttctaacccatacctaagctacatttatttatttttacttcagtttccttgcataaatgacattgtcctctattccagctcatggaggctgtgtcggcatgtgaaccacgctacacatatggtaatgttttttccacatttgatctgccaatgtatcgtagagagatgttattgtcctggattcctcctggttataagcagggttcagacaagacaaccagcacaaaccgttttccaaaaaagagattataaatccaaagtacgtagtactactctatgcaaatattagatgtagaatacccataaatatcagagaaaaattcaggcatcttctaccctaaagtctctatgaaaaaaaaaactctttttgtctgaaaaaccagcggaaaatttgctctgaaccggttcttggatctgaatcagcaagttttttttttcactcctctgtttttgtaaccaaagcctataggtcatataaatatgatcctgtgggcaaacaatcttcccaaatacgttctgggaccaaagggatgatgcttctcaaacatgcaatccataaaccggtccatttgattcagaagacttctaagcaaagccacatctatctatgaaacttagtgcttgccatgatcgtctatcatgatgtattttaaatgctacctaggcaaacataatggctgtcacgtagtaggatatataagaacagctcaatctctggaccccgaatataaaatagggaaggagtggaagcccaatctgaagaaactaactaaaatcccttacaatcttggaagacacatgaaaagtaggaaaaatctctcacgaactcattagaaagaaggaaaaatctctcacaagcacatttgaattctacacgtacgagtacaatatatcaagggatgatatgatctatttgtaagagattttggctttgagagccagttattattattttttttgggttctcacaggtattacaaggtgatattgtctggtggcaataatcaagaggcatagttctatgtctgttttttaatatatggcgtcattgtttttttatcatttattttatttaaaagttgtgtgcaaatataaaaaatttaagtaatgcttaataagacgaacgaccaaacgtttatcaacgacgtcatatatattaaaaaaaatagagggagtactaagaaagatagatcgtacaggaatagcaaaattaaggagcctaaaaactgaaatcgctaattcgcgatccgtcagattattatttttttttgccagcacgaattgggccggattttctattttgcgtgtttaacgattgggttttctcttttttccccctttttaagtccatgtccattttcttttgggcttttgaccttttctcatttcaggtttctagggtaggtaggctgaattcaaatgttgggctaggcatgccggcctcacagcccacgtaccttttgtttttcttttcaaattttcttgtgaattcgtatcaaatttatacgtacgtgtacaaagtttatattttttacgtatactaaaaagtttgtaagagattttggctttggagccagtctattatttaatggttctcacagggtattaccaggtgattttgtctggtagcaataatcaagaggtataattaatatgaaggtaatgaatcgtacacgaacagaaaaattaaggagcccagaaactactactgcctccgtcccaaaatataacaacttttagtccttataatttgtcccaaaatataataacttctccactaacattctcttcccaaccaatcacaaccctccaccattcacttttcccacctacctccactactcatccaatcacaactctccaccactcacttctacctactttcttaataaccgtgtccaactctaaaacttcttatattctgggacggagggagtatctattttcgatgctgaactcgactgattatgtacatataccgtagcaatcgttcaaccatcggtcacacttgtgcaattttaccaaagggcttaggcgttcacttgtttcggacttatcgaaacatcacaatagtttgtcaaactcgattcatatgtaccgagatatttcactctaatattttgttacaaattactcttatattttgtgacaaattacatgatcatcacagcagttctcattgggattacctaatttgaattgctccaaattttgacgtactagcattacaatgtccaacagcccaacacatcccattgggtatgtgcatcctgactaacatcatactccactccatttcctccaatagctagcacatcatttgaatgcttaaaccatgcatggtatgcctcaactcagcctcagttattgcagagaggcagtgcccgcttattgcgggctaagccctggtgactatgcggtggaagggttgtaagttcgcagcgttggtggtggtggtggtggtggtcagcagcggtgccaagaggggtaggggaggtggtgctggtagagcaggtcaacgataatggcttggaggcgacggcttgctgacaagataggctatgatggtagctcaacagagtcttccagcgacgacgcctatggcggcaatgactcttcggcaagataagctatgacagtttgacagttgttgtggtttaaaatgacaacgacgtgttaatggcagtcttctggtgatataagctttagcagctcgacggagtggtgatagataaccacttttggcgagataagctttagcagcgatggaatatgtggagtagattggtcaagaggcgtgagttttttcttggcaactgcaaggtagttggcagactactattatccccttcctttgctcaatggcggatcaaaggaacttttgtagttgatgcaacgatagtgagatggtgtggcaatagtaatgcaggctagccccgcatctccttatagttctaagtgaggaagaaaagtttagggttagtcttctagtttttgtttccggttgttcgttggtttatgtttatcggttatgaaatttagaatgtcagcactcgtgtaatctttggctgttttatatccatttatggaaaatagaggccggatttctatccattatctaaaaaaactcagcctctacttcattgagagcctcacttccccagttaacctcaagcatgcagatgcaagtggtgcaacttaatccccttattttgcccatccttcatcaacaatccgcattgagaatttcgaagaactagtcctctatgaaaagggatgcaaattgtggtaccaaactcctaatctaaggacacatggttcatcaaaattataggcaacacaatttttttaattgtccatcatgacatccttcttccattattattccattatatgataataaaactttttatggtgtttggtagctacttagatattcagaaatgaaacaatgtaaaccattcattaagatatgataaggtacgaaataaagctattctagttttatctcattattcattgtcgaggtacctatttaggttacgacaaatgacatacgattagattttacacatcgaacaatagattcactctcactttgttaacgggcctccgggccggaagtttcaaaaaagaaaaaccaatcccaccaaatcaaaatttaaattttttcaattcataataatcccattaataacaagggtggtggtagataaaagatcccacccattttcattttcatgaaagaattaattcctccaattaacatccctcccaatacatacaaccactccaccagtccatcatcagtactagtactaaacttggaaaaaaaaacaagaaaaaggtgagcaaaacatttttctaaacagaaagcaaccaaccgcagtccacagcacacgtgggactctgaacaacttctcctctcttctcttctcttctcttctcttctcttctcttccatgccaaaattggattttttattttggtctgcctctttctttcccccaccttgacctgtagttgccgccggccggtcatcctccctgagctcaccttaatcttgcctgacctccaagaaaagtagctaaacgctgctagctaccgtggcctccctctctctcgcttcgcttcccctgaggcttcacctactcgtcgtcgtctccgatgccttcgtcctccccaccgctccgaggtagtcctactaacaaaggccgtacctttgccttcccctcttcagtcttctttcttccccgtggaggcttcccttgctttgtgagttcttgtttcgatctcttgccctggaagtgaagtttttgattgggtagtttgtgggtggttattgagagagagagagagagagagagagagagagaggcgtagagcagttgcggcaaaatcggtggtgttttggtagagaggttcttgattttggattatgcggttgcggcggttggaggatggatccctagcttaatcgatgaatttcttgggggccgggaattcgatcttttattatccctgaaatttctgtgtagtgtttcttgttttcagatatatttttcagtactctctttcttggtttttgaggtaggtagtccgccgtcaattcttatcatggaattcctcggtagaaacacccaaattccaatttgttttgtgatcgaatttaacagcaatctcaattaattgttagaatactgaacccggttaaactcttcttggaacctccctgaataacccaacattttgtttttttgcaggccttccactgttcagtgtctcacctctgaactctgaagctccactaatgtgatgtcaatcgcatgctgcttgccggttgtcgagtgcgtctactgcctggcgtgcgcacggtgggcgtgccagcactgcttccacaccggaggctatgacagcgagacctggggccttgcctcgccgaatgagtttgagccggtgccgcggctatgccgattgattctcacggtgtatgaggatgaccttgagcacccgcagtgggcgcctcctgggggatatggcattgagccacggtgggtggtgcaccggaagacatatgagcacactggtggacatgccccgacatacttgttgtatgttgatcaccaccattcggatgtcgtgctcgctgtccgtgggatgaacatggcgaaggagagcgactacgccgtgctgttggacaattcgctcggccagaggaggttcgacggcggctatgtgcacaatgggttgctcaaggctgctgagtggttgtttgatgctgagtgtgatgtgctaagggaccttctggagaggaatcctggttacacgctcactttcgcaggccattctcttggttctggtgtcgtggcgatgcttgcgctggtagctgtgcacaatagagaccggctgggtggtgttgagaggaagagggtacggtgctttgccatggcacctgccaggtgcatgtcactcaatttggcagtccgttatgcagatgtcattaactcagttattctccaggtgagattaattccatcattttttttagataatggaatagaatcccagcctttgctcaatgagctacagccaattattacatcaattcatagaaataaaaacgcatggcaaaaaagtcataaaaacataggcctaaaaggacaggaacacactcagtactaaaaaccaacgcaagaaaagatcacaattaattccatcattagatgttgccaacatgtgtttatatacctcttttccaattgtaaattatgtacctcatttgcatgtgattgtgcatgaaatttcataggtaaatttctttcggaagtaaaactgtaggaaacactttaccattcccacctgctttcataatttgtttgatcaacaagttcaactgaaatctgttttctgattcatattttattagaacaggatgattttctgcctcgcacagacactcctttggaggatgtattcaagtcacttgtctggtaatggaactttttcttatgtgtagtgaacacttgaactcgtatttgtagagatttatgatcttcttagtctatcttttcagggtacctgatgtagtcctttgtatacagcttgccatgccttttatgtggaaggtgccttatagacacgtgtatacctgaaagtgcgatgttgagagatccaagacgtctctatgcaccaggccgcctttatcacattgttgaaaggaaaccattcaggtacgacttccagtcagttctaaccatacaagtaattttattatctgttaacacaagaataactatgcaaatatattcagtatatgcttatattcatcttcataataacaatataatatactaactgcaatacacaactaaatgctcagggaaaatattctttcagtttttactttttctaattttgatacctcaagtttagaataaatattccattgaacgcttgctggtagctgcagatgtggaagatatccccctgttgtaagaacagctgttccggtggatggcagatttgagcacattgtgtatcttgcaacatgatttctgatcatgctattatctggatcgaaagagaagctcaaaggggactagatgtaagtctgaatttgttgttctcttcttgagtattctaccatgacaaacagataattgtttctggcgtgtagaaaaatggtaactaattctagttctcttatatccatactgcaacctatggatcgtcattatttatttcacagacgatggagcttaaaagtattagaaacaaactaggaatatagcccgcgcacatgcgcgggcatcttatgagatgttgttttaaattgtgttaagaatgttttatgtgtgggtgacttttcttaaaatttttctttgacactattgtaaacgtgtttttgtcactaatttgtttgggattgcgttgaatgttggttattattttcttatatttatccttggaagtttaaattctaaattaaaattaattggaactacgccgttttgaaactatgagaaaatatggtgtcataataatggagctggttcttataaaactatgatttgcactatgtgtatttactttttaatatttagcatatcttatcttttttatgtttctatgctttaagtaacaaaattgcttttataccatatatgtatttatgaatttttggatatattaagtgaatatattttctattaaaaaatatggttaataggaatgtttcatctaattaaaaaaacttctattaatttgcttctattctcttctcttttttttcatacgttttcttattttctttgaaaaataaaattgatttgaaagaatagcacaatcatataaatttaattagtatgtgtaaagcgtttataaatatttaagtgccatgggctaaattgcacttttgttggatcaattctttttatcaagtatgttctactgcatgcattctcatatataagtttagtatgatttcccctaataaaccaatcttagtatgaagttcccatataccatgcgtacttaatagaaagcaaagagagaaaacatgacttgtagtttgtctattattttattattatttagaggattaatatagtctctaaaatgtagaacaatggtagtggtaaatatgattgatacattaggttatcccggtatatacggatcaatagtatggaccctatatataagcatatttaaacgatgatataatctatatcattatttttttcatgatttgtcaaatctccaatgccatgcaaagtaccaagatttgtgaactgataaccgatatatagtgatataatttatattgtcatctattttccataattttcatatctgtttgcattggattacatgaaaagaataaaaatactatctaaaatataatttcctttcacaagttgaaatatagtaaatatacataataaattattaatttaatggtaaataatataattatgtaaactttgttttaaaatgcggtaaagctaatcgagttatgcttgtttgtaaagtgatttaaataatttgttaaatccgatagatgttttgtgtttttcttagactttctaggattttctctaatttattagacttttattatatgattgaggctctttggatggcacacaaaagcaaagtataggtccgcatgtctgttttcaaaatatacatggtttttcattgttgttattttggccatgcatatttataaagttctatacttaataatctacacggtaaattttgttttgtatacttttatgagtaattggatggtgtaaaaaagagcaataatctaagtcaacatgttagtctttttcacaacatatacgggtcttaaaattgttggtttaattgccaggaatacaacttttgaattagcctttttaatataataatccaatgatagggtttgtcggccgaacgtaatcttttttgacacgcaacacgtaaatacgaactacgtattagagatcggatgagtgattagccggattgatctatatacatgggaaaagaaaaaaaagaaggtaaaatacgtacgtacgttcatccttttttttttatctctacgtacgttcatactgaacggaaggaatagtgagatatgtaagggaggaggaggttggtgggtcatcggtttgttttaagagatctaatctaacggtttataatattggacccaccgatttaagtgaaaatcgatggatagatgttttgttttttcctcagtttttctatgattttctctaatttattagagcgccaagtggtggcttgagagcgttttgaggaagtttaatggacttttagtatatatttaaactaaatatatgatattttgcgggcatgcgttgtatggtaggtttgagacacttataaaagcgaaatattaaccggagaatatctgccatgatttctttataaattgttttcatcggcattaattgcttttataattttctaatctgttacctttatattatattatatttaagtaataaatgagtcagtcctgtctcgtttattcgatgataataataatactaatataaatactaatctgtgaaaacaatttggagatacaaaatcaccttacagtaaaaacaaatactaataattaaaccacaaaaaattgcaactacacatatatctgaaattccgacacaacacggctgattgatcaccctgtcactacccaaccccagaaatcaaatttggaactactaacatgaggattattgtgtaatctatttcttgaatgatcgatcactgaggtcgatttcaggaggtggcgttgaagctgaggagcttcgacgtcttggactcgatccgg

SEQ ID NO: 46335 - DNA, 3504 bp, Oryza sativa
ttttacttactaaatatagttactttgggtcttgaattataaattttgtggtaaataatctaatgatgaattatgtattttctatataatatagtatgagaggatggaaggatgtatggcgtaagtacgtgtactggtgcacgtaaatgatacggatttaaagtgggtccaccgtatttaaagttgtaaatgatacggatttaaagtggctccaccgtatttaaagttttcctttttaagaattattagatattcctcaaatttattaaaatgccacatgacgacttaagagcgtttgtaggagtttcacgtggcggcttgagagcgtttgtagaaagtttaatggacttttagtatataatagatagataacgttagtattcatctctggcgccttgttttagtatcagctctcttaatcatcgacacaaaaaaatatttagtttttcgtcaactgtaggttctgtcatgagctttctttacagagcacaaatgatgtgtagactaacagtcttgtcatttcagttgatgctggagaacgagagaaccatgaagccacctgagacgcaaagaatggacgatgaaatcgccatcgagagggatcatgatgaggagcagaaggcggcattgaggcgtgccgttgctctaggggtcgcagatgttaatgtgccatcagcatatggtacattcagtgaaaatctgactcctgaggctgatgaggcctctccggtattgcccgacagtggactgcgaaggacggtctgggatgagtggattgcaaggatatttgagaaggatgaatctggcaaaatgattccacgaacatgattatggtagaacagggcattatgctatgaaattaggaaaaaaataataaataagtatgcaggcaatataatctgagccgattattattggcatcagttcatctccagcctgttcaagtctgttttcaaaaccttgaaatggtgatggaaggaaataggaattgttggcagagcaatgatgtgaaatctgatgcagtttcaacctcagaaacaaagatcctagtagatgatatggggcctgtttggatcggagggctatttatttatttatgagtattaaacgtaaattactgataaaacccattccataacccctaggctattgtgcgagatgaatctaacgagatatattaatccatgatttgctacagtgatcatccgctaatcatggattaatatacctcgttagattcgtctcgcaaaataggctaggggttatggaatgggttttgtgagtaatctacgtttaatacttctaaatagcaagattccggagggatatttaatagcttggaggagccaaacaaggccatggtcgcacggatgtaaatgactccatccatcctaaaataatagcaaactatagtttaggatgaagggggtaggaattaacaaaagggaaggaatataggtgaaaattgatataggaattagcaaaatggaaggaatataggtgaaaattgatataggattacatatatttgttatcagaaaatgtcctttatacacacaattgattaagtaattagttgtacagtaagctattaaggagagtaagatttgtatgcaaaccatgagataaaaaagaggggcatcctatcttttggtaaattttcagccagaaagtacgaactttgttattatcaagacagtggaatgctgcaaatagtcttctctcaatctttagttattaagcgtaccatttgttcttttagaactcatgaactttattgaaggaaatgcttaaaagcacagtacatgaatgatgttaacttctccacaaggagattacaaaggttgcctaaggttgggcaacttgcaaaatagcaggcaaagcatgacaagaaaactattatgacaagaaagttattaggagaagaggttcttgctttatgtcagcatgtttattggcctcccttggaatccatctgattgcgatttgtttacctgcagataaagcatgcaattcaaagagtaatgatctcaaagaccaattgtcttggttgagcaatgaaatcttgctgctgtaaggttgagactaaagttttattgtctgacaggaaaaatgtatgctgtaactgtaaagccaagcaaaattttgtaacctgaaacaaatgctgcaagatcaacaagaggagaagtaaagctcttcgaacgtgcttttattaaggttactgcgtgtgaaccaggatcatgtataaaaatgccaaaatctgatatattaattttccaagaagcatcaacataacaaagagtacagtacctgaagggataatcaagttaacataaggagatgttgttcagtttgtgttacctccgaagaatcatgttgtgtttgatgaacactattataactttgcaccatggagatggttgcattacaaacctgaaaaggctcccaattttttgctttaaaattatgatcattcatagcttttcaaatttgccaaagcataatagcaattttttgaagggcattatctgtggacatagtagctaggaggtaagaataatatcatacatagatgtcatcaagctaagagcatccgttttatgttgaaaatcaaagataaaccaaactagtctactaaagcaacagtgcaaaaagatatgagtttcgttttgttgttgaccgcatgtggaacaagtaggttcaatgtccttgattctagaatgaagagtaacagcagtaggtaaagcgtttctgaaaagtgtccaaagaagaattttaactataggagaaattgtcttatttttccaagcagatttaataagattgataactaaggaaggaataggatgatgattataatggaaagacttgaaaacttctttgtaagcacttttagtattacactcagcagaagaagtgtgaatccaacaaagcttatcttctgtatcctgatgaattactcttacatgggatatagaatttgtagcctccttagcaaagacttgagaaattttatcaaagtcataatttttgttttgaccccacaagccatcgaaggtaaatgattaggaatattagtcggatttaaggatcatgaataatttctcaaatagaacactagggttgattctaaatagaaacctaacctttagaaatttgcccaatacatgaagtgaaaaggtattttcggattttagaaatggaagaccagagagttgactgggaaacattaaaaggagctttccaaaaggaagcattgttgaaatatttggttttgagaatagaggagactaggcccccttttttttttcttaactccaaactttaactttcttgttttccattagcacaccttttaagttgttaaatggtgcattttttttaaaaaagtttctatatagaagttcttttaaaaacaaataaatctattttaaaatttataataaataatacttaatcaattatgtgctaatgaggtttctcgtttaattgcataacatgtac

SEQ ID NO: 46336 - DNA, 4584 bp, Oryza sativa
attatacttcctgatgataacctcctgtgctcaagccctcaactgtaacatttccaagaatgaacagatgaaatattagcatctccatgttttcttttgatttctttaaacattttaccctttcgatcgcactaactataaatgcaatcttactatcaacagtttctccactggtttacgataccaccaaacctttatgggatgcgatacaagactttaaaaaccagtatcaacagtctgaatatgaaaatggatggcattttacagaagggctctgaattaggtcttctaccaatcgatcaggagatcctgaatgaaaggtctgaaatctctttggaagtgatacctgatgattacattgtgggtgacattgaaaatgaagcaaacaaattgattgatatattgacagacaggaaaagtgcgaagacacttgttgccatagttggtggtagtggaacaggcaaaactacactggcatggaagatacatgatgatcatcgcacaagaaatgcttttggtatgatcgtgtgggttagtgttttcaatgactttgatgatattggattgttgtctgcaattgtaactgctgctggcggaaatcctaaagaagcaaaaaacaggacgcagcttgagttaatgctggcttccatgcttaaaggaaagagattcttgctggtgcttgatgatgtgcggggtcatcaaattgaagaaaattccctagaagctcattggcatgtttgtggtcatggaagtagaattttgatcactactcgagatgagaatgttgcaacaaaactaaatgcttcttacatccaccaggtaaaggaattgagttttcagaactgttggtccctgctttgctgtaatgcatgccttgatgagaaccttcatggaaacactttaaggaatatagggataatgattatccaaaagtgtaagaagattccaatggctgttaagattatcggcgctgttctaagaagaaaggagcaaacccaagaatcctggcagagagtttatgagtttgaaggatggtcttttgatgaccttcggggtgatgttcaaggcttaactggggccatatatttgggctaccatgatttgccgtctcatctgaaacaatgtcttctttatttatcactctttcctgaaggctctaccatcaggcagcagtttgttactcaactgtggatttcagaaggtttgattgatcgacaagatgactgtagtgctgaaaagatcgcagaggagtattatgaggagttgatatcaagaaattttctgcagctggagactggaaatcgcgatataactaggtgcacaatgcatgatcaaattagatcctttttgcagttctttgttaaagataaaatttgctctggtgaagtgaaacctggcaccaatggaacttctagtgaaggactgagacatgtgtggattagcggcaccagtacaacaactaacctcgaagaaactgtgaccagcttgaagacagttattctctacaagaacccattgagaaatcaagggttagacaagctatttaaggggctcaaatatttgcatgtgctggaccttggtggtactgaaattaggtacatcccaaggacactggaatttcttgttcaccttaggctcctaaatctttcattaacccgaattacagaacttccagagtccattagttatctcagaaatctacaattcttgggtctccggtactgcaattggctacacacccttccgaagggaattggcaacttgcatagattacaaactctcgatcttcgagggactagtttgcatcaagtcctgccaagtttggtaaatctgaagcagctctctacgctgcacggtttcacagtaaatcgaacacccatacctgaggatgatccgagtgggtggcctcttgaaaacctaaaagatttgaatgcattgaaagcctgcagatactgaagatggaaaaagtatcagacttttcaagggtgaaagaagcaatgctagagatgaaatctcaacttaaggaccttgaaatatgttgtagcaatgatgatagactggctgaagcacgagaggatgattctaggacgctgaaacagatatttgattcactttctcctccacagtgtctgaaatctctcaaaatagtgagctattatgcaagacactttcccaattggcttccttgcctcacaaatctccagcggcttgttcttagtgattgcaaattctgtgagcatatgcctgacctgtccaagctaaatcaactgaagttccttaccataactggatgctctaagttgcttacagtggagcaagagtccacaggtgtcacacaggcatttcccaagttggagcagttgcacctcaaagatatgccaaagctagtatcatggataggatttgcatctggtgatatgccctcccttgtgaaattttgtctcgaaagttgtcccaagttgaagtgtctcccagaaggcctcaagtactccagagtcctaagaagtgtgcaaatacgacatgctgatagccttgaggtcattcaggacttacctgtgctaaaagaattgaatgtccaagcctgcaatgagctcaagatagtctcaaaccttccattactcgaagtgttaacaatccgcagatgccctagattggatgatgtcagtggtgttcactatctaagtcatgtctgcatcacagataaagaactgaggaaattaccagattggttgtcaatacatgcaccagtgcttcagacattcaatatagtcggcgtatcagaattgcttgatagattacttcccaatggtgaagactgggaaatcattcgtcaaattgacaaagtttatgctaacttacttgatgaatcaccattcttcacttacacaaagagctctggtgatttccatgtcgatcaaagaattggagaaataaacaaaccacctgttgtgttaggacatggaactgcagtcggaggcttgagcattcctgatcactctgttgagataagctctcaaattggtgtgtctagagtacctatgaaccgaatatccacactgaggtgggtcgtaaggagttaccttgttccgtaccttatcatggttatggttgttatgcaatttctttcgtattatctacacaacaggtcaactagggagatctggctggttcagacccttttcatcttcttcgcgacagtgtttttgcttctgcttgtatttctggactgatggttttctcctaccaaaattggagagatgagaccagtgaagaaacagagtttttttttctaccataattgggaaaatgagacagctggcccaagagacagatagttacaatgaacttcataatagtgggcataatcatgtatctcctacagttgggggtgtgctgcaattgattcatgcttgcttggtggaaggaaacaatgaaaacagtgcctcaacaacaaaaatcaagagaaatgttgcctcaaatattgaagttgtgatgtgagatttgttaataaaagggtgcaatatcttattgtcattcttaaatgagccaagaaaaacagattctgccagcctctcgcagttggtttgattagttgtatacttgtattgtattgttgtatgcacagtttaggttatagtgctctttcatatatagtttgtagtgtttgacttgccctttttcaaagagatcatagggggttgtgatgcctacagaaattgatttgttttgtttagggcacagaaattgatttgttgtatatttgtatacaaaaataagggtgaataaacaatttgttcctcccaagtttagctcagggatgaatttggtctcacatatttggacaaaatagagcattaagagtcaaattgactatggtgcaaaacttaggggggaataaattagccattctccctaaaaataaaacaaaaccatggagagcctggcaattaagttgtcatcttttgtcctgtgtactttctgttatatattcttcaatgttgaattcgattccgtcgataatcgtgaccaaatattgtatgacactggatattattacccgtcatcgtcacagtggttttcagattttatatgacgtccatatgcgtagttttaatagataaatcttcagtatttagcttgctgcctgtcaacagatattctctctattacctataaggctttatcatagtaagcaaaatacatgagcaaaactaaaactcttcatggagttttctgtaacattctttttcaagttgctcacacacctcaagtaaaactctgtaaattttagctcacagataactcaataatacaacaattaatgtgtcaaataggataaaggtgtagtgacaaaacataagattttacagtcatattttaaaccatttccatatggtggaattctttttcaccaatacattagcttagatttttataaaccgtgccaattcaagcaaaacattaatatttgaaagctgtaagtaaattgtgacaatcagtgcaagtttcagaagttaccatacagtagagcctgggaccatgagaacagaaacaatgaaggtacaaaacttgagctattatttt

SEQ ID NO: 46337 - DNA, 2680 bp, Oryza sativa
  unsure (1)..(2680): unsure at all n locations
cttcattctctgggagaagaaggcctcttcctaacaattcatcataacatctttcagcttcttcttcaactgttgcagagtgcctctgtgttgagtttgtctgggtcacaatgaatccctccgcgatccactgctgggtgatgcactgccgctcgataacagatccctctgggtacaacgcacagtacagaaaacacctcttaaggtaatatggcagttccaggtagctcatgttaatagtgctccgtatccttgcagaaatgccacagaaatcgctcgagtagactcttccccattcatcctccttatgatccacatcccgtagatggcatccaatcctccttattgccattggaaggccattgcacttttgcacgattcgtcttcccatgtcctgcatgttgccagcaccctcatcaagaaaggcccttgtacgaagcaaccaccaaccatcatcctcattcagcatcttcacacggtgaagatggatagcccccatcctcctagcaacacgctcatcccgggttgtcacaaggactctactgccaggggcgccatgttgggcttgtatctctagccgcccatcccaaacattctctccccatacatcatcaatgaccagcaggaacctcttatcttgtaaatatgatagcaacagtgcttgttgttctgcaatttctgctttactgaacatcccatcagaccacattgttaagtgccgcaaatctttggagacgtgtacccatagcctggtctcaaacatggctgctgccttatggtatactttacgagcaagggtagtcttgcctactccaatagttcctatgatagcaaacaaaggacaagtagtattatagtctctggttagcagctgtatgagattatcggagtcattctcaacctctctgcctacgatatcaggctcaagatgtggagcaacatcaagatctaatctgatttgatcttctgccactggattcagatggagcagtgtactctctgatctaatgctctccagttcctgatttagttcatgtatatcatttgctataatgtagtcaacagcgacatctctgcagcacttaaaaagcgatgaaggattgcactcctgcacagagattgtaaatttaattcatggttgaataactagatagtgcaaaatatgaagataatatgaaaaatgtactacagaattttctccttgagactggaatcagcaagataagcacattaggctatttcctggtgaataacatataaatttatgcaatgcaaattaagataaggtactatctttactcgcggttcatatgccaattccagtgatcttggcctcttgacaggaaaaaggaaaagagcactaccagttctactgactaggactggtagatgtcatactgattaagaagtgatttcatactttcttttttatgtagtcttaatgctaatgattttatcattttaaaggaccaaaaacagtagttttatcccttaaagaaaaaacacagtagttctaccaaaaaaaaaagacgaatcaaataaaaatagcaaacctgaactaccagctaaggtctggtaatatttcaaataatctttctgtcatccaaactatcaacaacatgtggccacagaagcagatgttagcagtacacatatatgttaaggtatatttaggatatgcagcccaaattgcctttgattaaatattagttcgctaccacaggaactattggagtgttattaagtattagttgtagagaatgttggttacgatagagtgaatggttgtttttgctagacacatgtatattcagtacacagttcgtggtcttacatgtcttaataaccattcatagatttatagaaactaaaaaaaaagagtgtactgaatactgatactaatatctgttaaaatttcagcagaaataacacactagtttcctatatatctgcaataagaaactggactgagtctgaaatgtgtccaaaagtccatcatacatttgtggtgattgattggagcattcctagaaggaccgagacaagctgaataatgcccgttgcctccaaccccatctaaaagttgaggctatacacattatgttggcatatttgagtatccttagacaacagtgagccctcaaaggctcaaagctcacaatattcaaatacattgtatgcaagcatttttttttttggacaagcattggaaatggtcttcaatgaaattacaaatctaaataagctaaaaataattatcaacaaaagcagaaaggaaaataacaatttggagaaatatgttcccggggttaaaacaaaattgatgaagatttgagaaatataacctgtggttggaacatttggagcctctcttgttcaatcctgcagcggtcaattatgttttctgcctcataagctattcctctcaactgcttcaaccaatcccttgtggtttcatactgcacaactgtctgctcagcatccctgatgatagccgacatggtctcaagcttcctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46338 - DNA, 745 bp, Oryza sativa
gagcctccgcgcgagcccccgcagctcgtccgccgccgcgtgggcgtggccgccgacctccgcggcgagcgcctccgccgagcgcgcggcgggcggcagcgccgccgtggcgatcatggcggcggcggtggcgtggcttccaacgccggctagtcgatcggaggaaacgagagcttgttggcgtccacgtcgttttaatttaaagtcaaccgcagcgaagattgggtcgtggctgtcgtcagcttacgcaagcaagcagagactgtttcctgatttattttatttttttggtcggagtaaccgataaatggctgtccgtccttttggctgtttaatcgaggtcttctcactcaaacagtctgtgttggagaattgtttctaaacctaatgatttaggctccgttccacgtgtggtgttttggagattgatttttgttcatcatatgtgccccaaatctaaaattcattttccatcattttatttgtcaaatacttcatttattcaactctgttcagaatcttaataaaatcattttttatgttaatatgagtccaagtgataagtaaaaccattctaagcatggctaagcaatatagtaaactagtgacaatataactcatattccaagtagtaatagtaatagaatatgattcctaaggttaggaatgagggatatggatatatgtggggttaaggcgataatgcaaataataggagtttgtctaacaaatttaacaaaatttt

SEQ ID NO: 46339 - DNA, 2896 bp, Oryza sativa
ctcttttcttgttgggggggggggggggcggggggggggcgagttaaaaatgtgcatgcttccttattcttcaccaccacttaagttttttttttggtgaaaaaactaatcaatatgaaatgggaggaataaataatatggtcttataagtacatctattttctctatctatttaatgcttgaaattatagaaatttacccttttattcatatattaattgaaagcagcgagacattgagatgatggacataagttggaagacgaatacgtgcgtacaaattctgaattccaaccaaccaaagtaatgaaactacttattttccctccacatgtgtataagaatcgaggaaatccttttttttaaaaaaaataattttatcttcttattccttaaatataacgttctaagtgcataacattaaaaagttcaagttacacagtaaaggaaactaatgaattgattatttgtttgaaaatttggtactcaaggagcataacgtttgcatcaagcgggagcaaaagatgtcggtagcattcttttcctagaattttacctcaattttcgttagcacacttttcaaacatcggtgtgtttcatgtaataaaaaatctttgtgaaagttgctttaaaatatcaaatatatcaatttttcaagtttgtaataattaaaacttaattaattatgcgctaatagttatctcgttttgcatgtccgcatttaatctaaatcttcgtcagattcgaatacagtattctcatttactacttcattctatcctggataaaagattgcaaagaggcctggcttttttttattattgtccttcccagtccgcagtccccactctcgagtctcgactcctccgctgctctccactcatcaatttgctcctcgctcgacctcggtgtctccatcttcgccgcggtacgaccgtatcgctgctacaacggccttcagtctatggccttcttcgcatgaagctcgaaggcgcctgcgtctgcaagattgaagttgcgccggcaacatcagcaaagagaaatctgcgatgcgctccctgtcccccacctcctgcaatccctcatgcttctcgggccagcggccggatccgcagcccacgataccttcgcccgccgcatccggaagacaactcccatattcccaagccgatgtgattatcggcgcaaaaatctggtagtgagctttggtgctggacaaagcaccagtgagtgtgagttgtgcgatacagctagcgttgcttgcgtccattcacttgctctctgcctcttttgctcatttgcatcaccatccagtatcccttagtataggctcggtgattttggtactcgcctgcaggcaggcatgcatgcatcctacttgggtattttcctctctacaagttcaacgaaagatctaaagagaaccagtgatcctagggaagacactgcttgattttctttgctgaaaacatctcaacacgtgccttaatttagcaccaattgcaggtaattttaaccagttctttggtgttctaaatggaaggagtataaataaaggacacgagcgggtggttcgccgtggcgtcatcggccgtgatgcgcaggtggcggaggatccggcacggcgccaccgctcactcgcacacgccgcctcctctcctcctccgctagctagcgcccctcccttctcctgatccgggccgatggccagtgccgtccctcttctttctccccgggttcaatggatttggcaagtctgtattgggacgggcgttctcgagggtgactcctgtcggtgagatagaagcgtttaggaagggcagcagcatggcggcgggaggcacaggggagggcgaggtggccgggcgaatgtgaagaagacgagcccaacgccgttgagggagaacatgaagcgggtggtcggccgcaacgcgcgagtagcggaggagccggtggattagggtcgagcaattctgcaaataaaaaatacaataactccgtagttttacgatgaggtccaccgcaacgaactttagccgtcgatacttaatcaaacggtgcaagaggagtgccaaggagacacgtggcagatttctagagaggtgaagcttgatttctagagtgccacgtggcccaatcaagtgccaggattcgggccctgcaatcggtatataagattgggttaatgggctttgggctactcaaattaagtgggccttgagagtttcacgttgaaaaagatcacggaaggacttggaataagttcaccgaaggtccctcaacttaacaacgagatttttgaggtcccctaaccatagaaccagaaatgtgtacccctaaacttacacaaactatgcacacaagatcctatggcagtatatatgggtggtttcgctgacgtggcatcctagtcagcaaaaaaaaaatgttacgtggggcccacatgtcagctgcacatcttttttcttctcttttcttctccttctcttctcttttctctcttctctcttctcttcttcaggccagcggtgggcagagcagcgatgggaaagcgcggatgcgggcggcaggcgagcgcggtagcggagggaaacactagtgtgtactctcgttctggctcggccagtcgccccaccgccgctcgcttcctggctcaggtagggctgcaatttcgcgctccatataacgccgctgtggacgtacagcagaggccacgtgcaaaccctgcctgcgccgtgtgttgtcatacgggcgtgtggcggtgggctggcggccatgtccccgtatgaggctatgggcgtagcggcggctgggacgcagctataggcggaggaggtggcatcttggattcagtgtccatcttggaggcggtacgtggtgccccccgagtaggggtg

SEQ ID NO: 46340 - DNA, 8172 bp, Oryza sativa
  unsure (1)..(8172): unsure at all n locations
tcaccaacgagaacaagtagctcaagggacaaaaaaggacaaccacaaccaacaaatcaaatcaaatcaccataccagcgccgcactcgaggagcgtcacaccggttgagcttttcgccacgggttgtgaattacttgtggagcaagagaggagaggtgcatggcgatggccggccaggttgtcaccgtcatcgtgtggtgcgattgcaatgtggatagcagcaccctggctagggacgacgtctatggcatgaacgataagcatcctgtcgggtcgacgagttcctagacccaagcttgcctgacggagcgaacgacgggacacgctccttgacaggttccatgagcgcactaatcctagtgctatgccgctacgctccgccgccactctcgtccgccatccgctccgtccacagccagccacctctcagctacctccgctccgccgccgcgctcgcccgccgtccgctctgcccgcaacccgccgccgttctgctaccgtgctcgcccaccgctgcacttgccccgccgctggcccaaagaagggaagagagaagagaagaaaaaagatgtgcggttgacatatgggccccacgtactttttttaatttttttttctaactaggatgccacgtcagcgaaaccacccatatatattgccatagaaccttgtgtgcacggtttgtgcaattctagaggtacacattttttgttttgtggttaagggatcttaaaaaaatctcgctattaagttgagggacctccggtgaacttattccgaagggctttgaattagcaacgctcctacatagtgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcaggcggcccccttgccgccctccgcgagggcgattttctactgtgcggggggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcacccgaagaggtggcgaacgcccctgcggagctcgtggaagcgccggtcgtgcctgcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcatagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctctgcagcacactctttgttcgatcatcaaccgatgtaaatgtatgtaggtcatagtacgtattattattcctctgggcaatggtggctaacaaacgaggcaaattatcataagaagcttcaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccatctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgatacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacattacattctccagatcaaactaaactacatcttacaattaacactactgtctatgtctcaattcatactattatattctatgctctggatcttcacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcccccagggcggcaagggggccgcctgcaaaattccatgccccctcgccgcccatttgcaggcggccccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgagggcggtaggcgactccttccgtcaattttcaaaatggaaaattatttttgtaaaacttttaatacaaaaaattataaataaaaaaaattccctacatagtttggttgtttggctgcgttggttttaagaatagcaaaccaaacaaaaaccaaccatggaacaaacggagaaattaaaaccgaagaaaaaaccaaacatagaaaaaactgctacttcggctcggttcggctcggtgtccggttttctatatttttttcccacccctacccccacccttaatccaagttactacctattctcagtcaacccaacacaaacactaaaataaagataaattcaatttccatttggatttaaattgaaggtccaactcaattcaatctaaacacaaatatagatatattcaaacgttggtctaggagcgatcgatctcatatagttgtgatgagtttggtgctaagacttccccctcagtggcttgtgtttgtatggtcggtgcatcattctcaactatgcgctccgatgcacggccaagcttgatggtcttttgtgtctccccccctcctcttaatactattagaatgctatgctgaaaaagaaaaaaaatagtactgctacacgtaaatactcatgtacaactaaatacatgtactcgtagatcaattaaagaagaacatctttacatacgtacgtgagttgtttagttagatcgtatgcataccattttccaaaaaaaaaattcgttgaaggccaagtccattgtgcaacgtgtgtcaaaaggtcaaaacgtttgtctgcgcctgctagtgcacttgcacttgcattgcagcaggtaggcaaaacgaagaccacccaaatcttccgttcccatttttcgtgtcccttccatcatcctttccccctctatattttcgaggcgggggctccaccgaccaaacgctgcgctcggtccaccacacacctccgcctgcacggatcacgaccgcgcggtgcacggcgtccacgccccgtggaccatgtccacggaggggaagaagaagccgacccaacctaacccaacccaacacattcttcctcctccgcgtttgctccaatctctttctctctcctcctcctccacctgaatctccctctctctcctccaagaacaggggcggcgaagcagctaagccggatttcgtggttggtggcctctccccttccaccaccaggctcgccccgccgctgccgcgaggtgcccggccgcctgtttcttctctccggtgcatttcgatctgattcccccgtccgatttcgtgtccgtcctgcttcacacccggatggttcgaatcgattcttaaggaggtgaggcgtttaatttgttgttgagctacgtgtaaatccccccctttacatatgcgtggagagattggagcgggcgtatggagcttcgctgagctcacggcttcttcgggataggcgggggaggagggggtgatggtgccatggttggcatgaagcttcgtttctcattttccatggtgttggaatgcagcttctcagcttgagcaatttgagggaaatattgtcaaacccagggagcgttttctcagagcagtgattataatttttcggtttattagcattctttttttaagtatacaacttcctattttcatgtaactatatattttcaaggattgttactgtttaatttgacatcacggctgcatggatccatttcctcctagatagttgcagcttcaactcaatctgcttacacgcctttcttgttagtgctataggtttatcgagaacctcataaatcagctgtattttgttcaggtaatgaccttcccccttatcaaatgtctcacctggaatacctaccagaacgttatggagctggataactatgatttctcaacaattggattattctaaagcgttagtggcgcctgttttcttgtaacggtgtgacctgttgcagattggttgctttagattaactttgtctgtggtgatgcaccatgcatctgattagtcaaaactagcatccagtaagcgatgccaaagtgattgaattggacatagcatggaagctttagagtgaatgtgttaattgataagtgtagtccctcctttcatttgttaaaagtctcatctgtttatttggacaaaaaaaaatctttggttgttataaaatggaatacttatgtgttgaaagatgaaagccattaagcatatgtcatgtcaagttgatctatatgtcaacaaacaatttttaatgtcaagttgagaggctctgtttttaacttgatcttaaggtgagttgtttagctacttgctgaaaacataattagtcgtgcattgtctgcccataccatatatagctgcaacaaggttatcttactgtgcaactgcacaaattacaatgactagtagttgttcattcctcagtattagtaactttatttaagtgaaagttttataatattctatcttttatttcagaaacaaatgaatcgtggcgaatgaagagtttagcgatgtgccttagttgaatggttccattgccaccctgtttggctgattttgttcagacgaactcatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46341 - DNA, 1942 bp, Oryza sativa
gttcttagcaatgctcttaagaccagccttttaattgatttgagtactggaaaatgggcaggcggcctgtcaaacaggttgtatagatgagcctttcttcgttgtttccattttgacattatgcttatgtgtgctgtttcacatcattacaagataaattgatgacatcaatttttgctgaaggttacacttagttttcaaggaaatgagcttagacgtttgtttgatgctatatctatatacacatgtcaatgatagcatacatgcgctatcatgcaaaatgtgctcttgaagctatcgctgtgctccctttcatattcttttatttacttattgcagttctatgggacacacagccaacagcttgactaagaacactctgcttgatgcacctaataatacagaatgtagtccttaccgggatggaaaatgctgctgctctttagccccaaaatgtttggcaggttatggatttacaaagcactgtgttgctagaatcgatcaaactgatcatacagtacaaaagagcaaggatgatggcatgcaagctgctgccagatgttgcacgctaggggagagtgaaaaattaatatgccagtgctcaagcgagataattgctagaaaaagcgactctaaagcttctttccagaatgaggtctctactgaagtattgaaccgaccttgtgttcctacattacagcagctgaagaatgtaacagaagcatcggctgtaggtggccattggccctatgaaactgtaaaagagaaagcgagtgcttgtagagattctggaatatttaaagaactaaaatccggtttctcttctggattctccagcgatgttgtgaccaagttttctgcatcacctgaattgaacaagtatggtcttgaacacaaaaatcttgtgtttgatgaagggtcacgaattgagaaatgttcctcatccagctatttgcctattagtacaggatgtgaagaagcccaaaatagtttttctagatttcacctggagccatctttagtgaagcacaaaaataatcaaatttctgagggaagtacacggaaagaacatgagaatgagggacaatgttctgaaatgtcaaagaaaacacgaacattgaggtgctgtgcaaacaaatcagaatccgatgattgtactaggaaaattgatctgtcatcccgggaaggggattctcaaccgcagcataaggctggtccattttcacgcagagtatcaaaaaccaagaggaaacatcctcccacgcatctgaataaacatgtgaaacggcttcacagcaactgcaaagttctcaatgttgacaatgaacggtcagatgatgagggcatttatgttggagaatcaaattcctctgatagaaaaaagcaagaagataatatgaccactttggatagaacaaaatgccaacagcaagggagtcgattgcttgtccgcaaactgccaaaatatgtgtctctgaattgcattgtaaatgaaactaacagtgaagatgcctgtagtgggagtgccagtattgattctagtttgattgctacaggaataactaatgataatcggaaatctcccaaaattgttccactcaatctgattcttaaaaaggctaagagatgtcatgctatcaaacccctcagtaagacagaaaatatccatttttctgaggaaaagagttcagatggttctgcagataaatcttcctctggtgacagaagtttcagtccacaagatgaactgtggtctcccaaaaagaataggtattcatctaatgtctcgaggccacacgtcaagactgactgccaaagtccctgctgtggtataattctgaaaactgcattacagatagtatcaacatatagctaagtaacttacagtgttccttttagaaaaatggaattgacaaaagaatctttctttttcagtacttga

SEQ ID NO: 46342 - DNA, 2214 bp, Oryza sativa
atttaatggacacagatcaagaagcttcaatgctatatcttcttttggtataaaagaagcttcaataggtagtgcacgtggggacattatcagcaagtcgtggacctctaatcgcaattccagtctacttggtccacgaacaaggcagtgggttcatgtggtctgtgggttgtggacacctggtacaaaatgcccaaatacaatcacaatgagtgcttttgatatatcaggggcttcacctgccaaaagaaataccgtgagttccctacatgcatattcttttgaacttcattgaaaatatgtttcctgtaaattgaaagtgcatccaatgccaagtgctggcattggccatgggtttcctttcatcctgcacccgattatttagtcctaatgaacttaatcttcattattgctaatgtttttgttgtcaggaatgctcaatgtgtaacagaactgggggctcatttatggggtgtcgtgatgttaattgctcagttctctttcatccttggtgtgctcatcagagggtatgatatccactcataataagctatttgacctatatattatcacattgatttactgtatgctcataagaaatattctgcaatcttggttaaaacttattgttatctcaacactgtaaatctgaatgttgctcatgatatcacaatagggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtaatatatttgttttacctttgtactgcttgaaaaattagaatcctaacaagtgacaacttcctttgtcattcttctgaaacaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacaggtaacttctaatccttcactgcaatgcagttggttatcttcaatatagtacattgtaatgtactctgctttagcggggtatcaaagtttgcatgtacatactggatgagctgtttacatgtcttcattctcatttttagaaggaatatgtccactacaagcagttaaagggatggaagcatttggtagtgtacaaatctagcattcatgggcttggtctctacacatcggagtttattccacgtggctctatggtaattcatcagttattctttccttagtcgataatctgacacaagaatttagcaaatgaagaaattgttaacttctgcatgaaaatatttcaggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatcaaccactcttgccaagtaacaaataatatgctcatctgtgtcttttttcgtccatctaaaactgaatgtttctaatgcatgttttgttttcttccaatctttgctggatcagccaaactgtgtcgcaaaaataatctcagtaaggaacgagaagaaggtaccccttttctttatttcgatgttgtcgtttcaaaatattcgccccagccctctttctttcctggcaaatttatctgtttctattctaatgtgtttttatcattgtccaggtagtgttcttcgcggaacgccacataaatccgggggaggaaattacctacgattatcacttcaaccgagaagatgaagggcaaagaatcccctgcttctgtagatcgagaggctgcaggagatatctgaactaagatagtgtacttcggtcgtatgtttgtagtgctgtttaaacattgtaatgtgcgcactgtatatatgaataaactgtagggacttaatctggcactgataatttagacatccaaacttaaatttagaatggatttagaattaatttagacttcctctcccgtgctcggcagcaaaattggaagctacttgcccctgctggagaagccactgaccttgatagaacccgtaactcggtgattt

SEQ ID NO: 46343 - DNA, 10549 bp, Oryza sativa
atctcagaatttcgaaccatgtctgttaaatctgaatgatgacggaattgtgaagttttcagtactttgggaagaaggtcttgaggtcagatttgtccactggaagccttgttgagatggcctcaatttgttgatccctacaatgatgccaggacatacattttacacacttcaaacaacagtaattgatcaaaaaattcattggcaaaacagacagattaaaacttacgaaaagttcaagtttcggttggtggatgacaactcagcctgaatccttgaaagctctttctttgtgttctccaccaaaaccttcagtaagttcagatacaaaaagctcagttcagtccagtaattctgaaactaccaagtaccaatcaatggacacctgcacaatctgtttactgaaactaaacacgatggagagatcaaccactttgcaataccttatcattcgctaaatcggaagcagaatcatcgtcgccggtggccgtattcagcttcttcttggctctctttgcatccttggcaacagccgggctcgcctcaagccggcactcactgtacgaagaccgcggcgcagcgtgctccggccgctcaccgccggccgtcgcctcatcgttgcttgccttcttccacttcttgaggccatcgaacccccacgaactcttcttcttgctctttgacgcatccttctcctgatctgtgccttccatggacgccgccgggggctccttgttctcgctgccattgccgccgttgtggaacatcgccgtcaggtgcctcctcttccccttgtcggtcttggcggtgggcatggcttccgacggcgagctctcggccatgaggacggatggggcgttcttgctgttgttctggtcgacgggggctaacggtggcctcgatgcgtccagctccttcttgcctctgctcttccatggcgggacgaaggccttgtgcttcggcttgtcggaggccgccgcggcgggcggcgggtcccggaggtcgatctccgaccactcctccatggaagacgacgaggctggtgccgccgccgaagccgcgccgccatcgccgacgtccgcgtcggggcagtcgaccacgacaccgaacgccgcgaggcgctgcacgagtgggctcttggtggagttgtactccgccgccgagatgcacttggcgtacaagagctcctgcaaaaggagaagggagaagcgttcgatcaattgctcgctcggattggagggagggaggtagaagaagaagaagaagaaggcgatgcgggtgggtagtacctggaggaagaggagcttgtcgcggaggatggcgggctggtcggggtgggcgggcgggggcggggcggcggcgagggtggcgagcatgtcggcgcggaaggcgtcgacgtcggagggcgggacgatgccctcgcggtggagcgcggagaggtggaggatgcggtggaacgattcctgctgccacttgagcgcgtcggcgtggcgcctcgccgcggcctggtcggcggtgaggcggcggccggacctgaagccgccgaaggggaggatggacttgcacagcgacgcgatggtgtcgtgcaggcccgagtagtacgtcggcgtgtacgtgtaccccatcgtcgtcggcgactcgtcggcggcgagctgctgctgctgctgctccggtggctgctcaggcgaggcgaggaggggagcgtgagagagagagagagggagatggtggtgagagagtgaaggggaacgggttttgttgggctacggcccaacggttggggagaagggaggaggaactagccgttgagttgaatctgcagctgcaagtgggcccgttcgccacgaggtcaagaagcttcttcgcctaacatgttgatctcagccgtttaacgactgatccaatggttggtcggggagacatcacgtttaccggagtatccgatactatcatgtaaattaaagagcaagtgatccctctgttccatatttttccctatttaaattttattaagcttgatcgagttttaaaaaaaatttagcaatatctaaaatatcaaattaattttattaaacctaacattaaatgtgtttgtttttttattaaaaacactattatatttttctataaacttgataaaatgaaagaaatttagttagaaaaaagtcaaacgacttataatataaaatagatgaagtaaaaaaaataagggagacgaagatacaacaattcatcaattcaaaacacgaagatcgattgttgaacagatatatgcgtaggcaagaaactgcaatccaatcgtccagcattcacgattgtatgtattccacaaagaaatgccaacgtaatcagataactgtgagtgagttcagtgattttcttgaacggaataataccagtttttaacttttgataagagcgttgagccacaaagctgaaaaccatgctgaaaaccatttgctggatactgctttcatcccatgaatatagcaatatatatagtactatcagataagacattataaaactatgaatatataaattaaattagtttcattaaatataacatcgaaaatattttgattatatgtttgctttgtgttgaaaatattactatatttctctataaaatcaaaacgacttataatatgaaacgtccctccgttttttaattataagtcgctttgatttcttaagtcaaacttactagaagtttgatcaaatttatagaaaaatttagcaatatttatagcaccaaattagtttaactaaatctagcattaaatatatattaatagttttttgtgttgaaaatattagagaaaatgcatgtgcgttctaatgtgttgaagcaattttaatctcacacattatttgattgatgaaaataggagtcctcctatgatttttgcatcatgcaaaacctatacgcatgcatgcatgtattgataacagctagatagacagatatactgacatactgtagtaatgtctggctaaacaatttcattctcagaagatagataggattcacaaaccgcatgaactagacgtacgggctccgacttagggtccaaataggatttagtttggctacatctttatttttttttctctttcataatcggaaacctgactctagtatcataccttctattcatcttcacacatagatagtttttctatctaaaacgaataaacttgtgtgcagatcgccggccatggctaccgtcttcccctaccgttggactaaaaccaagcatctcaccgagcgtccacccacccacggccaccctcccgacgctcacccatggatcgtcctcgacgtccgcgcctacatcgccgaccgccagaacgccaccaccgccaccacctctctcaccagcggccgcaagctccagatcaccatctgcgccgcgccgccgccgctcgtctcctacgtctgcgcctggtcccccaacgccgaccccgccctcgtcttcgccaaggaacccgtcgtcgcctgcgtcaacgccgacctcgtcttcctccgagtccacagcgatcaagtctaccacctggtctaccacgccggcggcggtggtgacagccgccgccgccgcccttcgctcacgcttgtccggcaccccgaccgccccttccatcgctgtcattaccttagtgagctcggcagcattgccatcctctcccgccgccgtgccggtgccggtgacgaccacgacgacgactccaccggcttctatgtctgcagtcttgatcaggagctatggtatgggttacctggacaacgtggccacttcaagctctgcctctacgactccatcgatggcgaatggagccaggagacccttcgtctcgaccagctgcgcaatccgcaggacaaagacaccgttttccattacacggagaaggtgattactctgcacgatgaacaggtagtggccttcgttgatctgtggcgaggcatggtcatctgcaatgtcaacgatggcacctgcaacaacgtcgagctcctgccgaagctgaacggtctccctgccatggataagctgcggatagctcgtcctatgctcagcttgatggattcgcatgtcgtttacatcatgggcaaggtcaatctctccggcgagaaggcggtggtgctcactgttgacatggccaacaagaggctgcaaggggtatctctgcgtgacgctgaaaggatcgtctacgatgataacggttgcagctacaaacagtataccatctcccaatatttcactacatctgcaggtgattgattaatccctggcctgtttttttttcctacttattgcttttcttttggagaaatcttgtgtcgaactgacgagacctcacctgctttcaagaactcggctcgttcgtcatcaacctccctctcctccaagaatttcttcaccaattccatctccttagcctcaacttcctgcgaatctttcacagcaaacaaaccgcatgaaccagagcgcaaaatcacaaaaatgtccgtacgcgaagtttgtgtgtgtgtggtggggggtgctccgttgccggcgctggatcaggacgagttcgtcgtcgaagcgagggcgcgtcgatcggccaccggcaatccgattctatccaaaccatcttccgccgatccgatttacttctcccctccgactccaacttgcattgctgacatcgattcggatctcgatcttctccgactccgaatactccacgctgctctactttaagcccggccggacgatcgccggcgggaggagaggccgcagccatggctaccgccttcccctacagctttacaagaaccaaacacctcactctctgcccgcccagcagccacggtggggatgcggccgatcacgggccccttccatggatcctcctcgacgtccgcgcctacatcgccgaccgccggaactccaccaccgccaccatcgtcttcagcaacggccgcaaaatccagatcacattctgcatcgcgccgccgccgctcgtctcctacatctgcgcctggtcccctgccaccgaccccgccgtgttcttcgccaaggagcccgccgtcgggttcgtcaacgacaacctcgtcttcctccgcgtccatagcgatcaaatctacgatctcatctaccatgccagctctcgcccatctctcaagctcatccacaacccctacagcccctacaacccatacgactaccttcgtcgtatcgacaacgttgtcatcctccctgaccgccgccatgccgccggcgctgatgatgatgacaacaacagcggtcacttctatgttagctcgctcgatcgggatcaccgcttcgatattggccacttcaagctctgcctctacgacgaagacgattccatggactgcaaatggagcaacaacatccttcttcttgaccaactccgcaatgcgccagacaaagatatcgtgctccatttaacagagaaggtacttatcctggatgatgaacaaccactagtggccttcgttgatccctggcggggcatggtcatctgcaacgtgctcgacaacagcagcacacctgggggaagcagctacatgccgatgccatccgagatcttcaacatccacaacacctacacttcatccatttcccgtgacattgctatcgtcaatggccgtctcaccgttgtcaggctgtgcctttacctcgattcagatgatgattcagacgatgatgatgacgacgattgctgcgcttgggatctgaccacatggagcaagccagtcacctgtttggatgatgagtggcgtgaggacttgaagatcaagtccagtgacgtctcgattgacgacagcactcggaacgcctgcctcctgcccaagctggatgatggttgcccaacaacggagacgctccagttagctcatccaacactcagcttggtggacgctcacattgtttacatcatgggtaaggttgacgtctccgatgagaaggcgctggtgctcaccgttgacatggcaaacaagaggctacaagaggtatctatgtatgacgccgaaagaattgtaaacgattttgattatgcctacacgcactctaccatctcccagtatttcactacagcagctgcaggtgattgattaattcctagccttgttttttttttctacttttgccttttcttttggggaaaccttgtgatgaatatgatagtaaacctaattcaaagtagtgataggggaaactattttgatccctcgaggggatatcaatatctttgtcgtttgcatgttactcaaatggttattaaaaaatgtgaaaaaatttgagaagatgtattaacgtgtgatatatcacgccacaaacattcaagttaaaattcaatttttacatctcgcaaggaaaaaaaataaattaaactatacaactagttaatgtatattcacagacaaatttatttttttcgttgcgagatgtagaagctgaatttgaacttgtatgtttgtggagtgatatatcacatgttaatacatcttctcaattttttttaatttttttaaaacaatttgattaatatgcaaataatgaggggatatcctctcaaggatcaaaatccactcccgttgaccgttgtgatagctgatatattgtgtgtggctgctgctttagtgctagctagacaagttgaggccgtaattagtgtgaacctcgccaaactctttattacccatctaatcatggaagccgtcggtgagcttccaaacaagttatagagtacagttccagaaaagttgtaaatttcatgagaattaatgcaagtcatgtgggacacaaacccactcaaatacaactgcggcatattggattgaaaaaagtacgaattacctctctaactatcaaggtcgaccgaaatacacctacaaaatcgaagaccagatattctacacccccaactattgaaaccggataaataccccgtgtctcaatccggagcggtcccacatgtcagcctccacctcatcctccctctcttaagaagctagttggccccgcatgtaagctgctccctcttccttcgtctcctggccgcagagatgcctgtgccgcctccaggctccagggacccgcaccgccgccgccaggcacctgcgccgccgcactcatcttgaagcccgcctccttcagtcggtcgtcgtcgccgttgctcccatccaaccgctggagagagagcgagagaggaggggaggggaggggagaggagagagagagagagagagagagagagagagagagagagagaggagaaaagagatgacaaccggcggcggcgacaccctccagggcaggcgggtaaagcgacagactccttcacttcggccaaggacccccgccgcccgagttccgtcggagtggccccgtctccaccaccgccgacgccgaggtccagacttcgctcccccctgctacgccgtcgccagaggatggatgctgcttcaccgcctcgatttcctccgccgatcccatcgtcaggaggccaccactgaccgcgccagcaccggtctccatcgccgctaggccgccgcttcaccacgaccgccaccgctctgcctggctgccgatggcctctcctctcccttgtgccacatctccgtttttctctctgcctcccatccgcgcccgccgccgctcgccgccgaccgttcccctccccgactcgcccgctgccggccggagccgcgcccgctgccgctctcccagccgctcccgtcaacgctaacagcatcaacatagaggatgggagggcgccttccacctccgccaccggctgcccgggcgagctccgcctccgcctcagccgcccgccgctcggggagctagctctgcctccaccggcggccgcccgctctgcctccgcctccgaactcgaaaaccgaggagctccgcctcagccgcccgccgcccgaggagctccgtctccgccgccggtcgccccctccgccttcgtttcagccaccgtactagtgagatggtgaggggagggaggagagagagaggggtggggatctgacagtgggtcccactaattttttttaagagagggaggatgaggtggaggttgagcaggatgttattttgaccggtttcaatagtaggggggcgtagaatgtccggtttttaagttcgggggtgtaattcggtcaacctcgatagtttagggggtaattcgtactttttcctattggattctagattgtctttatagataaatatttttccctgtcagtgcacactatatcaataacatgcacataaaaaaagtgagcatttaaaagaaatggtcggaaatgaaaatagaaacaagatttccgccccaacaaggtagaaagagaaaagaccattttaggtgctattgcatgcgtgaactaaattggttgatactcttttttgtttgctcgaacacattggtgatactctgataggaggacttccattttggtcaccctcgtcgcgtgaagggttaggcatattaatatattatatatgtactcctctgtttttaaatatttgacaccgttaactttttagcacatatttaaccgttcgtctttttaaaaacttccgtgtaatatgtaaaactatatgtatacatataagtatatttaacaatgaatcaaatgataggaaaagaattagtaattacttaaattttttaataaaacgaacggtcaaacatatttaaaaaaattaacggcgataaatatttagaaacggagggagtaatacgtaggctatttgcgctgacacatggggacttttgttttgctgggtgcaggtgtaaagggaagcctgaagagacctttgaagtttcatattcaatatcctcacaagcggttgggtgaaacaatcaataggagcgatcctatggacttgcatgagccattgcaactggatgctggatctgacatgggaactacagacggaactgaaggcagcgataatcctatggacttggaatagccatgccttttgagtgaaactaaatgggcataaattaattagagctgttgagaatcatgtccgggcataaattattatagattaatttgagctgttgaaaatcatgcccgggcataaattaagggtgtgtttagttcacgaaatgaaaatttttgtgtgtcacatcggatgtttgaccggatgtcggaaggggttttcggaaaaaaactaatttcataactcgcctggaaaccgcgagacgaatttattaagcctaattaatccgtcattagcacatgtgggttattgtagcacttatggctaatcatggactaattaggctcaaaagattcgtctcgtgatttccgtgcaaactgtgcaattagtttttttatctatatttaatgctccatatatgtgtcaaaaaattcgatgtgacgtttttaggcaaaattttttagtgtagctatatttatggcgccatatttttcatcgaaaaatagtcggcatgtatttacattttaagtccctaaattacatatgtaattttagtgtatttacaatgtaagtctcaaaattacatatgtaagtactaaaattacatatgtaaattcgaaaattacatactaattacatatgcaagtggggtgtaaatgaggtgtaactacggtgtaagtggctaaaaaaaaatcgactgtaacatatggcgccatatttctagcaactctgaaattttttggaactaaacaaggcctaattagagctgttgaaattttgaaaatcatgcatgccccgttatgtattttggttgttgtgcatgactgcatgtctacattttagatttgccttgaatggatatgtttatgctcttgttggactgtatttgatcgttcagatcgagagttgtctttggagcgtggtgttaacatattgatttcatctataattctgtttcagaaatattttttcgtactctacaattcagaaatagcaggggaagcccactgctttccattttcttgaaaccagaaaatagagtttgagggtggtcgttcgccacgacttgacctccttcgccaacgaaatgtaatcgccaattatgcataacccataggctgatctgatcaggaaagaagattattgctagtggcctttgccagaaatcaggctatcgtcaagcacaagccactaccggcgataatacaaccatagcaattcaagataagcagatccgattttaagcacctccgatcgatgaaatcgatttacttctccccctccgattccaacttgcatcgctgacatcgatttggatctcgatcttctccgactccgactcgggatcctccacgctgctctactttaagcccggccggacgatcgtcggcgggaggagaggccgcagccatggctaccgccttcccctacagctttacaagaaccaaacacctcactctcagcccgcccagcagccacggcggggatgcggccgatcaccggcctcttccatggatcctcctcgacgtccgcgcctacatcgccgaccgccggaactccaccaccgccac

SEQ ID NO: 46344 - DNA, 3798 bp, Oryza sativa
cgcgccagacaaagataccgttctccatttaacgaagaaggtgttcatcctggatgatgaacaaccactagtggcctttgttgatctctggcggggcatcgtcatctgcaacgtgctcgacaacagcacaccagtgggaggcagctacatgccgctgccaccggagctcatcgatgcccgcaggacctacaattcatctgtttgccgtaacattgctatcgtcaatggtcgtctcaccgttgtcagactgagtctttacctcctcgattcagatgatgacgattcggacgatgacgattactgcacttgggatctgaccacatggagcaagccagtcagttcttgtttggacgatgaatggcgtgaggagttcatgatcgagtccagtgacgtctcgattgacaacagcactcggaacgcctgcctcctgcccaagctggatgatggttgcccgacaacggatacgctccagttagctcatccaacactcagcttgatggacgcccacattgtttacatcatgggcaaggttgacgtctccgatgagaaggcactggtgctcaccgttgacatggcaaacaagaggctacaagaggtatctgtgtatgacgccgaaagaattgtcaacgattttgattacgcctacacgcactctaccatttcccaatatttcactacagcagctgcaggtgattgattctcttttttttttttcgggaatacgccagtgacgcatttttcacattatgagaaataaaagttatttacaatcaaagaaagatcagcacgggacaaagttattgattcattcctggcctgtttttttttctttctgcatcttgtttttcttttggggaaaccttgtgatgaataccatagtaaacctgattcaaagttggctctcataggactttttttttatcatatcatactttcataggacttggcgtgaagggttaggcacatgtatctgtaggctatttgcactaacacatgggcacttaatttgttttgccgttttactggtttgcaggtttaaagcgaaacctgaagcgacctttgaagttccatatacaatatcctcacaagcggcagggtggacctggttcgaaaattagagatgaaactgaagatgggaataatcctatggagttggattaattagtatacgaattgcgatacaaccaaccgcatacgaattgtctgtattcaacaacaaatggtagtgcaccagagcaccaatataatcagatgagcgtgcttagtgattttctcaaatggaattgcagtttttctactagaactgagccactgaataagctaaaacccatcttattactagagtcatacatggcttgaacaataggattgagctgttgaggtggataatttacatggcatgtatgagagcaacttttaacaccacttcccagaggcctgcagccttagttttcagttcccacaggttgaaactatctccaaagtcttgctgataccagcaaggaactcgaacattcagacttcaaacattcaggaaatcaaattacaatgacaaatggataagactgattgctaattctgggtaatgaattataaaagaactagattggctgtcgatattcctactcaatttgaaatatcacactccaaaatgtgaacaaggtggtcaggcacatatagttaccgaatttctcattccagtgatgtaaacttatagatgaaggtcacttaaaacatgtccatactcctgaatttcgtattggattattggccttgctataagttaacaatgctaacctacctgcttgggtaaaagggttaacgtctcacactaacagatacattatttaagaaactgcatgttccatactggagtatgattgataggaagaaacctcagaaccaacatctgattgtgtaactcagtatacatttagtgcatcaataacaatgttctaaaacaaggtctacaaggccgcacaaaggaatggatcttaaccttgtactgcttaagccacacaataggccagctatgccatgtaaggcaggcgacaacacataacccttgacatcttttagaatcttgataaaaaatgatcaaaggaattgaatttcctagtactacctgttctgcagtctacaggtcgtatggctcaactcaacagaaaagggaatcaaggcaaaatgtccagggtctccaaaaatcaaattttgtggtgactgcaaaattgacagccataacttattgatctattatctctttatccatttagactagtcaggggtaaactcatcatagacatcaagaaaatttaagtttcaaaatctctacatattaaaatactacacattttgtctcacttgtaatcagcgattatttcttacctcctcaccatttctgtactagagttaagactgtaaactatgctgcgtctttgattaggctggcaatccgtttctatccaaatcatctttcgccgattccaacttgtcttgattccaaatcatcatggttaaggtgtcaaaaaaaatcatcatggttaaacctctccggctcctctactctgctctgctctacttaagctagcccggccgggcggacgatcgccggctggaggagaggccgcagccatgtctaccgtcgaccactacatgtggagtagaaccgtcgcctggagtatatttgttttcagttcccaagtcatgcggataccagcaaggaactcctgcaaatgcagaagggagttcagacttaaaggtttcaggaaaccaaattacaacgacaaatggacaacactgattgttaattcagggttaatgaattgataaaaaggatgaacaagactaattgttgatgctccaaaaatgtgaatgaggtggtcaggcaaatgtcaggaaagtataggttcagtcaattagctgcattacgtctcaagctcaaactcagtcagttaagactgtataaaactcacctgttttcaagaactcggctcgttcgtcatcaacctccctcccctccaagaatttcttcgccgattccatctcttcaacctccaacttcctgcgaatcattcacagcgtacagaattcacaaaccgcatgaaccagagcgcgaaatcaatcgacctcaactcgacgatgacgctgaggtggatgcgcgggccatgccatgctcgagtgacccgacgcggcggaagatcgtgcggatcgtcggtcgccggcaatccgttcctatccaaatcatgtttcgtcctccgattccaacttgcctgtgattgctgagatcgatttgcatgtcgtctccgactccgactcctctactctgctctacttaagctaagcccagctgggcggacgacgatcgccggcgggaggagaagcctcagccatggctaccgtcgaccgctatatgtggaataaaaccgaacacctcactctgcgcccgccctgccatggcggggaccctctggatgcacaccagcctctaccatggatcctcctcgacgtccgcgcctacatcgccgaccgccggaacgccaccaccgccgcggccgatctcggcaatggccatcgaatcgagatcaccatcttcaccgccccaccggcgcaggtcttctacatctgcgcctggtgcccgaccggcgaccccgcccggatcttcgccaatgagcccctcgtaggctgcgtcaacgccgacctcgtcttcctccgcctctacagcgaggtagtctacgacctcgtctaccgcgccggtggccgcccttcgctcacgctcatccgggaccccgtcgacgtcga

SEQ ID NO: 46345 - DNA, 11258 bp, Oryza sativa
ggatcatcaacgactttgattactcctacacgcagtctaccatctcccaatatttcactacagctgcaggtgattacttaattcttgcgctgttctttctacttattgctttttttttcggtaactttgtgttgcatacgacagtaaacctgattcaaagttgtgattgctgatgtattttaaacctgtgtggctgctgctatagtgctagttggacttgttagtttaggctggaattattttgaacctcgctagactctttacctctctaattatggaagcctttggtgagattctagacaagttatagagtacagttccagacaagatgtagagagcacatgacatgcaagctatgtggaacacaaacccagtcaaatgcaactgcattttggattctagattgccttcatatgaaaattttcttgtcagtgcacgctatatcaagaacatacacataaacaaagtgagcctttaaaagaaattgtcagaaatgaaaacagaaacaatttttctgcccccaacaaagtggagagagagaagaccattttaggtgctcttgcattttttaaacattcttgaactaaattggttgatgctctcgtaggttttctttttgtcatactctcatagggcttgggatgaagggttaggtacatttgtgtgtaggctatatgcactaattcatgggccctttgttttgctgttttactgggtgcaggtgtaaagggaaacctgaagagacctttgaaatttcatatgcaatatcctcacaagcggctgggtgaaacaatcagcaggagcgataatcctattgacttgcatgagccattgcaactggatactggatctggtatgggaactaaagacgaaactgaagacagcgttattcctatggacttggaatagccatgcatgcactaaacgggcataaattaattagagctgttatgaatcatgcccgggcataaattattataaattaagttgagctgttgaaaataatgcccgggcataaattaattagagctagctgttgaaaagcatgcccgttatgtattttggttattgtgcatgactgcatgtctacattttagatttgccttgaatggatatgttcatgctcttgttggactctgtttgatcgttcagagagttgtctttggagcctggtgttaacatattgatttaatttataattctgtttcagaaatatttttttcctactctacaattcagaaatagcaggggaagcccgctgctccattttcatgaaaccagataatagagtttgttgcggagagtggtcgttcgccacgacttgacctcctccgccaacgaaatgtattcgccaatacgcatactccctcctattctatattaattgacgttttggacatagttgagatcaaatttttataactttgaccattaataactttaaaaatatttagtttaaaacaactaaaacaacatatatagatttgttttttaaagcactataataaaagtaaacatacatttatttattgtatatattataatagaaaaataaggtcagagatatattttgtaaaccatgtcattgtccaaaacgtcaattaaaatagaatcggagggagtagttcatatgctacagatcgatctgagacgtccaccgcctgatctgatcaggaaagcagattgctcgagtggccttaccagacatcaggctatcgtcaggcacaagcaaatcaccaccggcgataatacaaccaatagcaattcaaaacaagcacagtaggagatctacttatattgtttaaaataaaaatgaataggcgagcaattgccatacaaccaaccgcataagaattgtctgtattccacagcaaatggtagtgctccatagcaccaatataatcagacgagcgtgcctagtgatcttctcaaatgtgactagaattgaaccacagaatatgctgaaaacccagctcattgctagagtcatacagcacgaacaatgggattgaaccactgaggtggataatttacatggtgtgtaggacagcagctcttatcatcacttcccagacgctatttgttttcagttcccatagtttgaactttgaaataagtccagagtcatgcggataccagcaaggaactcctgcaaatgcaaaatggagttcagacttcaaaggtttcaggaaaccaaattacaatgacaaatggacaacactgattgttaattcaggggtaattaattgataaaaaggatgaacaagactaattgttgatgctcctacttgatttgaaataggacactccaaaatgtaaatgaggtgatcaggcacatatagttaccaaatctcattccagtaatgtaaactgcttactgatgaaggtcacttaaatatgtccatgctcttggacgtcatattggattgttggccttgctataaattaacgatgctaacctaccggcttgggtgaaagagttaatatcgtttcacactctgacagatacattatttaagagactgcatattcatccaccaaaactagaaagaaactgcatgttgcatactagagtatgattgaatattgataggaagaaatctcagaaccaacatatgattgtaacttagtatctttagtacatcaataccaatgttaacataaggtctacaaggtcgcacacaaggaaagggatcctagttcctaaccttgtactgcttgagccacaatatgccagctatgcccacattatgccagctatgccagtgatgtaaactgcttattgacgaaggtcacttaaatatgtccatgctcgccttactagaaactattgggaacttatatatgaaggtcacttatagattattagccttgccagaaattaccaatggtaacctactggcctgtgtagaagggttactctgacagatacactacctaagaaactgcatgttcatccaccaaaaaccagaaagaaactgcctgttccatactctgtatgattgataggaagaaacttcagaaccaacatctggctgtaactcagtaccctcagtgcatcaataacaatgttctaaaacaagatttacagggccgcacaaggaacgggatcctaaccttgtactgcttaagccacacaataggccagctatgccatgtaaggctgtaagcactgcaatgcaggtgacaacacaatagcccttgccaccttttagaatcttgataattgaatgtcctgcctactctagtaccacttgttctacagtctacaggtcgtatgactcaactaacagaaaaggaagccaagacaaaatgttcagggtctccaaattttctggtgactgcaaaattgacagccataactttattgatctataatctctttctccatttagactagttggattaaactcatcatagacatcaataaaattaaagtttcaaaatccctacctatgaaattactgtatttttccttactagtgatcagcaactatttcttacctcctcaccatttctttactacaacaagcattgcggaggaaaacaggttcagtcattaactgtagtagggttttagctcgagctcggtcactcaaagagttaagaactagtatctgtgattttgtctgtgtgcttcttctcgaaagcgtggagccaagccaagccaagccaaccaagggattggattccctgcccatcccttccaagttattaactgtaaaactatgctgtgtctttaatctcatagttctaaatgtatctacgacgaattaacaatctcacctgatttatctgcttctcctgtgcctacttctcgacgaatgattcgacagtcttcaaccaccggagaagctccatcttttccttgttcgccatgtagtcgtgcaagaactcggcaagctcgtcatccacctccctctcctgcaagaatttcctcaccgactccctctccctagcctccagcttgctgcgaatcattcacagaagaggaacatcatcacagaccacataaaccagagagcaaaatcacaaaagcttccgtacacgaagtcgcggcctccgctgctggtgctggagccatcggcgtcccggagagtgaggacgtggcggacgacgagttcgtcgtgccaggcggagcagatgaagccgaggacgcggtccgcccgggagacctcgacgatgaggctgaggtggaggcgcgggccgcgctcgagcgactcgacgcggcggaagaggggcgcgtctgggggcggggcggcggcgccgtcgaacatggtggcgtcgaccttgacctcctcgtcctgggcgccgcgggtggcgcggaggcgcacccactgctcccccgggcggtcctccaccccgaacgatttgaaggccttcggcggctgcaacgcattcgtttctcggcgaatcagagaagacacacacacacagagagagagagagagagagagagctaagatgggggataggcacgttaggatgagaggataccgggtagggagggcggcgttcggagatgtagttgatctcggagcgcaggaggcggaggaggcggtcgtccatcggggagcgcagcggcgcgacgacggtggagaaggatggtttcgccggggaggaggccgcggcggcgagggagagagcccggcggactagggcgcgcgccatgtgttcgagcttttgcctctgcgaagcgtctgcctagaggcgagggttggttgaaggaaggatacgacgacgcggcggcggcggcgacctgacctgggctgcctaacattgcggcccgattctcctttgtggaatagaataagttcactagaggtcccttgatttgtcccagggtctgacagtcatctctgaaccgaaattctccactagctcatcctcaacttaccacatcatgttgagggaattttaagttcctgaggtatctaaatttttcataactcctctgaaaattgcgaaacgtatttattaaacctaattaattcgccattagcacatataggttactatagcacttatggctaatcacatgtgggttattatagtacttatgactaattatagactaattaagttcaaaagattcgtctcgcgatttatgtaaactgtgcaattagtttttttaatctatatttaatgctccatgcatatgtccaaagattcgaagtgacgtttttttggcaaatttatttgaaaactaaacaaggccttaggcttaacactatgaacaacggcgtgctattaggaaaacttccggattcggacctattttcgaaaatggaatctgtcggtcggaattttttcgaaaacggaaacgaattcggaaatattttcttggaaactgaatcggaaatgataagggcagtttccgtcggaactcggaatcggtccgaaactttccgaaaattttctcagaagtactagaaattttgtgactaaaataccctggattctttttttaagcactaaatagtgaataccatggtgtttggctgttatttttataaaaaatatgtgttatgcaaatctaaaattacataagaatattttttgtcctacattggaatttatcaacaacattactctttcaattggatttatcactttgatgggttttttatttcgataaattttcgttaccgtattcgcgccggttcattttcgctccgttttcggtttcgataatattcgattccgttttcgtatccggggtttccgatttcgactctgaaaaaaaatatgaaaacgaaaacgataaagatggtttccgtccgtttccgtaccgttttcactcctacgtgctatgccgcatatgggaggcagtctggtcaccttgcgcccaacagcccgccagctgttcgacgcaatgccccaaccccaacctcttcacctgcaacgtccatctctcgctactcatccctctccgtgtccttgctggacgatgatcgaatatttggcgcagaagcagaacgcactggatgttttcaggagaatgagagcacagcagcattggtcaatacaagaacatactcagttcacatatttttcatgttccaggagaagaacaataagagtacatcaatttgtggatgctttcttggtagaggagtggccaaccatgtaggagccgaacccccatacggtgatgagcagagacaggatcttgaagccgctcatggggtcatggaaccagatcaccgccgcgatgctcgtcaccggcaccctcacggcgttgagcacgccggcgaggacggtcgacgccaggaacagcacgccggtgccccccagcaccccgagctggaacgtcaccgccgaccacaccatcaccatcgcgtacgacgcctcgccgtgcctgaacgccgccgcctcccgccgcatcgccgggaagccgccgccgctcacggcgagcccgacggtggtgaacgcgaaggcgcagagcgacaccatcgcctgctgctccagcacgacgtggaacgacctccggccgaggacccggacgaacaccagctccgacagcgcgaagatgaggccgtggagcgccgacccgagcacgtcccagacgagccccagcgcgtactgcctgcccgtgatcccggggtacctgtccgacccggagtccagcgcgatgatcaccacgccggcggttatgacgacgacggcgttcagcgacgacagccgcagcctgttcttcgcgatggcgcagccgaacagcgccgagaacgctagcgacgacgcggcgacgagcgacgccgtggacgccgggaggtaggcgtaggcccaggcgtacatgaggttgtcggcggcgctcaggaggccgagcagcgcgtaccaggcgcacagcttcggcgacagcggcgtcggcgccgccttgccggcgaggtagcacggcagcaggaggagcgccggcagcggccagccggcgacggcggaccacgacaggatccacttgctctgcccgccgttgttgtagtacagccgcgacaggaggctcgacgccgggaacgctgtgagcatcgcgccggcgctgaggacgagcagcagccagaaggacatgggcttgctccggtacgtctccatggaggaggcaaccatcgctgctgccttctgacgcagagagcgatctgctgcctctgatgaggtctcctccattgctgcaacttctactgctgttcatgacagggacaaatattcagaagatttcatcattatctgaataaaattcagaagatttcggattctgtctacagctccagcttggtgaagaggagtattttctgaacaataacgttgtgttaacatttgaaaacatggttagattggtagtaactccagaaataaaacagagtgaatggttgagtgcctagagatttctgcaatactagtatgatccaacaaaataaatttcattattgctaaataacaatgatgttgtttggatcccacaaatccaaaattattttaaaaaaacaaaatataatattacaattgtaccatacttattaatgttttcccaccatatttattaattcttcatgacaattgtaccatgcataataacattattgtataaccaaacaaaccttcttttgtgtttgtttccaggtctgcaaaacttttgaatttttttttggaaataatacgattttaatgaaaaatcgtaaaaaatatatgtcgattaggtgaaatcgagcaccctatcgaacaaccgtagttcgataggacacctatcagttcgacaggtaataaaataatttaaaaaaagagaaaaaaacattgtagcatcactgtagcatcatccctgtcgaacactgcctgttcgatatgtcctcctatcgttctttgcttgcttgatatgtctctgcgtactttttaaatttttttttcttgaccaactaccttgttaaattgccacagttcgacaaatacccgtcgatatgcagatgttcgataggttctcctgtcgaatcgtggttgttcaacagggtactaaacttgcgatttcgcctaaccgacctatatttttgcaattttccattaaaatcgtattatgtaaaaaaaaatccaaaactttcggcatgcaggagacaaataagaaaaaaaaatacgcgaaaatctgctacaggaaaaacacgcacacaattgtcatggccccgcaacaacctcaacaattctcatggcacatcagagtctccaaaatcaagaaacaaaaatagaagagttgaattaggactgcgacatcaactttgcaaagggagtcagcttcaagtgaaaaaaaagaagccttttttttgaagggttgttaatttttacagtagctaccaagctcaagaagcagtaatactctactcccaaataactcagaaaatccttcccaattgaaggtacacacaaaacgtagtgccatggccttcttttgtcctaaaactacgcagatgagcacgaattattcacaccgacgatgagaattggtagaatcaagggaggaagctcactaggttttgctcggcaattaggaaaaaaaacagagaagaaaagaagaaggacagacctgacgctgggacctggacgacatgatgatggcgtccctcaccgtcgccgtcgccgtcgcggtgctggttcctctccatctgccgccgccgccgtcggtcgcggagtcgcggacagctagggaggaagctacactctccgggtctcccagagaagacgacgatatgattattgatgacttgctggaacagccaagccaacagacagcctcctggtgatacgtctacgaaaaccaacctgaactctggtctggttcgtgcacgtcgctcgctcgctcggacgaattttgtttatctataaataatctggtggtcgtagtggcacaaatttttcatcaaagtacggaagtatatttaattatggaaggagaattagtactttattacccccgtttccactgaagtgttgaccgatacggcgcgtttcagcgtgaagaaagggagcgcttttttttgggcgtgtgtggtgtccgggttgggaagctgcccactccacaaagaacacgcgaaacaactgaaaaaaatgttacatctctgaatctcacaaaaagcgatttaaaaccaagtagtactagttaactaattaaggtcataccacctacaactttaattatcatcatcttatataaggaatatcacgttctttgtgtgacgcctggtaaacaaaataatataatataattacaagctgcaactcacaaaggcttcattgcttctggaggtgcgttgttttcgtttcattgagctggttaatgatcaggagttggcaggtgacgaagctttggaaaaactggagtaaacagtcatattatttgggaaatcaaacattaattaaaaacagtcaggcaacaagcccactatataaaatcatatcagaaacaggatggacaaaacagcaacaacaaaattaggatttcccaacaaatatggagagaatgaagtatttgacagatgtactgtatctagagagcacaggacacagacagacaaccataatagtgtaaaatcgctttgcctcttctcaaaatgaatagtatccgacttcagagtggatatgatacatggtttctagcattctcttcaatacacagctcagctaatgatgctgcgaatgtgcaaataaacacctcaactagcatccctctcttatctctaaactgactgaaaaagaatcacttgggtaatgtaataaattgtgcctgtctatttgtcaaaaatgtacactatacaatgtaaataggaaatttaagacagtttggagatcttgtgttgcctggcatcatcctgccatataaatactagattcttgtgaagcagcaaattatcacgacctgtggatctcacccatatatgtgaaaataggaattggtgtatttgtatctgactctgggggataaatatatgttgatatatgtcatctagcaagaggttcaagctggacctccatcacaccagaaggacttgattctgaattcctgtctgtactgtcaggatgcaaaagatcaactgaatcgtcttcctcggtgttacctaacacccagtgccctctagagcttgtgtcgccgctcctccgtttgacctctttatactccaagtaaagtgttataactatagcagaaagcacccacagcatcaaggcccaagtgagctcctctacattctcgctatcatacctatggcctaaatgcttcattccagtgaaaagtgccacaattccgactatgattgccgacctgcctgtgataacatgaaggtattcccagaggacacgattccaggatgaagcctccccattagctggtctcttgggccggaagtaggcatttagtggctgaagacctgccaacagcagagccgtgacaccaaatttaacatgcactgagctgacataaaaacctctgagttcagctgcagcgaaaaggacaccaaggaacattatagcacttcctgagtattgcagatagacatgtatttggtaccacccgtcacctttcaagttcttcaaataccgggcagccagtattccaccaggaagcaagatgccccaggcaacaaacatcataaacccatgaacagccagaacaggacgcaagtcctgttctgcctcagcagaacctctcaacaaaagcacacgtatggggcgactgcttgtgatagaatgcatgttactatctgtaagactgttacctgaccagcttgcacccatagcccaaacgaccttaaggggcgtggttggatcaataatgttcttacactctacccttccactacaggaaggcctaagaggacgagtaaactcaaatgtaataatgccattttctgacctacacctgacgtaggttaagttctcagatgttgggtggatgcccgctgcactctttccatcaatccagtaactcttgactcgcccaactccatcattgccaacccagccaacataagcataactgttcagcatgccactcccgaacccaacagcaaggtacccacttttcttctcacctcgagctgctatagatatagaatcatgggacagagtccagaacagagtaacctgctgatcatccaaaaggacgctgctattatacatgtcactaaggcctccatcaacaacttgaactttccaacccatcttcggttcatacaatgactggtagtagactagatcaggtgtattccgatcaggcagccaaagcagctctg

SEQ ID NO: 46346 - DNA, 10708 bp, Oryza sativa
catatatgacctctgttttattccgcagtgtagcattcccccaattggatccgacgtgatgtaaagtgcaacatcatgcccagcctgcactgagaacttcactggcacacctctctcaaccttcagcagaggagcctccttcttgttgatgtaaatcaccttgtcagggtttggtgggtttgggtagcggacggctggagcagatgtcaccaccaggggtgtctttgcatccgcgatgatcctctcctgatcctccttgttgtcagcatccaatggtccgttgcagctgtccaccgtttccgacaaattcacccttgcaaacccataggttgtgtccctcggccccccatggttctgcgggaggtagtgtggcctcagagtatccggcggccgcagcttcccaatggcccagacaaccgccatctcctccgtggcactcaccagcacatcatacttggtatccccagtgtcaagcttcctctgatacctcacgaaagacactccatcccgccggtgaccgtacaccagcaatgaatcattcttcccctcatcataaaccttgtcagggcacacaccagataccggcgattcatcggtccccagcgtgcactcgctgtagtcggttatgtagtagtcctcggcgaatggcataccttcctcggtgaatccggcgacggcaacatcggaatggatcatggcgggagaattggccttgggatcagcccacccgaacgccatgtagtactcggagcccacggcggcctcgaggccgatctcgactgtgccggcggaggcattgagcgtccaacggagacggtacttgttctcggcgagagggaggcagttgtcgaacatggtgggaacaggctccggcgacggcgagggcgaggcgacgccggaatcatcggtggcgttggaggcggaggcggaggcggagacggggaggaagacgtggccgaggtcggaggaagtgtcggggtcgaagagcgcgaggaggggcgggagcggggcggagaaggggagcaggagggtggcgttgcggaaggtggagttgagcgggtggggcgagaaggcgcggcccgcggcgaggtcggcgagggagtccccccgcgccgcccagaagcgcgcggagggggaggccgcgaggaggtcgaagcgggtgaggcgcagcgcgcaggagtcgtcgtcggcgaggcggaccgtgccgcggagctggtgctgcagcatggtgaagtccgcggcgaagggcgcggtgtggttggcgtgcgggcacacggcggccgacgacgacgccaccagggccccgatcgcgaccgcgagtacggcgaggcggagggcggcggcggccatggccgcggccgcgggggagggatcgagatctggagaggaggcggcaacgcgtggagtggagggatctggaagcggagggggttgggttggttggatgagttgagttgagttgggctcgctcgcttgcttgcggctgcggctgcggcggagtggggcgaggcgaggcgagcgggcggggtggaggtggggtggccgagatccactttgggtggtggactgatggaggccgtgcgccgcgtgggaatgtgcgatgcttcgtagggaaggtcggaaggaggcagtcgcaaaccacttgaactgttaagagaagaagaccattttatgttctctcgagaaactttgaccattttatgtcctatcaacaaaagtttggtctatctcaaaaaaaaaacaaagttttggtcaatttatttgtttgtttgtttattgttgaaactgaatatcgatatcactttttacagaatgtagaaaaacaaaaaaaaacgaaagtgataaattcagtgagcacaaaaatcgacagtagattaccttgagctagtatgtgtaaaaaccaggaagattttaatttctatatcatcttcagtcggttattgattttgactctgaggctgccactcaatttctcttatccaagttttagaagatgactattgtaaagcaaatggggtagtattaattggaagcattagctaccgtggtacacatagtatggtaactccgaaagtattggttttgttcaacatagcaatagacgtagatcattcttttgcgagagatgttctgtggctttgcacatgtcatcgtgctatgttttgtgacactagaatgtgcgatgttagaccctggtttaaactagtgctcctatatgatattgcctgtgggatgattatttgaagggcaatgcatgtgcgatgatttgatggttaatttgtaaaccttatttgtagaatagaaacggattaatccactgaataaattctagtgctcctcttgagaaaatttgaactcatgtgtatgaaataaaaatatccctaaaacaatgtaatgtgtctcaatcatggtatcatgaacccatcattcaaattttcactcgagatcgcgatatatgaatggagggggaaaaacctggtaggctcatttggcagctcgggttaccggcccattccccggatgaaaggcccacgggctaaattacacgcgcgtttggaagcccacaacagtcgcgtccacgcctgcgtcacgccgcagccgccgcgagatgccgccgccggccgggccgccggagtaactccggtaaactcaatcgattgctttggagcaaaacttgggactgactacgtgaaagattgtctgctcaattgaaaaccggtaaactctcacccggatctccatgaattggattttattttttcaggaagtaggaacttctgtttttagattggcaaattatgtttgttcacatttattagtttttatattaatattatattttcaagatgataatgaacagattccatgtagacaagttatattgctcctttttttttttgactacagacatcctatgcttggttagagtaaatcctctgatagccctgttttgggctgggacttaatatgtgaaaattttgccaaagctacatgttacatgtatatttctgtaggccattaaaaccaactggtttgagtcagagtttcatatactggaagcaatactggatttacttgataaccaatcactggaaacaatactaaaatgcatgaatatagaaggaaaatcctaaatttgcttaatattttttttctaaaactaatatctggtaactatccaggaattgaattgaatctgtgctgtggaaaactatagtcactgcaatcacatcaatactattataaatagtgtaattgctaggttatcatggcaagtttatttggttgttttacatcaatgaaaaagcagtgcaagtttttaggtcttctctttgtgacaatatatcagtaacatcagaaattgagacattaatcaggtgaacttgttttattttttttttgcagtcaccactaaaatgtaatatcagtgccgcatagaagtgatcatgcatataataagaaattgaagaagagagctatggaacaagtagatcttgtcaactagaatcgctaggtggtggttctttttaattgtttccccttgatagctaacctgtcaatgttgaagtaacattttgtatgatcgttcgtatatgtaggcctatagccagctccaatacctttttttttgcactatatgtggtgcatttcagcttcatgccctgaccattaacatgatctggttgtatgcccctcctgattgaagctagtgctataccaatcaactcccaaggattaattcctattgccactcgttggttccagtccttgcttgttatggtgcatagagcaaggtaatcagtctcataccatctgcttggtatagaactgatcatcatgcggagttcgttcttcgattcaccacttgcgctgagtaacatggactctgaaaatcatgtcaccaaattgggttattttcaggcatgaaatctgtcgtcaatagatattagaaggctgcatgtatgtattgtttgcagtaatcctgttagaacagaaattcttgatcatgtactttagtccgcatgttacatgtgcagtatagaaaactattttttttcttctttcagctagtacaataatggaactgtctgagttgaacattcaaacaattgaagttgatggctaaaatgttgtatcagaaatgtgagatgttgagaggacttacaggcttgcattgcatatttaccaatgataaatgataactcaaatatttattcatattcttatactgcctttctttccaactgaacatttagaacccaaacatgtacatgatgtacattttgcgtgaaggttaacaagcagccatatatatagctccaactgcgaggatataacaaaatcttttcacccaaagaagttaacactgcatttattttttacatgtatatttatttataacatgtaaaaactaggtcctagagacacttgtaacttgttgcacatgtatgttcatttacatgtgaatgagtttattcagcgccgtgttttctaccgaattttgtctgaatttggcatttgtacaccgtgacaagctttatagtgggacaaaggtcgctagctggcaagggcaggattcgatggattttttgttctccaatcgatgaaagattttaaaggcattctttgcttgtccaggagataaagatagaattatgccgtgttcactacattgctgatttcaacccaacaaaacttgataatttggtgttatcaaaatttaatagtttaacaaactacacaagccttaccgttatcaacctatcataattttgtaacttcgaaagttttcgctcacagaaattctgagaatgattgacgtcggtcgcccggcgcgggggagccggatcgggcgctcccccctcgcacccctccccccacgtgtgggcccgcccacttctttctcatttttccacaaaagatgtttcattcagtgtatttataatgtttcactatttatagatctaatgttgcagtgaattaaaatactttttttaaaaaaagaaacccacatattttggaaattctccattaaaggaatttggtttattttttgttccaccaaaaatgtttcacccagtgtattaacaatgtttcactatgtatagatctaatgttgcagtgaacaaaacattccattgcaacaaaaaaaacctacatattttggaaaccccctattaagggaatttagtttatttttttttccaccgaaaaatgttgcacctagtgtactcataatgtttcacttatgtatagatctaatgttacagtgaactgaaacattctttcgctatttactgaaacattatttttatatagggtgaaataacacccgatttaaatgagtgaaacattttcgatctacttagtgaaacaattctgatatatttgttggaacatcatgcaacatttaaaaataattcaataataagctaaaaaaattcatcggaatatattcatgtgtggtcttattttgaagatttaattgcaacgaatttaatggtgcaatcggatcatgatttggataagtaatttaagagaaatcagtttaaagtagtttttgcacgtaaatcgggcgctgatgtcagcgcccgatttttctcaaattcgatcgggcaaccgatcggtaggagtgccccaaaaattccaccgaaatttaaggctacgttcgttccccagggtttccaactccccaccctcattttcgtgcgtacgcttttcaaactactaaacggtgtgtttttttgcaaaaagtttctatacaaaagttgtttaaaaaatcatattaatctattctttaaaaaatagctaatatttaattaatcacacgttaatgcgaacatcgttttacgtgccggatagcgaacagagccttagctctaaaccaacttatccaatgctaccaaaatttagtatcatatcaaaatttgatattgccgaatttcggtgtggttgatttttcaataaaatagaaaagtccttaatttagacccagaagcttcacacaatctaccgtttgaatatttgcatttaccaaagttttcaaaaaaagaaaatttgaatttaccagcatcggctgcctcgccgggtcaaacgacgccgcccgcatgtgcagagccacgtggtcaaacgacgaagccgacactgtaaacataattacacgaaacttgaaggtccaaaacgcaaaaaaaataaacttctatccgataaaaaccccgggaaagatccacccgacgccccaagctttcttcctcctccgcgcgcgggtcgtcgccgtcgccgccgcccccgccgcatcgccgccgccgcgctcagatccagacccctgagacatggtctctcgccgagcgatgcgagcgccggagatgctccggtggctcgccgcggcggcggcgctcgtggctctgctcgccgccgcgccggccgccgggttctacctgcccggcgtcgcccccaccgacttcgggaaggttcgaatcgctgctctgatcccatccccctcttcgtcgagctaggaattgctgcgcgcgtgctcgggtttggatctgggtcgttggtcaacggggtgggggttcggttccatggctgggatgggatgggatctcgtagatctggctttgggtgttaggtactcctgattcgattattggtggtgggatatatatctgagcttgggattcacacggttgcaccaacaattcgcttgttccaaatacttccatttggtccatttggagtgtgtaggttgcatgcatcatcaaactcttgtagtaatggtggatttaagccaaaaatagctagtttggttgattttgtataaactttgacatcagattttggttgttctgagtagtaacattaaactacctctcgttaaacgtgtgtgtttccaacaagtattgtattggaataggtgattctgagaaaatccattggtttgaaccaaagttaagctcaataaacggatgtgcactggccatccgagccaagcagaagttccgtctcggaaaaaactcaactcacagtaattgcataccacaagatcatcttctgaagggttactcattaaaaatccattgccattacactaaaagaaggccatcgcttaaatgatctgaactgtaattctttgcttgccttcttttcctctggtgtatctaggtccagtggttattccagcttatctgattttgcctatggaattagatgatcacaaagttaacatagaacaatgcatgggcactggtttctgaaattgggttggtgagtcacccaataatgcattggttcactgcttcatcgatcataattataactattgttctgcttagttcttttccaaagaagattcatttgttagatcagactggtttggctcatcttcctgtttctttgcacttgtagtttcatgtgtacacatgccatgccgcatcttgatatgttaagtccaaataaatgttacctttaacaaggaatagtttagggcatcataacattttatttgtggccaggatttcccttataattgcctttcctgtttatctacagggtgattcacttcccgtgaaggtgaataagctgacatcagtaaaaactcaactaccctatgcatattactcccttcctttctgcaagccagaaactatcgttgacagtgctgaaaatctcggtgaggttcttcgtggtgatcgcattgagaactctccatatgtggttagtaccgggtaactcatattttgaagtttatgtccttgaagtaatatgccttaatctctgtttgccatcattctttttgtttgagctacagtttcaaatgagagagcccaagatgtgccagattgtctgcaaattaactgttggtgagaaagaagcaaaggagctcaaggaaaagatagaggatgaatatcgtgtgaacatgtaagggatatataggtaatgttgcacttcaagtcacagtatcttccaaagtgacatgatttgttttgcaggattcttgacaatctcccgctagttgtttctgtgttaaggcaagataagaacattgcttaccaaggtggctatcatgttggtgtcaagggccagtacaccggagtaagttgtgcactcaattgatgcttgcttgaccttctatttattcatatatgctctggattaacaaactgtgatatataaatgtattcacagagcaaggaagagaagtacttcattcacaaccatttgtcatttttagtgaagtaccacaaggacgatgattcagaactttctagaatagtgggatttgaggtcaagccatacaggttttctttctactttgtgctttgatgttttacttgcatatgctctatataaatgagcctaatgcatgtgttatttatatactgttatggcagcattaagcatcagcttgatgataaatgggatggcgtgaacactcgcctgagcacatgtgaccctcatgctaacaagcttgtaacaagttctgactctcctcaggaggtcgaagctggcaaagaaatcatattcacctatgatgttcactttgaggtactagttttgcatgttttgtttggattctgtttcccccttcatgtgatagttgcctattctcttaatgttaaatttattgcaatgatttccattgaatctttttccctcattgcaggagagtgacatcaagtgggcttcccgttgggacacctatctgttgatgactgatgatcagattcactggttttctattgtcaactctctcatgatcgtgcttttcctgtctggtatggtcgcaatgataatgcttcgcactctatatagagatatctctagatacaaccaacttgaaactcaagaagaagcgcaagaggaaactggctggaagcttgttcatggagatgtgttccgccccccaaccaactctgatttactctgcgtttatgttggtactggtgtccaattcttcggcatgctgctggttacgatgatttttgcagttctgggtttcctttctccatcaaatcggggaggattgatgaccgcgatgcttcttgtctgggtcttgatggggttgcttgctggttatgcttcttcacgcctctacaagatgttcaagggttcagagtggaagagaataactatgcgcacagccttcttatttccagggattgcttttgttatcttcttcatattgaatgctcttatttggggggagaagtcatctggtgccgtccctttcaccactatgttcgccttggtcctcctttggtttggtatctcagtgcctcttgtgttcgttgggagctatcttggattcaaaaaacctgccctggaacctccagttaaaaccaacaagattccaaggcagatccccgagcaagcttggtacatgaatccaatcttcactattctaattggtggcattctaccatttggtgctgttttcattgagctattcttcatcctcacctctatctggcttcaccaattctactatatctttggcttcctcttcctcgtctttgttatcctcatcatcacctgtgccgagattacggtcgtgctctgctatttccaactgtgcagtgaggactacatgtggtggtggagatcttacctcacttcgggatcctcagcactttatctcttcttatatgctgctttctacttcttcacgaagctgcagattactaagctggtgtctggcatcttgtactttgggtacatgttgcttgcttcattagcgttctttgtgcttactggtactatcggtttctgcgcttgtttctggttcacgaggttgatttactcatctgtgaagattgattagttgcaacactacagagcacagcatatgtttttaagccttctgagtcatgggaattgtatgttcgaagtggggatcaatcccctgggtttttttaaagaaattttcagtgaagttacattttaggttttagtttatgaacaatttatgtttgttatggctaaacgatacatcttactgtagtaatttggagtacaagactacaaggatagaacacattgtgatggagttgttttttggtgaaatttttttaatggactggtataagaattcaattgattatgaactgcttgtactctaatcaatggtattattgactctggcaccagtatgaaatcaatatgatgtaccagtaacaatttaatcactgttatattattagaatgaaatgtcccttttgctttcaagtactatccaacctgggtgttggtggtgtgctctgggtgtgtgacatttctcccatttttaattttgcttgtggttggaactttggaggcatcggtatgaaattgctccgcattctgtggcatgatttctcagaccgtcgggagacatggaatcaatatcaacttgccatgatcaatgtctttttcagtcttgtcgtctgagttgccctgccatgtgggcgtccgcatgttttcacgttccacggcgtgtagacggcggcgacaagctggggccagggcggcgtgtttgccgccggcgtcgagggcggtggcgcgtgatgattcaaatttcgcccaatttgcactaatccatggtaccttgttcaggccaaaggctgaacaaaaaagggtccagatttctgacacgaacggcacataaatcaaatcaaatcgcccgtgcttctctctcccctcctcttacccttccattggctccctgggttga

SEQ ID NO: 46347 - DNA, 2458 bp, Oryza sativa
tcatctgtaagcctcctctctacatctcctcctttctttcgctccagcagcaatgatttccgacgacgagatgcttgtgcttgtgccggcgttgcagcgttcaggtaccagaaggggacgcacaacgtgttcgaggtgaaccagacggggtacgacaactgcaccatggccggggtcgccggcaactggacctccggcaaggacttcatcccgctcaacgactcacgccgctactacttcatctgcggcaacggcttctgccaggccggcatgaaggtcgccatcaccgtccacccgctgaagcacaatgccaccggcgacggcgccaagaaccacggcggcgacggagccgcacaggaggccgccgctgccgccatgccgggcgccgccgtgtggatggcagtgctcgccgtggccgccgcagctgtcgccatattgccatgattaattaatctctgcacttgtgcttggaagaactcaagaacattggcacattgtgtgttttgctcgcatttttatcagggacttgattaatgtagcaccaaaatcagatttatattcaagtattaattcagcaagaatattggttcatgatagagcatcaggattcaggaaaaaatttccaggcggagaaagcagcgacaggatggagcattggaaaattcatgcatttcacacaacccagttcgattaagcaacatggcatgtattacaggttgtggtgcaagaaaaagatgctagttgaaagaaagaacaaaccctatagtgactgtagaatagaatcccttttcttatatacaccacttactatcctttttgtctatcaccggttggaactccatggttcggtctcggcctgctacttgtttggatcgcttgggccatcatcaagctcgctgttcacaaaggtaagggctcaaattctgaaaggggaactcaggcttttacaatgcgagatttcgtgatctggaatatggtttaggtgcgacggttaaaggaagctcactttggtcgcatctcttctgaagagacagattgatttgtgcttgaagtagcagctgacttgcttggcttcttgaacttgactatgatcactgtcatattatcacagccatcaccaccggatacaggtgccaagcaatggtcaagcaacttctcgcagacagcagataggctatcctcctgtagttgttttcccagtaaattaggaaaccataacataagcatattgcaaaacacaacactatgaactatatatttttagtgcataatgtaaattctgtgaatatcagttgcttacagtgttcatttctttgtgaacaaagtccaccacttcttgacttgacatgcaatccctgtcataagataaatttacgtctcagataaactatccagtgaaactacaaagaatacagaataatccatagaagagttgacaaaagatctagcaccatttcaaaataactgcaggtataaaaaatcagcttcacatctagtatacaaagttatctggatgtttatgtatctgggatccattataaaagaagttacatatcagcatctgcacgccacacagtgcactagtacacatcatctaaaaagaattgtgaattactatctccaagggctgtccaaatggtttaccaatagaagatgatgtcatttctttggacttaccctaattacaactattgtttctttttactaaaaaaatcaaatctgctaataaactaaaactgttgttggaaaattgagttgtcaaaaatcagcagcagctacaccagatggtaaaaatagctaaaattgtttatctcaataagatattcaagagagaatgattggtgcaaaggacataccatatgccatcacatgctaaaacgatgaactcatcatcctcagaaagtttaacctgagcaagccgaataaattccatgttacaaaaaatgttgtccaaagcaaatacagtgacagaaattgtcaacaaaacccactgtgtttaattcaggttcagcagtgacaatctgtctctcggctgggagaaattcattctgcttcaattccatatcccctggtggaaaagcacaaaaggataaataaaaattatgcgtgtagctaaggaattgtttttcgatgagaagagagggtgctacctattgcccttgccaagttcaaacttccattgacccgcccagcaacaatgaaaccaccagcattcagtatcctctccttttctgcatcaagatctggcttgtgatcttttgacaggtcataagcctatgcagaagactgagtcaggacacatattctaacattttcttcacaaataaaaccagagatatagaggtctgactgacgtactcgacccttccttgagagcacacaccgggaatcaccagcatttgcaacaatgagttcatcatttcttatgatagccacacaagcagtgttccagatgttg

SEQ ID NO: 46348 - DNA, 3551 bp, Oryza sativa
  unsure (1)..(3551): unsure at all n locations
aattcctgcagcccagcacttcatgttcaaaagaggtacatgctacatacctgaaaaatgactttaagacagaagtagccaaatcaccagatgaataagcctcatttttcagtacttgcaagtgtagatgtttcgcacaaaacttagatactgccttccctggaattacaaaggacagtttgtcaagtcacaacataaagagttttgtccatgatgtggataaaaggacaacatagaagcgcattaagttttggtttcaaaaaaaatatatgaaaaagatgaatcaatttaaacctactcaatgcacttctaccttttacaacgatcaaaaagggaatgtgaaaatgttggactgtttgattgttatttccctgttaggttactggactaccaaactcaacacagctaagtttacctaatctgcatgaatggatgagatgatgaataaatgaatggatgagattatcatcaactcaacacagctcaggttacctaatatgtgtagtttgttaggtgaaagttggcgatgcttaattgaacttgctaaggttatgccatcgaaactacagaggcaccaatcatttgcaactagtaatggataaagttgtaagatgatattaattcaatcaccaaatggtaggcattaaatcgcactcgtctttgtttagatctgaagatgcaacataatagcgagttggacatgaacagaaaatcaatgaaaaaacttacctccatggccatcatagacaccaaaaaaggatgtgcattcgtccaggcgtggcagggcagtgtgctgcaatgtaaggatgcactcaataagcgtttaaagaacaggtacagccactaattcaatctaatttcacctgaaacggtccctaatgtcatgccaaatcaatgagaactcaatgtcgaacggcactcctagtgctaatcatcgtgatcaatttatctgccctagtatcggcactggactccaaatgcaagtgacaaggcgcaacaaaaggctaccgtgagtcttatcattggggcaacagaacaccaccattggcgaacgcaattggaatcaatccacgtagccagttccccggaacaacaacttttggcggctaaccaatcaagcaaatctacgagagacaatcctgacctaaaaaacagttgcgaattccgggtcctagggtggtggcgaatcaaccagaaagcagaagccaacaataatgtaatgtggaaggggaaacagagggagggaggaaggaaggaaggaactcaactcaccgcgtcctccatggtcgtccgccatccctgcatggatgcgaggccgtagcggaggcggtcgttcccgccctcgccggagtacttctccgtcttgggcgtgctcaggtacacccccatgtcgccgcccaaccgaatccccccaaacacccccctgcatccaaccagcaccgttattacaaacgcaaaccccaatcacaatcgcaaaaacagtggcgctcccccgatccccgcgggcgatcttcgccacggaaccaaacatcgcggaatcgaagcaggggatgaggagtgggaggaggagggtactcacgacgacgacgacgacgagggaggaggcggcggcgaggcgaggagaggccaggtgaggaggaagcaaaagggaggggaggaggaggtgggcgagtatttgtagggggcggaagcgacgggaagaggagaggagagccggagaggaggagtccgaggcggaggcggaagggaaggagggagatgatgaggggtgggggattctgggaagattgcgtatctccttttctattcaccgccaccctcccttctctctctcgctcgccgccctgttgcaatgccctctcctcctccggtagatcaccgatccaccgttttggtggttatcaacagatacatatactcctgcctcagaatttatctctagccttttctttcttttgaaatagagaatttatctctagtaaagaaataatttcttgttttgatttgtgcttctttgttaaaatatatctgcagttattacatcacgatcgtattatcatcgaataactcttgtgagaataatctaatgtttttaacatgagcatatagttgtaagaattaatctagtgattgaatagtttgctttatttacttttccttttcttatatcgaagtttacttttacggtatacctataaatgattattgttaattgcaattagatttgagccattactgagtatatatgatgaaataatagtattctcaaccacatccatagtagaggctttactacattcgaattagattgcagccgataattatagttaatattttggttttttattacaattcaaaggcacatataaaatgaattaaatataaaaaaataaagatggattttgaaaagtatctaagaaatttctatatataatgtttcttaaaaaatctatttagttgcttaggaaacgtgcacataataattcagaagctaagaatataggttaaatcgtggcacatttatcatggcaactactagtttcttttggcaacttcttaggtgtactagtttctcgtacaatactcacacgtttattttgttccataaaaacgaaacattatgtactttatgcagcttaattaatagcttaaaacatgaatgacattgatccaaaactaccttccatcatcaaattgcaatgctacaaatgtgagtatctaccttccattgtcaccttgtgcaaaaagctttatctattcacgtggcacggaaaattacttctcatattggatgaacganaaagtattcattattaacctgtggatacacttctgaacgaaactctgttcatactcgcaaggatcaaacggagtttgacaggatatatagtgattatctcaccgtttgatttgtcaccatcaaactttcaagccccaggtggctaaacaccacacatcaagatagattttttcttttctactttctaactgatgtctcaaaagtattggcttcagtgtatgaacaaaaatttacagctgggatgtcaagctctctgaacatctgtcaccctttgtttgattgatttcttggaggataaaattagataagctaattgtagttgttaagcaaaagcgattagatggtcacacatgtcggcatgtcaaggctacacagcctttttaatggcggcaaaaaatgcaattatgcaaacatcacaatgctttgctatcccactgtacttaacctccataatatataattaaggagaccttaagacagccacacgtcagctaatctccaacagtattctactagtatacattattcttaaagggttaattaaagtcggtacgctactaatcatgccaggaggatactctgtacgtagtatgctcctgtagcttatcataatctcttcagattcagagttcgtttttctctttcagaacaagaagattacggatcaaactcacatagctaagaacttcattaattatgttcctgaatcttcaccagaatcacagtacaatccttcatatatgcacacatc

SEQ ID NO: 46349 - DNA, 1564 bp, Oryza sativa
cagccaattggggctcctggtttgctaggctggtcccccaggggtgtacgatggaatcggggacaatgcattttaataaaattaattaaaagagggatatgatttgtgtttttctaaacaaagaggaaaagaacaaggagagaatccgtacacgataccggtgtcgcgtcgatgatactgcaggctcccgtgtccggttttgagggtgctgagctaatcaatcaatccattaaccattgtcagatatcgttttagttttgggttatgtcgagcatgtctattttaactattatttcttataaattcgtatattctaatatcacaaagtttttatttagcataagaattcgtaatttatataagtcttaaaataaacgatttttcaaaagttaatggtaaaaatagacatagacatgtttaatccatattctttcacaattgaaacacatattttatttgtttttgttaacaagttttttaaactactaaacgatatattttacgtgaaaaactttctatataaaagttttttcaaatatcatataaatttatttttaatcttgaaataatcaaaaatcaatgaatcatactctatccgttatatattataaatattataagttgtttgacctttttaagtaacatattatagaaatacatttaatattaaatttgataaaactaatttaatatcgctaaatttttctacaaacttgataaaagctaataaaatttaattaggaaaaaatcaaacgacttataatatgaaatgaaggaagtccgtgctaatgatttctcatttttatgtctctatacttaatctttcatcggactcgttcaacgtgacataagttagattaaagatagaatgataaatcaatttgaaacattcggaataagtaattaaccatcatacaaatcatgattaagccttactcataaactaaccaatgataagtaattaaggctaggcgacgtgtcggcccataccccgtccgtcctgtaataatctcctcggcgcgacgccacgccaccgaccaacgcgacaaggcgagacgacgcgcacgcgacacacagccagcggaagcagcagcaggacgacgaggaggaggaggagatagcttagatcccgctcgcctctgatccccccggatccgatccgagatcctccacccatggcgtccggccggtgctgcacgttcctcgagatcctgctcgccatcatcctcccgcccctcggcgtcttcctccgcttcggatgctgcagcgtacgccgccacgaatcccctttcttgccctccctatctctctccttgcctccccgacgatctcccgctcgctctgctactgttcgtggataggtggatcggggggattcgttgtctcgtgtgcatctggtcgttagaatttcaatttcggggggcgaattttttgcgatctggtaggtcgattttgctcgcatccagtaataataattcgaggatactgggagtggttgcgaatccccgagctccaaacgctgcgctgccagcgctgaatcttgggtggacaactctcgatgtag

SEQ ID NO: 46350 - DNA, 1406 bp, Oryza sativa
gcttgcttctcaccatccttggctatgtccctggcatcatctacgcagtctatgtgcttgttgctcttgactcagaccagtaccagagggaatatcatacccttgcttaggcagtccacttcaattctgtcgaaacctatgctctatccagaacagccaagttctgctgttgaattggtatctggtaacttcgtctgggttttttgatatggcgttgtgaatcttgtgattataaagtagaaacagtggttcgtatcaaggaggacgaggaggcgcctagtcatttggtcgttaaatctccctattcatctgttttgtgctaaatgtataattttatctggatctcttgactccttatttcagtctgttaaatgctcaaactgtggtctggtctccattctgtaattttgattcaagaaaataagttgttgagggtaaatattattggtgttgtatgtcaataccgctgcacttcttgcctatttcgtcatggaaacaatgggggtgattattttgttacaacgacgtcagtaccaccttatatgccagtctatttatactttgccagtgaacttcaatgtttggtgggtttcataccttatgcataaggtattcaagtgcttcaccaatctttgaagaccactctggatttttgcatgatggaaatgttctctgagaattccatgtagaaatagatgactttatcatacttgatctgtagagtactaacatttatccaggccttgtaggaaaacagaaaacagtcttagaaccctcgccctttttcaaaatatgatatgcttgtcacatgctgtaatgtgcaggaaagtttgttttgttcagtactctagtcctctgacaataaattaatcagtgtccctcgtttgatggatcatatcttgctgctgattgtagtaatcacttttcatttgatggatcatatcttgctgctggttgtagtaatcacttgatcctgtcacttgtgtcctctgttatctgcgctttctgaacgacatcttcatactgatgtcgaatcatagatggatattataaaatacatgaagagaatgcttgtttctggtgctgaatgttcgtgcccatgtgatattcagtgattctgttagattgtgaacgcctgatgaatagattgtgtgtagctgctcatgaagtttctttaatgtttcatttctgattgcaacgattctgtctgccctgctgtgagagagatgcccctgaccttccctgtccacttgactatgctgatcaggttgtgtatgtgcatatattcaagggtacataaactgtcgcatccgattctctgtttcgttttcttaataatgcagtcatccttaattgggttggacgttcttaattgggttagacgtcatcgttgaccaatacatttg

SEQ ID NO: 46351 - DNA, 10120 bp, Oryza sativa
tatccaaaaaaaaaaaaagcttcttggaatgaatccggacaagtgaagatggttttttttgacggagagagtacgttctcccgaacatgagcagcaacatgactgcatcctatagtttcagtgagagaaatgtctggttaagtgccgtgttactatttcatggctcctcaaagctggcagtgaatgggaaacgtgtggttaaacatggagcagacagcagcagagtggtcggcaggtcggcaagtgtccctctactgctgctgctgctgctgcttgctcatcatcaagattcaagaggagcttgacctggacgtctcctctgctccatgtttgtggattgatcagtgggcaccactcaaccatcataatcctaggtaggatttggaggatgagtacactcttttgtgctcaccactgacttggatggcatattctccatgcaactttaaagtcctttccgttagggcaatgcatatggttttgaaaatgtggtcatcagttgattcatcatccttcatctagagaatttgccaatttgtatgcttgggctgtatagtaactatgacatgatctaagattttgcagatatcacacatagataaaggccgtgtttagttcacctccaacttccaactttccatcacatcacatcatatccaaaattttcctacactctaactttttttttccaaactaccaactttccctaaacttttaactttttttcaggaactaaacacagccaaaacagagacaagagttaaatagtggagcaatcaagtgggcattgtttatgcccttgctaattgctattagtacaaactaaaatagccaatatctgataatctgaacatgagaacggctgccccgttgtgtttcaaagaagagagttgagtacatgaaaaatcttagtactatactaagtacaaatgaactgtacctgtctctagtgtataagttttgatgggattagtacactgtacagtaatcacatcgtaccacaagccaaccctactgattttaaatccacaagggtaggagtgcatgatcagactcaaaaactctggtgagcagtgagctaaataaattgcactttttttttaacattaaataaattgcacttgtgcacagttctgcacttaatatgcaagcatcagataactgcaactagtcttgcatatacggtgatgatagtagcagtacgccagtaccatatgcttgactttctctataattattgacttccacttaactgccgtaggccgtagatgttgcaagatcccactaatggtcaaccagttgaacagaacaatgatagaggtagagtacagtagagtactactagtatactccctccgctatctatatctattataagagattttaacattttacttacactatttgactattcatcttatttacaaaattttaaaattattatttattttgtttatgacttactttattatctaaagtattttaagcacaacttttcattttttatatttacataatttttttaataagacgagtggtcaaacatagtatgtaaaatatcaaaatactttatattagggaacggagagagtattatctctgttaaaaaaactcaatctatctttttagtactgcaaatctgaataattctttattcagattcatggtacttccttttgggttattattatttttttttaacggagaagaggcagtactcggtgcagttgagtgcagcgcaggctggagttgggagttggctgcctgcgatgcgagggcaaagaaaaggaaaaaagatgccgctgcaggcggctgccgccacccaccaaccgcggacaagtggaagccccaaaccccaaccgaaagcgacggcgcgcgcctttggtggatggccgttggcgccgaggcaagcgaggcgcctgtattttcttacatttcagcccttccctaaaaacttattttacgaatgaaccttttaaaaaaactcttataaatgaacccttagaaacttattttacttttgcacctaggtccaacgctatgctgaagtcaatggcgtcgagggagttgacaccttgtcactttgtgtgagcacgcggaccggcattttggcgattgttaagatctctagccttgatcctcggtatggtgaagtgagctatggttgcgtggacacggtcagtcagcagttgtagttgtttcatgacagtccatctggttgtggccgctgccgtgccgaatcagtgaccaggatttattagcaccaaagactccggcgctgtgacgttggacctcatctttcccaaagtctaaacttgaaataaagctttgctgatggtgtctatatatgtaaaataagtttatagaaagggggtaaaacagaagaaatccagggcgaggcgtggtcagtggtcaccaaccgcgggcgccgcgactgcctgccttgctgtctcgtgcctgccgtggaaaacgagggaacgggaacccaacccaggcgcgggccccgccggccaccgcgcgcagtcgcagcaacagccagtactctctctgcgcggcggcagcgcatttcccactcggccactccagccccccgcagcatccgcccgatccgccgcgcggctgcttggctgttggctcccaccacaccttggcgtggccgtggcgcgggtgttggatccgtccggtcagcgctggcgtcaccctccactccctctccttccgcccttgcctcctcctccgcctaatgcgatccgacgcgcgccaccaccacctcctcctccgatcccgcatgcgcccggtccaccgcgcctcgcctcgctgacccacgggggccacctgctgctggtggtggtggacggacggagttgtccgcgacggtctcccactttccgcctcttccccaccaccatcgttctccttctcttctccctctcccacctttctccccccgcgcgcccgatccttcccttcccccaactccctctcgcatttcccagctcggatcctcttctgacttctctctctctctccgtctgtctctctcctctttcgaggtcttcagtcttcagtgttcttgacgaccttgctgcttcttgcctctgtttcgcctcctacttgccgtcttcttcttcttcttgctgctgctgctgctgctgctgaatttttcttcggtcagttagtcggtcaggccggtgccggtctgggagcgattccgccggacgcacgcatcaacagtggagggaggggaggggaggagcttcccctttttgatctagcaagtcgtcgtctccaaaaatacacttttttttgttgggtctttggaacaaaagggtctcctccttttgatctttctgtctcatcactaaattagcaaagctttgtgcttcgcggcgatctcttttcagctaattcagtctctgttgatagcttcgttgcccaagagagatcccccatgtcagaggcgagcggatgacaccgcaattcgggtccggttcttccgcctgagctgcagaattttaagcttcctccgtggtgccgccatggatgcccttcctgacgccgccgacgcggcgcagttggcggcggcggcggcgccgccgcagaagcgcgacgagtggagcgagagcggcattgtgcggctgctggaggcgtacgaggccaagtggctgctgcggaaccgcgccaagctcaagtggagcgactgggtcgacattgcccacgaggtgtccgcccactgcgccatggagaacgccgccgccacggggaagcccgggagcagcacggccaagacgcccaaccagtgcaagaacaagatcgagtccatgaagaagcggtacagggcggagtccgccgcggcggcgcgcgccggccccgccgccgccggtgctggcccgtcgtggcggttcttcgcccgcatggacggcttgctcaaaggccccgccggctccggccagccgcaggcggagttgagcaacagcatagacctgcgagctcctcctcctgcaaaggttgaggtcgatgtcgatgcagatttcgtcagtcagttagctgatgcagggccgggtgcactttctgaattggtgagtgcatatgcaaacggctcgattcaagagaaattggacaaggttgagaacagtgggcatgttgaggggagagctgcagagagtgatgtcaatgtgagctctccgaggatcaaggaggcgaacgaggatgccgaggaggtggacaaggtatgggacatgtccaagaagaggaagaacacggagtttgatatcgcgaagagcatcgagttgctggcaagctcattcttgaagattgagcgcgcaagaatggacctgtacagggaaacagagaggatgagggttgaggctgagattaagaagggtgagatggagctcaagaggacagagattatggcaaagacgcacttgcagatcgctaagcttttcgcaaagagattgaaggagtgcagcagcaagactggtggtagctcatctgtaacagctgaagtggacaaccatgccaagaaaggagaaaatggttagtatcaacatgacaatttgcgaataaactggttgtagttaactaacttaataggggtatatgttgttctttacattccatagctatcaaacattccatgcaatttgaagttaagtactcctacttggcatttgctatatctggagttcactaatagattaggaagttccagcctgttgagttttgtctagtgtaattatgcgctacatagtctttgagttccaaatttttggagttcggtacaactatatcgatagaagctgatattttctgagtgcatgttctgaaatacagaacggcttgattgcatgtgtggtatagtgcaaacacatgatgtttcgttagtacaagattttgattgtaggagtgcatagactaaattgcgatctgcaaaaagtacaattacgtgcgacctcagcagagcgatcttccatgttgcaaacacatgttacctgaattacctaaatgatcagaccttacattaaaaagattgtatacaaccgctaagtaataaaattgtaatgaaaatataatcaactgtgctgatggcatgctataaaaatactcctactgggttaagccatgaatagacaaaattttgctatgttctcctactctccttcaaaagcgaatccaaaattcgtataaccctagaggtgtccaattcataaaaatgaaagagcaattgcatgcttgttgaaagtgattctgactgtataatgctaccataatctatacaaattgaacttacaaatattctggagaaaaaaaatactggatcagcctatggatgtgtttaagtgcatctgtgcatatatttatctgatttgattgaatacgctaatattccatatcttatcaaaatggaccatgtaagccttttcatgcataagaggaaattagattatgagaaaatcgacacaggttgctaaatctgttcagcttagcatatattcagaatcaatcatcaagtgatcatgtaccagtactatcagggctaagtattggtttgtgctagtgcaattatgtttactttgtattgataaaaggcaaggttagcacaccaaacaattcaaggattagcatttatgccctcaagttgaaaccgatctgaatttctgaacttttaaatgcttccatcttcaaatacatctcaaaaattatcttttttgatcttcttttaagttgcttggaagtgccaactgaaagcgcggttttcattgtaatcaaacatgttgaatgatgtttacactttctatttcatcttgtttcgctgtgagcagttcttctgacttttgggcttatgaatttcaggttcagggtgattgaaacaccaaccgatcgtccagaatccagaaagcaggcttgtagtttttggtgttcttgtgcaccaaatgtatgtctttgattgatccgacttcaccatgtacgaagagatagttagctgtaaaagtaaaatgcaataaatgatatgattgtccccattcagtgggggattatagaagcagttttagaatcagtaactagcctgaagaaagttgttgagttccttttgttaatattttttgactgacagccatcgtatgtatcattctactttttttagataatggattttcattaatccggcctctagatccacaaatgatatacacagccaaatccacgaattatatacacagccaaatgtatcattattctactatctcattgttgcgaagtgttttctgaagcaacatccaacgataagattcttgcgggatattttattgcgttgataatatggctttggccgtgttaattgcaggattaaaatggttggaacttacactgtcgtttacttttatgctgtaatgtggtattccaagatctcatccgactttgtttgatccagcatacttatcactttatcagatagtgaaaccagatcccatttaattgccctctaatgactccacatccctgaatttatctacacggtcgagattttttttatatatattcatgtattacgatgttgatataaataaaaggtaaaatttattttagctagaaacaaaaacgttaaaaacgatactaccatttttattttattattttcgtgaatttatcgtgattcgaacccctactgatacctctctctccgtttccaccggtaaaaaatagggaaaaaacagaaaaggctgttcagatttgctagaaaactttcataagtttttttacccctaaaactttcatatttgtgactatagaatcgtgttgagaactcaagatttatgtatgaagaagaaaatttgctcgaaagaaatttttacacatctcatgtgcaagatcctagcactaacaaaccaaaccatatttgaatataagttttatataagttatatcgtagctacgagtatagttaaagctaagttacaatataattacacttcaattccattatattacatgcgaaaggttttgactaaaaaaactacggggcgattttttagatacttccaaggctgtttgtcgtgggtccacatgtcagttacatggtacaaattcgtgtggactctctgtgtggctcaagctaacaagcaggaaggcagggagtaattggtccaactccctcttcttcttcctcgcctctcccgaaaggaaaagaaaagaaaagaaaacgaaaaaggggaagaaaaatttctgtgtccgttccatcctagtccttggcaagtcttctcaagcaggaggaggacttgccatggtgttgatttggggcgggaagaagcatcgggctcgccgtctgctcctctgatcggcctcctcagttgacacagcaagatttggtccggggggaaggggagcagccgcatgtttgggtcccgagtccaggatgaggtggagatgcagaggaggactaccaacaggtgcgtgctgccagcttgtgattctttaatcctgtagcttccttttcgtctcttgatgcagaagaggaattcttttcggttctttcaagcatatgtaaggaggaaagtttcaatttatacggcagatttagtttgccccttttaatgtagtagcttgatccgcagttgcgaacaggtggacacaggaggcgatatgttgtcaatatgcaattctggtctaattgttaccctttctgattggaaccacccaatatttgcacaaaagataatacacattcagagataacatttttgcagtttatttttccttactgggttgtttctatgtgtaggatctttcctgatgagagacaggaccagtttaagctaccgtttcaagctgcacgggctgacagatttggggtaaacaggatagatgcaaagactactgagaagattaaagtgataagtgaaggcaacataccatggcaccgccgcattctagaccctgggagtagcatggtgctaatgtggaacagggtgttcctagggtcctgtttgtttgctcttttcattgatcctttcttctactacctgccgctagttcatgtactagatgaaagtaccaaccgttcatgcattgccaaggaccggcgattgagcataactatcactgttcttaggacatttgcggacttgttttacatgctgaacatcatggtcaagttccatactgcatatgtagatccaaagtccagagtacttgggaggggagagcttgtcttggacttaaagaagattcaacggagatatctcagaacagatttctttattgacctacttgcaacgatccctcttcctcaggtaaatagcgcagaagtaatgcttttttggaattcttattgcatttgttgatggtagatacccccagttacccatgcgcaagactaaagttgttcgaaagagtgactatggtgcaaatgtttgtaattgtgcactttattttcaccctccactacatcttttgttgctaaaagttttgtatgccacaaccatccctcaaagtacttttaataatgcccttttgcaatttactagtatttccattctttctttctgtttagaataaattcattagttttcatgactaaaaactaaatcacttcccctgagtgagtttaaagacaatttattttattatttccatgtttacttggaatattttcatgatatagttaactgctacttcgatttataattatccatgttgtctttgccaacattgttctaaaccatttttactttgcactgctagaactacatgattggcatgttattttcccccaatttccagtgtgtggttgatccgctttcccacaactgaataccgataatgtaatcaattgaaacttttgaattctacagtcatagcctgaatctcctggtggtactttctcttgcaggttaccgtgtggattattatgccttcaataaaaaactcagattacaacatccggaacaccacatttgctctggttattatgattcagtatatattcagaatgtatctcattgtaccattaagcaatcaaattatcaaagcagctggagtagttgccaagtcagcctggctaggagcagcatacaatcttctgtactacatgcttgcaagtcatgtatgaccaccttccatcttcaacttagtgttcatcatttttgtgccatgttaatttgtttaaatactaagtgttgtgcaatgtaatctacaattgaaacccaacttaaattttgcagttttttccctgatacctcattcacagtaggaattggacaaacaaaatgagcctgtctgtaatcacagcatgtagatatgttaatttggcctctctaaaaaaggaaatacatgcatatgtgcaaactcaaattggaggacaataattttaatatcacagctcttagctgcacttttttttttgaactaatacttcaataatgttcctcctggttctgcagattactggagcaatatactatcttctctccattgaacggcaaattacatgttggaatcagcagtgcctaaatgagtcttgtagttttaacttcataagctgtgacaatactggttctagcagttatcttacttggggaaagaacacaagtatatttgacaattgtgatcccaatcgtaattcaagtgctaaccccccaccatttaattatggaatgttttcaaccgcactgagtaaaggtgctgtttctgctccatttcttgagaagtacttcttttgtctgtggtggggcttgctgcagcttaggtataattaatttttaatatacatccccatcttgaatattaaactttctgtacatctgttgttgatatcttgcctgtgaactattaatctgattatatactttacttggggttcttccatgatttatccattttattcatggttctgtgtgattcaaatacaattgctcatgtttagttttctgctgctgtatgtgctctccttttcagttctagtggaaatcctcttcagacaagtgcatacatcgcagagaacacatttgccatagcaattggtgctcttagtctcgtactctttgctcagctgattggcaatatgcaggtattgtcatatcttttcttctgaactaggggagaaaatgctccaaggaca

SEQ ID NO: 46352 - DNA, 5243 bp, Oryza sativa
ctctgcagatcatttcgattgaggctgatgtttcctgctttaaaaaactgttgtaaaaccactactgtgcattgcattgtattcaatagccatatagtaatccatgtgtatctcaaagatgaaaccaaactggtcctttgtgtaattcaaatatacgcattttaggagctgtgaatcgtgtgcattttgtttgcagttgaaccaacctcgagaattttgaagaaatgaacagtttagtagttttatatattgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaatcaaaaataaacagcagcggactagcgggcctacggctccatcttcacaggcgctcaactggggtataagccaggactccacctaagacatcttctccaaagcctctcttactgaagaggggaaagattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggctaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtgaacaaggtaataataacaatagcaataataatgtcttaacaaaggtaaataggcatggctaaataaaacagtgataacgcgggaataaaacgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacgaagactacgcgaagcacacaagcaaagctacaagcctaaaaagaagcaataacaatacataaaaagaaagcacacggttctttaggttatacaaacattaggagacttgaacgggtcgattcagagctcgtatgaccaagatatgatcatccgaagtttaatgctgttatatggagatttgcggattattgtaattaggttttgcaactataaaacaggtgtaagcgctagcctggaaaagacaggaaggctgcgccgttgacatgcggaccccacatgtcaacctaaaggaccgcggtagaccgggtacactgagacggtccacgggtcgacggaagcggaccccgtgtgtcaaccgaggcgagtggccgacaaacggactccactagacaccacacgggctgcacacgtggaaaccacgcggctaccgagcgggcacactaacacggtcaccacacgcacaagcgaacgactaccgacaccggtacacgggtatcggggtcgacaaccgcacaacgggtacgggggacaccgaaaggacgaggacggggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgatgacggggctgcagcggcacacttgacggacgcggacgagacggacgagaacggcctgacggagggacgaacgccacgacgaccgggaacgacgagaggacgacgacgacgacgacgacgaccggggccggcgaggaggcgatgagggctgccggcagcggctgcacggaggcgaggatggcgcggaccacgccgctgcgatgccgacgacggaggcggcgccgcgagacgacgagccgggcgaccgatgggacgtcgacgacgagaacgatcggagacgacgctgatggaccgcggaggggtttggatggaggggaaacgatgccgaggacgaccttgccgctgcgatgccggaggtggtggaggtgtggccgaccggtgcacgggcgaggagggacgggcggccgaacaactccggcgaggcggatggagaggtttgcggcgatgtgcggcggcttccgggcgaaaccgaggggtggacgaggtggagggctacgtcaccgtgccgagggaggggacggcagcgccggctgacgcacgggcatggcgaaaggggcagccggaggagatgccgccgaggaggaaggagaagccggcgcgggcgacggtgttccggcgaaattcgggcgaggaggaggtgatgccggggatgagggcggcgtcgcggagccgagggaggtggtggcgacgtcgaccggcgctcaggcagggagatagaggcggctggaggcggccgacgcggaggaaagggaagggcgacggcgggaacgcagctccgggggtctccgcgggaaacggagggcaagccgggcaaggggaggcagctgctatgctggaggaggcgacggcacgaccggaagacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccgcgggccgaggggagagaaggaggactttgggccagacttggcccaaagggggggagagagattatttttaggtttttctttttaataaactctaataattgtttttgttgcttaataattatttccggtgctctgaaaattcaagtaaaatttaagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacatatatcgtacgatttcacatttcagttccatctcgttttgtttttctcgatctcgggttactctagctgggctgttcttgatggctgccgattgccacacttcacaggagacaattatcatgaaattccattattaggctttcttcgatcacaatcgctctgatcttccgagaatcgtttttggagattcaactttttaatccgttgttagaaagaagggttatgcatatagcttagctaacaatagatagaaatataagtctttgaggtggtatattaagtagtttttatgcctttaattaaattatttattcgtcctataacatatgcaataattagatgttactttatttaagcaaagatcggaataaattttattattatttttattaaaaaaaaaagtaagacaacgaattacagtaagtccaaaaaaaatcgtttgaatttcgaaagagatattgttggctgtgggctaaggtgggccggtaattttctagcctgtgggctgaagggccgcagttttccctcctttccatcgtcttccttccgtgggttagatcgatcgatctggctctctcgcggagatcgagcaagacggatgatggcatccatggcgaagggccgccgcttgtggaaaaccaagcatctcacactgcgcccgccctgccacggcggcggcgatggcgatggcgatggcggtcacccagactggattctcgtcgacgtccaggcctacatcgccgaccgccggaacgccaccaccgccaccgccatgctcagcaacggcg

SEQ ID NO: 46353 - DNA, 2443 bp, Oryza sativa
gctctctcgggatcaggtgcgcaatccgcctaacaaaaccgaggtgctccatatcacggagaaggtgatcaccttcatcaacgatccacatctggttgccttcgttgatctctggcggggcatcatcatctgtgacatacttgacaccaaaactcaaactgcaagctatgtgccgatgctcaaggagatcatcaacctccgcagaacccgagcatcgtcgatcaccagggacattgctgtcgtcaatggccgcctcaccgtcgtcaggctcaccactgtctttgatccagatatcaatggttgggactgggatctgtccacatggagcagggcagtggattgtttggagcaggaggattggcgcgaggactctctggtcgaggcctctgacatcttaatcgaccacaacatctgcaacgttgagctcttgcctaagatacaggggcaacctaccatggctaaactccacgttgctcttcccactctcagcttgactgatgctcaggttgtttatgtcatgggcaaggttaacgaatccgatgaaaaggctgtgctgctgtctattgacatggccaacagaaggcttgatgcagtatcagtgtatgacgctgcaagaatcctccactactttgatgtctgctacacgcagtctaccatcttccgatattccgccccttcttcaggtgattaattccctggctattctttctacttgtttttcttctggccaaacctttggatcaattgatagtaaacctgattcgtattgttgtgtttgctgatatatttgaacacatatatgtatgtggctgttgctatagtgctaggctgctagctagacttgctagtttagtcggctgttagttggaggctagtgttagctagactgctagttgagacaacattagtgtgaggctaggtatacttttagtcgtcattcattcattcattaagctgccagattagttatagagtatggttctagataaacaaatcatgaaatgcaagcccatatggcacatgtagccagttaaatgcaagggaatgttagctttcacattgccttcagatgaaaaagaaaatgttgctgtgggtgcatgctgtatcaaaaaacgctcataaaacaaatgagccattgaacgagatggttggaaatgaaaacatcgacaagatttctgccaagagagatatatagcagaccattgtaggtgcttttgcattcttgaaatagaatgaaaactgttgaattatgtgtaaatggttaagcacatatatgtgtaaattattttgcactaacacatttccctttgttttgctgggtgcaggtttaaatggaaacctgaaacgaccagggaagttccctatgccatatcctcgcaagcaacaggctgtaaatgagccatttcttccggatgctgggagaggtttagaaactgaagatagggatactatggactgggagtagttatgtaatttggagctgaaacctgaatagacataaattgatcacagctgtttattttgcttctagttactacatggattgctacaaatgcagctactctagaagacatcagcctgcatagagaaatttactttggcagcaacaaagagtcgaacttggctatctcaatctttgagcatctgccgtcatctcacaacaattactgtcgtgaaactccatcattaggcttttcttcggccacaattgttctgatcttccaagagattcacgctttatgtgaacacagaaccatttcagattataacgcatttgaaattaattactgacaaaaatgacctgtaaattctggtaaaacactttgactggttcggggatctggagtatgattatagataagagtattattcacatttagacatagaagcgcccatggcctaatggataaggcgtctgacttctaatcaggcgattgtgggttcgagtcccactgggcgtgtttattattttttttctcttttaagactcagaaacagaaaactttttttataatttgtaattagcaaatacaagtacagatagacctacctcattcacctctaatttctgacaagaaactagttagctagtttttgtgagaaagcaggttggagaattgctacacgtcgccgcagcccacccaactcacagtattacggcccaaccaggcctcccgtaacgggccgggctacatgcagtttccattgcgaccagcatgctggcccacggtcaggttagcgtgggccaatttgactggcccagttagtaggcaaatggactgcatgaaatgggccgtagtcctcctattttagctaggtcgacttctttttccgagacatttaacttcttgcaacttttaaaatatggcaattaattatttgtcactcgctgtatgacatgtgggtccagtggtaaataatttagcaccgggctgcaggaatt

SEQ ID NO: 46354 - DNA, 27914 bp, Oryza sativa
aggtccaagctacttcccccgtttcataatgtaagactttctagcattgctcatatttatatggatattaatgaatctagacacatatgaatatttagattcattcatatctttataaatatgggcaatgctagaaaatcttacattgtgaaacggagggagcaggagagatgaacaaaatctaatatatgcatgcatgtgcatcagtcaagggatccgctagctagctttcagtcagtcaatgttgggtttgcagcgtgtcaaaaaaaaagttgggtttgcagtggagatgtagtcagcatctatcattgacctgatcatattgacctgccaaaactagagttcaattccttagctccgatcccaaacgatgctagaatggcaggttatgttgtcccatgattttcacatcgacaatcttggggagcttatagaaagtatccacgtacatatagtgtcaagaaagaaattaatgtttatagaaccattcatatagacagtgcatccacgtacatatataaatgtattatccataaattaaattagttgctgataagttatatggataaacataagtataaacgaaataacggggctaaatatgacattagggctaaaagcagtggcggaactagaaaattgattcgttggtgtcataacgtgtctattggtgtcatagtatactaattatgtttaaatcatagtgttataatatatggataagcagtttggttataggttctgttaaaagtcgtcggtatcgctcgacaccggtcattacactagaatcgcccctggctaaaagatagatgaatatccatttcctggagacgacaagcactcggaaagtgaatgcatgaacgtttggaagtgaagatgcatgtgcatgacagggatccaagatattcagttgtgtcccttcctgagaaaggccacgcatgcatgcagctttgctacctatagctaactatacaggtgttaacttatatgctttctattcgatatgtcgtagctactcttactatatagtactagtgattacatgatcagtagccgctagtcgattgattgatcaatctctcaggccccattcagcagcagtactcgcactatacatactactgtttgaaacaacggcagtgcatatataaaatacatcatgatctgcagggaagcagtcacaattgaaatatctgctaccgtctcaaaacataattaactatcgagtgtactacatataattaaatctggagatggaagtattatacaatgcagcatgtatgaatatggccgacatgcaggatttcacatagtggtggtactcgatatagtagatctacttagtggccactccacatatggagatcactactagcgctagctgaatgtatgagctctgtaacgcaagcatggtattggtgacacaacatagctaacaactcttgtgtatttttcgtgtcaactttaattactactcactcgcagtgaccatatgattcatatgccgcaattctgatgcgaccggttctggccttctgggttaacaaatgcatgcacatatgtcaccgacgcaagtgaaaggataagcataattaagcatgtcactttttaaaaagtttgtaagctgttggtaatcgacacgtcgaagctattaggagagatgaacaactgaagtactatatatgcatcaatcaatggagcttttcagtcggtcaatgttgggtttgcagtggagatgtactcagcagcattggctactgccggcaccatgcttcattgacctgacaaaacttgttccttacctccaactggtagaatgacaggttacatgtatatatcgccccattattttagaacaatcttggggggctcagagcatccatatatatttatatatggcagagaaaaaaatcgcaactaaactagaacaagtgcagattgataagttatagcgatgtctcaggtataaatggcaaatgcctgttttatttgggttcagtctcagaaatcacagcaatgtatgcatgatttcttgatcaaataattaaacaactaaataggctgcagtcctatatatgaatatgaatatatatataaatatatatatatatatatgtttaaacaatcttactatgattcatacagatctgataaatactacagcccatgtataattcctaccaccacagcctgcaatcaggtactattttctccaatgtaatttaggtgtttcactaactccctacagaacgcatactgttgtatttatggaagtattacattttggcagagacacaagggtggatttgcgaggatggcttgtcaccagacatctctcaagtatctcccttccatctgcaagctctttacatagctttctgtgtttgagttgtccaaagaaccctgaaaattcaaggtaacattcagcaaagtggagatgaaagcaaagctactgttaaactctaaagagctttcatggcacttcacataattactcataatgcctgcttagaaagaggctaggctaggtgataaatactaagggacagagttctggatttgttttgacctcaatcaagaaagtgcaaactttctagaggtagagcaccactgcatcctcccactaagaattaactgaatctaacaggtaccaaaggtaatgatatacccaaacaatacctgttcctgcacaatggtgtgtagtgtgcggtgtacatctcttgccatgccctttgcatcaccacagacataaatataaccaccctgagaaatgatgctccaaatctcgggagcctgggaatattacaaagcaatggtgaaaaagggaaataaaacactacaccttatattaaacaaaaaggatcatttcatgtaccttctctgccattttgtgctgaacatactcctttgaaggaccctcacgagaaaaggctacaatcaattcagacagcgcaccggtctcaacaaaattgttgagctcatcctcatatatgaagtcctgaacagagaaaatactggtgaggggagttatttaagaggctaggaagttttctaattgccaatcaccaataagatactctcctacactcaaactacaatgcagaaaagttttctgaaagacaaggagagctctgacaaagcacatatgtgcataaccacattgtgcaacatcaatggcagatgtgttgatatttttaattactaagatttataagaatacctatgaccaacagatttcgtatattgtaaagttttctaagtacaaactgcatatgaatatgaataaagtaggaatgtatgtcataccatctttcgatttctgcacccaaagaataggacggcatggcctagttccacaccagtctcttttagagctaatctttcctgccagtgccaaatgcataatataatcaattgaattataagagtcaatatttgaggaaagggggaggaaaaacaaacctgtaagaagcccctaaaaggtgcaagaccagttccaggacctatcattataataggcacagtaggatcagtaggcagtttgaagtttgactgcctaacaaaaattggagcccagctacattcttggctctcttccaagggaatcgagttctgcatacacaatcatcagattaaaatgtttactggtcagcacgaccatcacatacttcaaacaaagtttttatgcttgaccaaatgtatgaccattgttttcaaagtgtactccttcgaaaatataaactctcattatatatgaaacaaatcgacaactacagaatatatgtatcaagaacttttcgaagtctttcatattgctgagggaaagatgcactccctccgtttcatattacaagtcactttgacttttttttctagtcaaactaacttctttaggtttaactaagtttatagaaaaaattagcaacatatacaacaccaaattagtttcatcaaatgtaacattgaatatattttgataatatgtttttcttgttggaaatgttgctatattttcttataaaattggtcaaacttaaaaaaagtttgactaagaaaaaagtcaaaacgacttataatatgaaacggatggagttactatataactatagaattttcagggagtgatacaaggttgagttactgaatagaatgagttgtttagtgttattggcaaggccatcacggtaagttcatcatgagaactgtaacctgacactttgtccatacatcaagaaacttgagaaattatgattcacgtggagtttttaaagtgggtaagaaacaggttcacttaaccagttaaagttggacacatgtaatgaagactggatcttgatatataagcatcaaagcgagctatgacggtcatattcaattatctaccaatcatccaaaagaaatgcagaaagcacagtgactataatatagaaacagagtgccctttcactatgatagaacaagggcttaccttcatccaagtagaacaaactcctttatggatccttccagtaggggtttgcccatacactagcgcacatgttacatgaattcttgttggagtcatcctgcagcaatgtgaatggttttaaatagataggtcaatttgctcaggttagaagggtattattcctgaccaaggtacctcggtgaggaagatatcgagtagtatctcggctgcagtcgaggagcaatggctgcaaagaagacaccaagtggaggctttgctgatgggaactctgtcataacttccaagagactccgttgacttgaaactatccattgagaatactccttctgccaaatgaagctcatgtgaagccaaaactaacatccaaaagcataaacttatattaaaaaccaacctttccagcaggagatgctagatgtcttagcctctcagcatctttgggatcagatgcatgggaagccaaagcaattaaagcactctgcatcaacaaattaaaaaatattaacatcaatacaaatatccagaaaaaatgcatatagaatgtaacaagatagatctgcaaaagttcaccttcttaggaaaactcagaaggtcagcatatctggcaagtgcagtccccacagtacagggggacgggaaaggaggtggcaaagaacccccaaaaagtggagtgccatcctcttggtcagcatgaattgagaataaggtatctggtgaataacctaacagattttctacctcctctacagtctctgtgcagttttctgcatatacaccaacatgatctccagtctcatatctgttaagaaaatgggggtcatcagcagtctaaacaccagtaagaaaaccgtgcctgcaattttgtcaaccaactactaaatttggaaagtaacaaattcagatacttacgtaagaccagtccctgaaatatcaaactctaaatgaatgcaggaccggtaagaagccggcgtgtgaagctcccgccgcacagccacatttgctctgcaaggaaagcatgatcagaatttgttcagaccacacccagtgtcccagtgcagtcaaattaaagaaataatctcatacctgcaaggatgctgaatgtcatatacagcatgaccattactgagactaaaggatttgttgatatgcatggcttcctctggcttgaccaatacaactctatattcaggaatagcagctgtgtagggagttggtgctgccgatttatcatcttcaacacggagcaatttatccaattctggccatagaagttccttcctttagttgaacaaccaaagcattagcttttgttttatgtctcaaagtctaaagttgatatcaatgtttaaaaagtgtgcacaaatagaatcagtgtcaaaatgatgcctgagttcaaagttgagacaaagactaagctaattacggtacgtaccatgcattgaagtcatcctcaatgcattgatcatcatctccaagaccaagaggaacaatgcgttttccacctaaaagagatgtggagaaaagttaaccaccaccaaatgatacagaacacgacagacaggaaaatcatgtgaccagaatgttgcaaagatcaacaatatctcactgaattattacatggtaaacctgttgttcagatctatcggagacaagtccgatttgatttagttgcacacttacactacattaatactagctccccttctgagtctaaaacactctacagaatatcggtagacagaaaaggatgaagacaaaaaaggcacagcattaaagtcttaaagcatatgatcctagtagcaaaccaccctgataaaattatgatgctttccagagcacgttactaactacctacataaaaagattagataagttgtatcccttatcctgtactcttctcatacagtataatttctgacaatgtttagtggcatacaattcttaggtgagcatgaacagtacaggcaaagttatgcctttgtaatatagatgaaaaaaatagtgcattgtagttattcgaacgatggttaccttgttcagcgaggagttggtcaaccacctttccaaccttcagtttaaaaagacaatgtaagtatacaaattgggctctatataaaagcacaatatcaatgtagaagcaccagcaaaccttgttaaaatgctcgtactgcctatttccgaggccaaagaccccaaaccgaagattactcaaccattcacctctctcattcccctgcactccagccaaacaaacaggccgtcaacagaaaatacaacgctcacccatgaaagggccatatgaactgtggatttgagagcaaacctctccaaaccatttatagaacctcgccgcattgtcagttggttccccatccccataccttcaacgagaacaagaatgcaactcagatattcattggaatcaaaattcaaccattctagtttctcctgaattaatcaatatcccgtcagaagtatagtaaaaagtggagatggcacctacgttgccacgaagaacaaggcgatgatctccttcttaagcttctgctcatactcctcatcatccgcagcatactcatcctgaaccccagaacgaaacaggcatgaatcaatcaatacatagaatgcaaaagcacatgaaattctgaagcagcgttagtggcaaatcgtggcggcttaccagatcgagcaccttgaagacggccttgtcgtacctcgacttggcctcctccgcaagcgcctgcgaatccgcaaccaattaagacccagggttttgctgcacgagaggtgacagacagagagcgagaaaatctatccaaccttggcgaagccctcggcggtgccggtctgcgtgccgaagaagacggcgaccctctgcctgccgtcgtcggggtcaggctcggcctcctgcttcctcttcgcgggggcgggggcccgcggctgcggctcctgcgccctcacggcgggcgcggagatggaggagcggcggacgagcagcgcgacgccgcagccgacgaggacggcgagggaggtggtgagcaggacgatgaggtggcggttctcggcgagcgagggcggccacccctcctcctccggtcgtccccgccccgtgagcagcgccgccaccaggtccagcgccgacggcctcagcgccccgccgccgccgccgccgccggagtccatagcgcgcgatgggatcgaggcggaggcggaggcggaggcggcggcgcgcgcgtgcggggtggtggccctagtacgtgggagaatttgggcgaaatattttttgggtttttgtggagttgagcgaaacggacggtgatgtgcgatcgatcggtacgtggtgtggtctgtggtggcgcggtgtgagtgtgtgacacgtcccgtcgggttgaggagagcgatgcacgtttcggcgcggccgcgacgtttggtggtgcgagtgcgagtgcgagtgcgagtggctcgtgcgccgcatggtttcactgttttactatagaacgccctcgaagcctctcgccataaccatcgccgtcaacaacaacgtacaacaaccacaaccctgcgaacgccttccagttgctcgtcaccatcgtcttgattctcgagccgtcgagcgtgttcgatcctaccaaattttgatggggggaaaaaactgaacatgttcttaccaatgctattctgttaaattttgctaattctaaaagttttcgctcttcagaactatacaaaattttgataagatttcgaatcaaatatattcaacactacttaaatttgataatatcaaaatgtacctaaatttaatattatcaaatattggtttggttgaaagctcctataaagtaaacaagaccactatctctagattcttgttggcgctgacagtaagtacactaaagcattggtaggccgcgttgctcggtgagaccaatatgattatcacagtcacctcttgttcgggcaaaattccctccacatggagtctttgctttcagcccattgcaacccaaaagtctaacaaatatgagccattgatttatgccttgatcaatgatggaaattgtctcatctctttatgatggaaagaaaaaccctaccttccattgggggagagatagtagcggcgattggggtgaagaagaaactagcaaaacacaagagagggaaaggagaggggagaagatgtgcagtttgttcagcttgggagctcttaccctatcttcatcaagttagcgattagaggctcgaacgtggttggattggcactaaacttggtaagtttgtttctcactttgagcacttcaatctggtcgatttgtataaggatgggttgaatatagcaccggatttgagtggtggtttgtcagctcgagttactgcagttacagcttgcgcaacaattggtagaatgtcagtttgaggggtcaaacagtgtccggttggactgtttttttggatagcttggaagggactcgtataccatcatttctgccaagtttcgtgtaatttgcatctgtggtttgggagaactcacctgagaaccgaagatggcctcttgttagctttgatggttaatgttgatgatgccaagtgtgtaacttaatgttatagctgctgttataatatgcctctagatttttcagagaagactccatgtatatcctaattgattatagttgaagcttggagtggaccgttggttccgtggtttttttatcctcacaccgaggaggtttttccacataaatcattgtgtctttatgtgcatgtgtttattattgttccgctgctgatctgctagtcgaaaccatcctcaaagtttatggcaagataagggtttgattgtgtgaaatatgtttatcagttggtgaattgtaatttgcacattgaagagatgtggttgagctccaacacctcacacattaacacaacccattcgttgttatttgtagcctctcagttaagtaaaagcagatatcttaatttcacatcttgactttatgtttttatttttacgttatttgcaacctctcggttaattaaaagcaaaggccttaattcaacattttaaattagtttttaactttattgttttttctttattatttgactccaccacaatacgagaattcactattgccaaaaggttgggttttttttttcaagttcttgtggtaaccatagatgtgtcgtggttatattcatgccacccagcatgaataatgaactgttccaaaattactttaaatgcatgttgaataaagcatgctcgcaatgcacctgtgttgcaccaacctggccgtactcttttttttttttttagaaaaacatggctgtactcagccgaacaaacttgtgctgtctgagtatattttcgcttggttttcctttgaaaactctgaaataataaactgctaaaaaaatcgaattgcatgtgtatgtccatgctgaataatactcctacatggtagtgattccaatcaaatcaaagagatttaattaagagtcgtgtttaactagaggaggagacctcggccaggtcggtctcgaacgctttgacgaggttcccaaagtattgccgcgtcaccctggtgagcccggcgagcttctccctgtacgccctgtacttgtcgaagtcgacggcggccttgtcgtcggcgccggcggcgaagagctccctcctctccctctcggcgcagccgtgcagccgctccagcgacgcgttggcgtcctcctgcaggtactcgaacagctgccgcttggtgaagtcgcggtccgggtcgaggtagtagccgtaggcgtgcgcccagccgagcacccgccgcccctcgccgacctgctcgtacgcctccgtcacgaagcccatctccgtcgccggcacgcccgccgccgaggccatcgcctccagctccgaccgctccaggctctccatgtcgcggagcgccacgcgcagcgacttgaggttggcgtcccaccgctcgtagtggtagaggtacctgtccagggacgccttggcctgccgccgccgctcgtcgtcggcgttggcgccggccagcgccaccaccgtgccgttgggctggtaccgggagcacgccgcgtggccgtgccatggcttgaggcagatccagcagaactcgtggaggcacggcggccggcatgtcatgtgcatgcacccgaggttcttctcgatcggcagccggcacttggggcagtgctttgtgtgggcgagcagccacgtcgccgtctccgactccgagctgttcttctccacccacttcgccaccgtcttgcacgacaccggccggtgcgcctcctcgccgcaccgccagcacagcccgtgcccgcacgagcagaacacctcgctgctctcctcgccgtcgccgccgcccacgaactccacggcgcggctgcacccgggccccgggcaccacctcatcccggcgctctcctccacgtacgaccggagcgcgaaccagccgaaccgctccctgtcctcgccgtcggccaccgcgtcgaccagctcgcgcacgacggccgccgggcacgacggatccgggcaccggagcgacaggcaccgcgcgccgtcgcccaccgccgcgcggacgtacccgcgccagcaggagacgcagtagaagtgggagcaccccgccgacctcatcccgccggtgtcgaacacgtcgaagcagatggcgcaggtgagccgccgccggttgacccgcgcgggcacctcgccgccgccgccgtccgccggcaggaggccggcggcgtcgcgtatgcggcgctcgtccaggaaccactcctcctggagcaggacggccctccacctgtacagccggaggaggacggcggcggcgcccggcgagagcgagagcacctcgcacaccttggcaatgtcctcctcctgccgcgcgcgtacgtcgtcctcggttagaacaacgtacgtcttctccatcgccggcgcctccgtttcctcgaccacctgcccaccatagtcgtcgccatcgtcatccatgtaatcgccgtcgtcgccataatcctcgtcggagtcgccgaagtagtcgtcgtcgacgtcgctgtagccggactccatgctagtagctgtccgagatggcgacggcgaggacggattaattatcgatcagccagggtttaattaaccctaaccctcacaatttggcctcgcgcgcgagcctttatcggatcgagatcgcctcgtgataataaactgtttcgtttttaaagattgcttgctaaaataaatcggaatcgccttttttaaataaataaattcggaatcggcttcttagctaaattgtacttccggatattgcacgcgtgtttctgtgcggctgttatgggtggccgaagattggaaaggcctaggcccttagcccggcccattactgagaattcgattacggcccctttgttctcatgttattaggacgtcttttatacaagtacatacaaaacataacgagcctagacacctcccggtaaaaaaaaaagcaatattttaaattttctttataatctatgacgtgtgattttttttcatataataatttaagtgattatgaaagcaccttcaaaatccaaatcatcacatgctgtttttatgttttcaaattaactttttaatattattaataatcaacattttaaaagtttaatcaaatcgcatacaaaatgtcaaatactaataactgaagggagcattggtgatacacgcttataattggtagccaatgagcctttattccaatttaaatagagtaatacctagagaatttcgtgctataatctttataattttgaaaacattatttcacttgatcattttattggcagaagttagggtttatccaatcacttcttttttttaattccttctttttcatttatgggacttgttggctgtgtgcacatggccacttgggtataaggagcatattgatccatgtatttttgaaagaaataaaccatagtatttgttaagtgtaccttataaaatatgaattcctaattcgtaaaaaatgttggcccaaccaatggatcaaggtacaaattttcctgatgtaattgagtgatcatcaagtattctagtactacaaaagtgttgtcgttaatttgcacgtgatcctacgagctgtcgtcttgatgaagaggctgaagaggatcaacaggatcgtcggagctctcggccggacctgtagctacggcggctgcggcggcggcggcaacagcaggtcccacctccaacaggccgtcctggaacgtcttgacgaggttacggaagaagatcttgcagacgccggtgagcccggagagcttctgccggtaagccacgaccatgtcgaccatctcgccggccttatcctccatcttcttcttcgactcctcgccgtcgttgtccttgaggatagcgttcaacttgatggttcgttccacctcggcgaggagctcctccctctcgtgctcggcgcagtcgtgcagcttctccagctgccgctcggcctccccctgcgcgcactccaccatggtgcgccgctcctcgtcgccgtcgagccccgtgcccaggtggtagtacccgtacgcgtacgtccaccggagcagccgccggcactcggcgatctgctggtacgcctccgccaggaagcagagctccgtcaccggcatggccaccgcggcggacagcttctcggcgcaggcgtcgaggccggccatgtcgtccaccgcgctctgccgcgccttcccgtgcgccgcccaccgctcgtagaagtgcatgtacctgtccagcgacgccatgccctgctcccgccgccgcttgtcgtcgctggcctcgccgttggccttggccgcgtcgtagacgttgcagttgtagtactcgctgctccggtgatcgctccacgggctgaggcagagccagcagaactcgtgcaggcatggcggccggcacgtcatgtgcatgcacccccggttcttctcgatcggcagccggcacttggggcagtgcttcgtgttcgccagcacccagctcgccgtctcggacttcatggcgttcttctccgaccacgcgtacaccgtctcgcacgacaccggccggtgcgcctcctcgccgcaccggaagcagaacccgtgcccgtgcctgcactccacgtcgtcctgcttctcctcgccgccgccgccgccgacgaactcgatggccagggtgcacccgggccccgggcaccacttgatcctcgtgccctcctccacgtacgaccggagcaagaacgtcgcgtaccgggctctgtccgcgtcgccggccacctcgtcgacgagctcacgcaccacggcggcggagcacgctgggtccgggcaccggaacgacaggcgccgcgtggacgtacccgcgccagcagccgacgcagtagaagtgggagcacccggccgatctcatctcgccggcggggtgctcgtcgaagcagatggcgcagacgagcgggtgggcgttgcgcgacacgggggcgccgccgagcgccacgccggtggcggcgccggctcggtcgccgtcgcagaacagcctgtcctggagctcgacgaggctccacttgtagtgccggaggaggacggcggcgaaccccggcgggatcgcgaagagctcggccgacgttggccgtgtccgcgtcctgccgcgcgcggacttgctcctcggacagattccggtacctcctgtcgatcttggtgaggttgacggcggcggccgccttctttttcttggcctcgtcgtcgtcgtcgtcatctacctcctcttcctccagatcccaactctcgccgtcgtcgtcgacgttgctgtccacctcgtcggtgtaatcgtcgccatcgtcggtatagtagctttcgtagctctgagcgtcgtcctcgccgtcgctcgccatgcctgcgctgcgtgctagcaatctaggtcgacaactgattctcagggtcaaggttgaatttttgtatgcacaattttccgtctattttttccgctaaaaaaattccatctatttccgaccccgagttgggatcagtctcgaactcagatcctgaacggattcgcttcttaacaacaattttaagttctcaataactttagtcaattcaaactgagtacggtttatttttcgttcaacctctctttgaccgatttcgtaaccaagattgatccctgcttcaaaacacaacacagtgctgtaaaaaaagaaacaaaagctacaaatgacttgacatgcatcacaaaaaaaaaaacaaaaaatcagacagcacagcatacaccattaacgtcagaatgtatgattggttggttaatggaagaaacgtccacaaactttattagtacattataaatacctatcacaaaatttattatagattgttattatctgtctcttctgctcccgtgctaagaacaggacaatgctgattgagctttactttactagacataccaagaatgccaatctctaccgtcggaaaacacgatttgtgttccgaacaaagccgcaccggcagacatcaccggcgccggcgccgccaccgccgccgcggcggccattgtgagaccccttgcactgtcccaagcaagcactccacatcatggctctgccattactccttcccttgctgcttgcaccgaagaggatccctgcgacgtgcatcccctgcatctccagcttcaccctgccatccttcttctccagggatgcctccatgaccccgatcatggggtcaccaatggcggcgtacccttgctcgggatccctcacctgaatcaggaccacagagaccatggaatccttcgtcgcctggtgcctccggtcgccgtcgtcgtcgccggcagccgtggacgaggcagagtcagccgtcgaggccatgcgaatctttaggccttgttggaccagtccttccatcttgtccatttccatgaagaggagagcctccaagaagtcgtcgccggagctgagcctcgccgagcggcggatgactttgccgggattcttccggccggcgatgtccttgatcggcatcatctttgacagtaacttgcacaggttctctgcgctcgtctctgtcatcttgtcaagaacctagagatcacaatgccacagattgtcgaacgaaaacaatgtgcagtgcaatggatgatagacttcattggcatccatggatcttgacagcgatcgaggtggctcacctccgacgcggtggcggcgttctcggcgacgacgggctgcgacacctgcagcgccagccgctcccagggcatgcccaccacccgtttgatctcgtgcaggtagccaccgccttccagcctcaccatttcccgcacgccgccgtggccaccgacggtgacgcgcttgttggccgccgtggcgccgatgccgctgcaggcgctgctcacccgatctctggtggccatggcgccgccattggcgctcctgccgtgctcggcgagcctactgccgagcctcctgatctcctcctccaggaactgcaccctccgccggtactgctccgcggatgctctagtggtcgccgccgtcgcgccatcgacgacgttggcgcgcgcaggcggcggccgcggcgcgcggcggtggaaggagaggcaggacgcgagggcggagcagccggtggtcgccacgggcggcgccggctgcttgttgtggccgccgggcatgccaatcttgccgatcgatcggtgtggcggcggtgcggtctccgacccgctcgctcgccggcgccgtgcaatttgacgcgtttgtttatcttgtataggcgccgcgccgcggctagctagtgaggttagttgcgatctatgcgtggggaggccggatcggatcatcggaggcgcgattttggagtttgaattcgaaccccaaactccaaaggtgtttgtcttggccaacttcatcttggagcagcaaatattgcgttgcgacgtgacgacgcggtgcattggatcgtgtgttgtacagccgcggtattcattgcatatcagttatcaccagtacaaatccattggatgtatccagtatccgtgcctgtaagggcctgtttagttaggctgtgtttagttcacaccaaaattaaaagtttagttaaaaataaaatgatgtgacggaaaagttggaattttgtggataggaaagttttgatgtgatggaaaagttaaaagtttaaagaaaaatttgcaactaaatacagccttggtgaaatgaaaatttttgggtgtcacatcggacgtttgaccggatgttggaaggggcttccattgtaggagtaattacttggggcttacgtgtatactaccgtgcagtaccgcactgctgctgatgccttgttgatacaactgtgggaacagtttcaaaagtacgaagagaacaaaaatctctaatattttgtatgtcgaagtttagaggttgcgatcttgtagattttcggtctcatcatttggtttttttccctaacaagtcaaaacggtttattagggaaaaaaataaatttataggtaaaatatatatatatatatatatatatatatatatatatatatatatatatatatatatatatatatatatatatatattgttggtgacttaaaagttaatgctaaaaaagaaattacgttgaaaaaaaatctcaaaatcaatgtcaaaattaagtttgaaaatttaaaatttagctttctatttggctgattaggccatccaataggagcctttcaataatcgttttagtctcatatgttgattttattattttagttcttattgttgtatgagtatttgctctctttgagataattttataataaatggttgtaccttctttgaagcaaaggtccgaacttttatttcattatcttatcttaggccctgtttagttcctaaaacaaaaattttcacgttgtcggcttgtcgcatcgaatgtttaaacacatgcattaaatattaaatgtatgaaaaaactaattacatagattgcgtgttaattgcgagacgaatcttttaagcttaattgtgccatgatttgacaatgtggtgttataataaatatttgctaatgacaaaataattaaacttaataaattcgtctcgcagtttcctagaggaatctgtaatttgttttattattagactacgtttaatactttaaatgtgtgtccgtatattcgatgtgacaactaaaccaaaaattttccacaacaaaaaaaaaggccttaaaataagacaaaaagtacaaatacatttactactagtagtacatagtacacacgatgataggagatgtgaccgtatgagtggggccgtgtttagttcccctccaccagcttcaaactttcaactttccatcacatcaaaaactttcctacgtatataaacttgcaacttttttttcaaacttctaattttcttcaaacttcactctttttccaccaactaaatacagcctgaggtgagcttcctaaaatagggaaaaaagaagataaaaagaaaaggtgtaggacacatgggctttagtgttgcaggactttggtccttgtgggccttgtaatgctgagctcaggctcatccgacacgtgtgcctcgcgggccttgcaatgctgagctctggcccatcacggcgaagacacatgcgccggggagcggcggtggaggggaggattgcccgccgcgccgcccgccgcggccgtcttcctcctccctccatctctccctcggaccctcccaatggcggctcctcggcgcggagtgcagcgagcaggcgcagcagcttttgtgtgtgggcgaccgccgtggggctgcacaaggccgtctcccgcatccctcgagggctccgacgccatcgatgatcgcccgcaccaccaaccccaactccggcgaccggccaccgggccaccaagtggtactgccatactctcctctcctctcccctcccgattgctggtcatcgatgatgagcaccaagctctccgcctttgtgtgtacctgtaccctcgatttttttttttgttggaaggactactctggaaatcccattgttgactgttgaggatactggctcttagcatatgcttctccaagaattgttcatgtttgatgcaaacatatcttgtgtttctgttcatgtaattactggtaacttgatgccttgctaaaaaaagagaactaattaacctgagatagttttaagtaaacgtatggatatgtttctgctcccaacatctatgtccttataggaagctttattgttttctggaacaacactgctttagaatcatttagatgccaatatgccataatcaacagagatgttttggttttgaccacctaattcgcatgaaagatgaaatatcttagggcggggaatctgggaacaatgatgcttttcagggataaatgttcaaatattgatgaaaggcttggttttccattccacgaggtgttgttttcttgtgtcctactattggacacacgtgtcactacttcttgttatgttctgaagccttttcaacaatctgaattccttgaatttgagaataggaacatccaagacaagtgcctgacttcctatcttactttcaaacatgttggcttcgtactttggcagatctgctcttactccagaagcagcatgaatccatttttttcaaataaaaatgtatctgttcttccaatgcccatagcaattggtagcctagtaatggatgaacaccattccagatgaagggcttacaatgtccatgatactatttcattaacaatagttttgtagagcatgccgtctcgtttttatttatctcctgtaatttaacctataacttaattgccgtcatatataatatcatttgccatattattttacatgcatttggcatgaattcatccacgccatgtataatatgttccgttttgaacaatccccttcaccgtgtcatgctgtagtgtttatgtgcatttggtatgaattcttccacaccatgtattaacattcagttttgaacaatccccttcactgtgtcatactgtagagtttggcatagagcattagaggctcaatcatggtggaaatgcagcaggcgtggtgggggagcttggaagatgcaatgggggtatggtgggctagtggctggaacagaacggtacatacacatctcaacttcatcagcactttttgctaaataaaatatgtcgtgaggttatcagcttttcttaaacttgttttcccttgatccggggcctttttgcacggtaggaatagagccaggttctgctaactggcagtacctaatctaaatgcaaaggcaggcaaattctttgcgtattcccgggaaaagaacttgtattgccgcagcacagacaagaattaaagcaagaaatggtattcttctagctagaggccggaatacataaattcatcagggaaagaaacacgtacaagaattgctagcaatagtacattagcactcaagatactaattatcactagacataacagctaatttagagaagagagtataattaagagccaactaatttagtactaggaggtaattatgaacgagggctatgaggaagcaggaagctgaggtcctcgccttcgtcggcggtggttgcgacggtagcggtaggctctccttgtactatctcttggctaggggaataaggccccgactttggctctggctcccgctccggctccggctccggctccggcatctggagcttgtcggccaaggtcttggcgcccttgagcgagagaatgagccagacgaaggagaggaactcgccaccttctccgaggctcttggcatgtaggtatcccctacacatgctggcggagtagaagagcatgcccacccacacacggtacatcacttggcaccgtgttctgcggcccatcttatccatcaactcctctgcgagcctgcatgcgtcatggacgagagggtacttggggggagggggctcatccaccctgatttccctctcttgttctcttaccatttctatgtcgatcgcagcattgacctcagcattgacctcagcttttgccttgtcgatgatcttctttgccaggatgtctcgtccgagcttcttgaggctatgcggctgctgctgctgagactcaatatccttcaagatgagctcaacctcctccattgcctgcgtgaagaggtgctgcctgctgccggtcatgagcatgtcagggcggaggttgagaaggtgggccatgtagtccgatatcgcctccgtgcactcgagaaatttcctgtcaatctcgtcgatggtgttttcagccatcatgcggcgcatgcaaaggtcagtggcgatgtgccagaggatgacacccctatcaaaggacccacgcaggctgccctgtacctctaggccgcataccttgcgcaggttctcattgagcacccagttgcggcgccccggcgcgaagcttcggtagctggtgaagtcgagacccttggcattcgcctccactaggtcggagaagatcaacccggccagcatgtggtacaggttcttgcgttggcaaacgaagaatccctgtgtgtagccgacatgtgcggcacacttgagcaagaccccagcaggctgtgtcctttggagagctgaccggatgaggttattgtattgggggactgtctcgcatagcgctgcgacatccgccatggacatgagcttgaacagcagctgccggatgggctccgcaaggatgtccagcgcggcggtgaggcagaggagcacgtaggtgatcttcacgtcgatggtgttgtggtggcgcttgctgctggcggcgaagagcacgatggcggtgatgtgaaggaacggcgccaacagtatgtggtaggccaggtatgcaggggtcaacaccacgttggctctggtgtagatgagcgcaaacgctctgcgaagccaacgcttggagcccttctctgctctagggcttagggtccccagcaagtctccctccacctcctccttgctgtcatcttctcccatcaaggattggcattgacggcgacgacgttgttcctgcttgaggtcagagtcggcagctagcagcgacatgtcggagagtatcagtaggaccttgtctctatctgtcaagatgtgctgctgactcctcttgacaacgtcagtgcctacccctggaggaggggtctccttctcttttttcagctggcagcagcggtcgagtatgtctctcttgtccttttccagctcggtgaagcagtatctccacttgctgacctccttcctgccttgtaccatggacgacacagctgccagccggttgatgctggctcgtcggagagcccacggcttctcggtgaagctgaacaccccaatgacgaagagcaggacggctgacaccagcagcttcctgtcaccgccattggcgggccatgacttgtagaaggcgtatatggcgaccgtgacctgggacaccagagtcacagtgtgccgcctccacagctcgttgtcctcgatggtgtaggcagacatctcctgctgcccgccaaggtggatgaggaggaccggagcccataggacctccagggcgctgccattgacacaatgctgtttcgcggcggtggtcgtgttggcgtggcggttgaagagggtggcaagcgcgtagatggccagggcgtcgctgctgatgtaagccagccagatgaaggtcctgaaccagtgagggatggtgtacttgcgcatgggggcagccagcagaaggaaccactggatgcccaggctgcacagcaccaggatgcgcatctgccactcgtcccaccactgcacagcggctgacacattcgtcattctatcatgcatctaatatctgtttgttactattttttttgtttgtgcatcgtaggttcccgacaatggacggttagtttagcacacctatatatcagaatgacacttgttgaacacagtttttctgtagcccagctgaagacttgctttgctagtgaagctcactttaattattactgctacacatgtgcgtgtgggagagagctaaagtgagggataagcattacatgataaaagccgaaaaagagaatgaacatagagaaaaatataaatgtacattacaacttttatcgaaaataaaggaaaaatataagatgtacattacaactttagactttatttatttacagtcatgcgctgcccttcgcgcacagctttgtatgatctctgcaatattcctaaatcttcatatgttagctagtgtggagctattgatgatgtctaactctttgctttgtttacgaggtggtccttactatctttgcatttgcatatttgcgtgcatgttagcgaaataaaccatttgttcttcagccacccaaacatcatctgtcttatcaaaccttcaaaataagagggacttttgttcatcttgcaccgaaaccttttcccttgcttgttttcctcttccttcttgtcggtctgttttcctttttcttttctccttctttctcatttcctttttcttttcttgggccacacctcgttgaggataagattttcttgggaacagttctgttgagtgagagcagtgcaaacacaactttggttcatgttctgctagaaggctagtacagtgtaaacacaatcttggttcatgttcataattggagatattactgctgaaggaggtgcccgcaaggaattgcagtcctgcagataagagatgccatttgctagttgcctccttggtaaaagtcttcacttgagtttatttatttgctttcctcttttccttggctggatttcccacaagtctcgttttcttatcagcaaaaccttttgttgacaaaaggtggtgtgattgtttaagtggggtccgaatctttttcttcttaaataaaggagtggaaatggaatagtgaaaggaatagtgtctctgttaagctttccttcatttatgttcctttcttactcgatgctgttgcctaatatatattcccttatttttatattaaaatgtgcatccaggccacacggttcaaattcttttttttagaacttcaattctaaattggtagtattaattggtgtccactagtaattttaagacacacgcgctcagtgggtccatatatatgctccgggaattttaattagccgtgtgtgaagaacatgcatgtgcatatgatgtctgaatgttgttgtgaaccttgtgtaaggtgtgaggattagtcctcttgactttgtttgtttgggctgtgtacatttaagttggatgtagaggttaggtttttaatccattttctaaaaaaatgtgcatatgatgcatgcgagtgtattttctgtaatatatttgtatattattgaatttggaaaaatgagatgacttgaacttcataacaatatatagatgagtgcgttgaaaatagacgcgcatgtaggtttcattagattctcacgtttgtaggcggatgaaaggtccactattcttctgttacttttgggtatgcggtggctaatcaccgagctactccctccgttctttttttactacttgccatataaaatactggcacagtgcatatatttaataattgaatttcctaatattatcttcgtaaaaattactgtattaaagatataactagataaacatatttttcattataactctgtcaatatcatttatcatattttaaatcttaatatgcatatattagtgggttaatgtatagaagtttgactacacattttctatttatgaaacgatgtagtgatgaatgcttttgtgataatgcaacgttcatgaaatatgtcagaaagaataaaatagcataagaaagtaaatagcaacaagactgaacgtgcatgagcatttgcctttttctttcagcatgtgaacttcaatttagtcaggattatcatggcaaaagaaatatcacttcaccctgccaagaaatagataaattatttgttcgccgcaaaattaatatgcgaaacagctaacggtcctagcgcataagttcggagcatatattcttcttctttccttatggcactcattagcaaggtagccaagaaagctctatataaaccatgtgcatcaccttacactgcctttaacctcctttctttccctaggacctacccctcccctaccctcttgagctttctcaaataaaaaaaaaggaacacctgaatttttttggtgattcaaagagaaaaagacaaagatttgatgggtaacatgcttttatcccctgttaatttcttgtgaccattatttttttctgccttggtttttggatttcatacagaaagtgtgttggtctgtgctaatcttttcctccctctgcgacagcatcttcgagctctaccatgatggcaaggcccggcgctgtgaagaatattgaaagctgggacgagtttacaaagcattttgtgaaatcagaggacaagctggtaaacatatatacatatataatccaatccaattcagatttacatgtgatgtgatcgatcgacgcattcatgcatgcatgaaattaatatattgaaatatgaatgatcaatcaggtggtgctggtattcatggcgccgtggtcggagccgtggaagctgatgaggccggcggtggagaagatggcgtcggggctgaagagcgaggaggccgaggtgtgcacgatcagcgtcgaccggttcaacacgctggggcggctgctgcgggtggaggcgctgccgacgttcgtgctggtgaagaggcaccgggcggtggctcgcgtcgtcggcgtcaaccgggacgatcttcacagcagcatcaacaagcacctcgcaccaccctcttcttctccacaacccattaatatttcttagtgctgttgatgattcttggttgattgcatgatataatcgagtaatgccatgcgtcttaattatgagttgtaattgtttatcacatactgtatttgagacatattcaaccttgtttcgagaaaaaaaaatggagatgaaaaaaaaatctattcatacttatagattttctttgaagaatttgtcttgatagggttgacacgcagttagcacgagagaacttccgtagcttgccttctgtacctgtatggctgtatcgatatgtatgcgtgtcttctacgcagctaagatatgaaatatatcatatgaggctgtggagaaattgactaatttatactcctacgagaaaaataattaatgctttcagaattccatttttcagtcttatgttaatgctatgcttgccaatttaagcactttgccatttttattcaagaaaaaatagtggatgctatgccatgtgtacccataaaaattaattaaaatgagaggaattaatgtaaaacaaaatattatatacacataggatagtatattcatctgattcctaatcctaattctcttcgattgattgcctccatctattcctaggagcctattatatggttctattctagggatctccaccactcagctccaaagagattgaaccatagatccgtggaatagaaaatttcagtataacactgttacattctagtgtttttaagtgagaaattaggaatttaggggggtcaccccccaacataatatagcttcgccaatggaggcaataaaaccatagatccatggaattagctagggaataggccaaggtaatacaagagaattagggcttgtttagttcccaagaagttttttccaaaaacaccacatcgaatctttgggcacatgcatggagcagtaaatattaattttttaaaaaactaattgcacagttagggaggggaatcgcgagacgaatcttttaagactaattagtccatgattagccataagtgctacagtaacccacatgtgctaatgacgaattaattagtctcaaaagattcgtctcgcggtttccaggtgagttatgaaattagtttttttattcgtgtctgaaaactctttccaacatccgatcaaacatccgatgtgatacctaaaattttccttttcgcgaactaaacagacccttagaagaattagattcaggaagtagaataacatgagaggaagtacaggggaaagacaaatattccctccgtttcatcatattataagttgtttttgacttattttcctagtataaaaaatatttggttatagaaaaatgtagcacaaaattagttttatcacatgtaacattgaatatattttaataatatatttattttatgtataaaatattgatatatttttctagatgtttggtcgaattttaaaaaattaaaaaaaatcataacgactcgtaatatgaaacatagtattatgaatataaaataaaacagagagtactataaatgaaagtttgttcaacacattatcacaagaacaacagatacaaccgacatgaagggggattggattctctgacttacatatcaatgtcttaaagttagataaaagtaaatcgaaaattaaaaaccgattcccacaagagctagtatatgcaaacacgcaaacaaatgctcaacacttgcagcatgaccggtccccagcagcgcagtaaaacaaggaatgattacaacacatgttaatgacctacgtcaaaagacagcacgtataaggagactcatctgaagtagggttattgtttgattttacttatttaaccagagttcaaacaatcaattaagtgttgagatggttaatctatcccgagcctcatcggttgacctaataagtcaaaacaaaagccaaaatttaaattttctaacttgattttgaagttacattttaagatgttttaaacataatttctttatagcattgggttttaaatcactatgaacaaatatataaaaaatctacctacaaaataaattttattacctaataaactgttttaacttattagaaaacatagtcaacggatgaggctgcccgttttctaaacagaggcagtacatagttgtacaagagacgtatcccgtgtttagactttctctatactatattcattctagtatatatcagtacaaattaggcatacataattaatttgatattgtactgtacatcgacgaaattcaagcaaaaaaacaattgatcttgcaatcaatcgatcagttagctcttctagctaaaaaaaaaaaaatcaaccgtgcggaatcggcgcgccgccgccgccacggcggttcgtgtccggcggcggatcgacgtacccataatccgtctcctgatcaacagcgacgccgacgacgccgcgcactggccgcttcgtctccgtctccggcaccgcggcgtcagcctgcagattcactccaccaccacttgtcgtcgtcgtcgtcgttggcgacagcactactattgatgcaccgagctccaccggcggcggtggcggc

SEQ ID NO: 46355 - DNA, 4130 bp, Oryza sativa
gccgccgccgccacaagcagcagccgcattataagtaggagggcgatgacgattagtgatatgaaacggttgggtaaagctcgcttcaaattcagtttatgcatgctatttatgcttgtgcttaattaggaagctcatcacaagcgcgtggcctacctaattaaatcaagctgatcatcaatcacttaattaatttaattcagagatatatccggatgtttaatactcctagttgcttcattgcggcaagaaaatggatcctcctcgacgtccgcgccttcatcgccgatcgccggaacgccatcaccacggccaccgagctgagctcagcaggagctccattgaggagggcactgacgagacgaggccatcggctctgaactttagggatcactgatctcacgcgatataaaacttaaattggtcctagggagatcacgaatgtgttcatttcgcgttaagattataagtaggtcaaccagcgaaccaattataggcaacctcatttccttgttgttttgtgcttaacaccatattatgaaactttcatcatttctccaatccttcttatccacggctcatttcaatgcaacttctaatgtttcttagccatgttgcttcttttgtctaaaggacaaagtctgttttactcccataactatcagccgagtaagaggttttagtactcaactataaaatcggatattgtatagacctcgcaatgcaactgtccaaaaatcgaacaagttcccctcgaatggcaataaggttgtttttgcaaagttggcatccaaataaattactaatatacttttcactaacatgtcacgtaatttcaataatcaagatagtaataataagtaaaagacacagtaattcatcccgttccagatgggctgaaaataaaactctaactggcgggccgttcgacttatgggccgattatcgttgggcctggacggcccatggataaggacgatccccatctctccggattccttctttccttccttattggggaaaaataaaaaagaaaaaaaaagatatggtacatcaaccgagagctcgctagtcgtcgtcctcgaaacgctcgcggcgactccggtggctgccgcgccgccgcctccggccgccgtaccagcctcacctcgcttcggtaatccctcgcctcactccatccatccccattccccaatctctccggctcctgcttgcagtagtccgctactcctacgaattcgccgccctcctctacttgttgatttggcctcttggtatggaattgagatcgcgaaatggtgcctccatccttgctggctgggcttgggtggtcgatttttttggggtgcttggtggttgatttggtggtaggatttcgtggtggggggcttaggtcattcacggtcaatttcgcatcggcgatgcgtttttcagttgatccagtagtttgtttcctctactggcgaatcgtgacaaatgtgtgacttgtttgggatatgctacggcaactcgaacctttagtcggtttgaacgctggtccgctaatccacttctcagtttcttttttctttttaatttttgggtctgtttttgtggatcagtttctactgattaggcagatctgaaccttgctttgagaccaagctaaagtttttctctttggacggattggcgcagagaaattagttatcttgtttctttttctttgccaaatgttaattaaccgcagtgaaggattagcctagtaacagtatcccatgaatgattaagtgcatgacttaatgacaaaatattttggtgctgttattttgttcttgtaaagcatgatgtttagaatagccatccattcctgttctatatcctatgctgtcacgtagacatgatatgttctccttccctgctgaaaaataggcttgcaatcagttagtatttgcctgatgcttgtttgtttctttcagatggaggatggagtgtctacttatactgttgatgaggctcttatttccatggggtttgggaaatttcaagcatttgtgcttgcgtactccggaatggccaagatatctgaggcaatggaaatgatgcttttgtcatttgttggacagtcggttcaagctgaatgggagctttctgcgcaggcagaatctctcatcacaagtgttgtttttgtaggtatgcttgtaggagcatattcttggggcatagtctcagacaactatgggagaaggcaggtcctttactatttacattccactgtttgtcagatttatttgaaatcttcattacaaatctctctccctaacaatatacagctattcctattactgttaattattgcatatttatcttctaatagaaaatctaggtattggcattttaatgagtcatggtgctcttgaatgatatcaaatccgtattatagatatgatagtacaactcttcaccctatggctttactaaatacgatgtcttctgggatagtcagattaatgtaacccttgctagagcttctttgagagactgagagcctgagagacaagagcttgtgtggagtttggatgtaggcctgcaaatccccatatactagactgttcccacttttcagtgacaatgagtgctacaacccagctgattaaccatatagcaattgacagagacaatatcatggttaggaggaaaatgtgcatgacactagatgacaatctgaaattcattttacttggggattcttctggccttccagtttttctaaaaaagttccaagatactccttttaaattttctgttcatgcaataacaagaaaattacttggatttcataaggatcactcacagaagccctctacagtacttaatcaccttgagatgatgttttcatacattgctggtgataattttaatagccagttctctcattaatctaaaagtatactaaaaatacgcattttacaggatgtaactttatttttctgactgtattcccttgatacttttccagggttgggttcaatttcacagcccttgtaactggtggggctggtcttcttagtgcatttgcaccaaattacctttctttgatcgtgctgaggtttatggttggtgttggactgggtggtggaccagttttatcttcctggtttttggaattcattcctgctcctaaccgaggaacttggatggttattttctcagcattttggaccattggcacaataatggaagcttcactagcttgggtaaatttctacattttgccaaagtaatactactgtttgcaatctgccttgggtcatagtggttcaactgatcatacaagtcagttaaacagaacgatgcaacatatgattttaaaacagtcgctatatttattaaaacagtggagattgatgtaattgaatttctttggttctgcactgcagcttcgatgcatgtgtttctgctaccctgagtaaatttaacagtgataaaatattagaatagatcagatcccatggaacagaataatgagcttgcatttggttagtcagtgatgatttatgcatttcatataatgtaatggaaactgcaatgaacaatatgttgccttctagtatgtactgatgtatgctccaaactgtcattctaattttgtaggaacttattatttgtttaattttcaggctgtaatgccaagtttgggctggaggtggctgctagcgttctcatcgttgccatcatttgctctactactgttctatccactgacactggaatcaccaagatacttatgcatgaagggcagaactgctgatgcggtgcaggttttggaaacaatggcacgattaaaccgtgtagctctcccttctggccatcttatgtctggccatcgaatggagctccatgagttgacagattcctcagagacatcacagttgctttctgctaagaaaaccaaccctgctgctcattctagcaaaaccgagattgggggccgcaatgcgattttaaagcttctgtccccaaatttaattagatctagtcttcttctttggactgtctttcttggtcatgccttcttatactacggtcttgttctactaacctcggaattgagtcatggaaataagatttgtggatcagaggggatagta

SEQ ID NO: 46356 - DNA, 12771 bp, Oryza sativa
tacatcggacgtttaaccggatgtcggaaggagttttcggacacgaatgaaaaaactaatttcataacttgcctggaaaccgcgagatgaatttattgagcctaattaatccgtcataagcatatgtgggttactgtagcacttatcgctaatcctgaacaaattaggcttaaaagattcatcttgcgatttccatgtaaactgtgcaattagttcttctttttatctatatttaatgcttcatgtatatgtacaaagatttgatgtggtgtttttggaaaaaaaaatggcaactaaacaagacctaatcgatggatcgatcgatgtcggtgggtcggtgttcgattaatatatgcggacccaaaacagatattgtgaagcatatgctactaccattctgttagaagcctctgctgcgtcagttctttttttaagttctctaattctccgctttgttgagaagacagacgtacgggtagtaagctataactactactggcctgctcgctttcaatcgacactcgacaatgacgaaataccttgtcgctcaatttgtctggccagttttagttagcgagaccagagacgtccggagacaaaaaaaaacaaacaagctaagggctaaacttgcttatatatcttgtgttttcaaaattttcactaagtgttgataaattttagtagatgtttaggatacaagcctaggctttctccgtcactgtttgagaccacacacaaagcggccgcttaataatatgtatattcactgtgcgtgcgatctttaattaattaccataataagcatcaaagctcggagtactccctccgtaattataagtaagtcgtttaggataatgtttaagtcaaaccttgagaatataaattataaataactctcaagttgttgagtttaaaaatgtaaaaattatatgtactatctccatactcgtaaagaaagtcgtttagtatagcgacacggtctccaaaacacaactgtcctaaaacacggtctcataaaagtatagaaacaagaagtcaaagttatgttttgaagaccgtgtcgctgtcctaaacgactttctttatgagtatggagggagtaatagctatatggcctctttttctaattaagatatactatattttatcttaattttcgttgttacgtttttcaatcaaagttttcttccaattatcagatagatcaattttttagtttacaataattaaaacttaatttattatgccctaattaataccttacttattaacgtcatcttcaatttttattaggaaaagcaccaccttaattattttaatagattaaaaattaattattaccccgtgacgatgcaatcgtgccgtgaaatcgctagtacgtacgtacgtgccggtaggtaggtaggtaggtcacgccgcggtttgacgagcgttggaccgtcgactgactccgcgtgcgcgcacgtacgtacgtcgcactcgatcggctaccggtggattttgcagcagctagatttcacgctaggttcgtttactttgaaatgaatatactatcacattagatttaatttatttaggatagaaagagaactcctagatacaatgatgtatcacatttaattattcgtttttcaagaaagaagaagtggctagcttgtaaaagtattccctccgtcctaaaaaagaatctgaactagatggatttactaggattaggggtgaaaacggtacggaaactttccagattctggacctattttcgaaaacggaatatgtcggtcggaatttttcggaaacggaaacgaattcggaaatattttctcagaaatgataagggcagtttccgtcggaactcggaatcggtcggaaactttccgaaaattttctcggaatttccaaaaattttctcggaattaccagaaattttgtgactgaaataccctggattcttttttgaagcactaaatagtgaataccatggtgtttggctgttattttttaaaaaagtatttattatgcaaatctaaaattatagaatattttttgtcctacatagggacttatcaacaacattactcttttaaacatagataatttattcaattggatttatcagtttgaggggttttttattccgataaattttcgttaccgtattcgcgccggttcgttttcgctccgttttcggtttagataatattcgattccgttttcgtattcggggtttccgattccgaaaaaaaatatgaaaacgaaaacgataaagatggattccgtccgtttccataccgttttcacccctaaccaggatgtgtcacatccagtactaatttagttttttatgagacggaaggagtagatactgacactgacggtgacggtgacagatgccgacaacgtgtgtgtatatagtggatacgtagtatttacgcggtgatcgatcgatcagtgcgtgagctagtgcactcgatcgtcacagcgacaggccaggtgggatcgccagctcgatcctcatcatctcatctcaccggccggcggcggcgcatgcatggcgtggcctgacgtccggccggagttgggtcgacgacgacgaaggaggatctcatctcaaaatctgacacgatctagcttgtcgatcgactaaacatgcatgcatatgcattcaccgatcgatcgatgctcaatggctgaggcgtacggctagcttaatatccatctgactagctaggctcctatcggatggcctaatcagccaaagaaaaaaaaaatcaaaatttgaatttttaaacttaattttaagattgattttaagatatttttaacgtagtttctttttcaacattggtttttaagtcaccaagaacatatttataaaatttttatctacaaatttagccgtttagccgaacgatagggaccctactctgttcatgcatgttgctggcccgacctgtacacgcacccacgaacgtatatttgggtggattgaataaattggatcgatgctacagacctgccacaaacacacctacgtactacttcaacagctcactaactttaagatctatttgggaaaacgtatgacagctacagtttcttttagaatcagaaactctttcaaactagtactttagctttttcgttcatatttaaaaagttattgtaatatataatttaaacataaattaaaaagtcaaaagctagaaaactcagctttttcatatttttagaaactaataatcaaccaatatgcttctcagaatctttaagctattaaaaaaaacttagggcttgttcagaatgtagccaaaataaaccttaccaagttttagcactgctaaaatttcagtaagatggtaatattatcaaaattttaacatgatttcctatgtattaaccaaatttggcaacaaactaaacatagatattttttagataactttaccaaaaaaatggtatggttgaaaataacatcaaagtgaacagacccttaacctcaggctatctccaacaatgaaacccaaaatacaagacccatttcacgtttgcatagcgctacagtcaaagagttcaatacctatttttggtcttctccagcaataagacctaaaagagaacccttactgcaaataggtcttcaggagagaggatactcagatttaggttatgcctcttatagcacgtaaaatgggtcttctttataagtactctgttggaggctgaaatagtactatcaaagacctattttaggtttaggtgcccttatgggtcacttgttggagacagtctcactcactacatattgcaactagccaactactgtacactgcactgcaccggccatacacacgttagtacgttgtgcgccttctgattgatttgcctagcttttctctgtaaccgatcttcggaaaagatagtactcatgtactagttcagtcacctatggccgcaagctcccgatctcgccaatcgccctccgattctggtgtatcctcctgccgcatctctgttgctacaaccacgatatatgtatcgtgattgccagacagctagccatgccgctgactggtacgaatcaactgtgcacgcgcactattacacgagttctgctactgtgctctctactaatagcagaaatcaatctaaatcgtaaatttagttttatttaagggtttagacctttatatactaccactccatttagctatactattggtcagggggcggaggtagagtatgggaggggtgctcagaaacctggtcaagaaaatttttagtaataacttaccgatttttgccatgtgcgcatctccctcaatactaacttaggcatatgcatcaacttaaatttgatataaagtagagtaaattaagctagagataccctccttcatttcgttctaggtccgcctaaatttcagttgtttatttctggatcttacagcaggtttagtacactatatatatttttaagatatatagttagattttgtattgatgtatattaagatagccactatataatacccaagcatggtcatggatgccatcttgtttgtaacatagattttagcgttgtttggttgtcaattgcagttttccatgcatgtatattaagactgaccaattcattatgtcttcttttgaaatgattaatcacatcatatataatatattgcagtatataactatagaacacatagagatctacaactaaccaagttgtaaaacgtacacatgcaggacgagagcacacaaaatcatggcaccttttactctagcttgttgatcatggcgcacatgttctgtgaacaagagccatccattttcatttctctctacaccagagccatccaattggtgggctaatgattacctacacaggcaacggctccgatttttttgtctaggtgaaaccagatggctactgagaatctaccatggatatcccattcaaaactggagccatgtcttcgcaatccaacaaaggcaagaggttctttttctttagtccagaaagcacaaatcttgcatagtcaaatacaagatataataaatatttatttcttttctcatacatggatggggaacaaactttcgagttccacacaattacacaaatgattgttgttggagtgatcttttagttgtaccctcatattcgtttgacccgagcagaagtactgcactcagattttaaaccccataaataaaaattctagtaatattccaccaagctgtactacatgcttccttttgcccttatataacaaaatcgatggttctgagttcaaattaattggcacaacatgaagagagcgtagttcagctggttaagcttatggtgcacctacctatccgatctaattcgagtaatagacttgacaagggtgcttgtatttatggctaattattcttttaataatatatgacgtacttgtcgagtgagacgtttgtgatgacttcatcaatctaaaattaattatgccaatggtaacttcatcaatcttaaacattccagaccagcttctcagagatgctcatatggtcgattgtgtgtctgtatatttataggagtgagtctacacacatgaaaatgtgagcattgcatttgtactacgcttctaaacgaaaaatttgttggcacaacaaactgaacaaataaatattccatggagtactcgtgcttgtcactactatagaaaaggggattggtgccaattcagaactggccataggtgctagatttcccaattgacacccaacagacaatacatttgagattctaggaatgaaaaaaaaaacaaaaagtcggcattcgagccgaagcatcgagcagttgtccatcatcactaagatcaacatcatccccattaaccaaatgcaatcaaaatcatcactgacataccatcatcccatcaaccaagctcaatcacaaaattaacaaaatcgcaaacgcaaacacacagagaacgccaccgtcgccgtcatcaatccggacttctccatcgtcatggtggtgtcaatcagatggaaaggaggagtaggaaagaggggtggcggcgacacataaggaggaggaggggctgcggatccaaaaataggtggagggaggaaaaaaaaagaggggtggtggcacgggctaaggaggaggaggaagaagaggaagaaaaggaaggggcagatgtggctcacatggggctccacgagtagataacgccggtcaggctgggtgtgccgactttttttattttttttaattataggtgttggttttttttaagaactagcacctacaggctataatgttagtaaaaaaaattaaaaaaaaccatttttttccataatttctgtttatatacccgtgtggaattaatttgcaaaaatatacctaaccagcttgctagtaatgcgggaacgaggattaagcacatgccggatgcgcgggaccgagggttggaacgatcacgcagggcgggggtgcaggacgacatcggtcccgcatcctggaaatacggtaccgtggcggtaccgaagcggtcccgcacttccattctgcgcgatcgagggtgcgccggcccggtcctgcggtacatagcgcacgcgcacagccatcgcgcgggaccgactcggttccgcaccttcggcctgcgcgatcgagccgatcccgcacatccagtatgcggcatcgcgttcccacgctgccacgccgcgctttcatcctgttcccgcgttcccaacgcgcggaggcggtatattttcgccaaatttccccacacatgtatataaatacaaattatgaaaaaataggtatatttttaaaatttattcaatgttagcataagcgttggttttttaaaaaatcataataatattataggcactgatttttttttatctaaaaccggcacccataagttcttaaaggtgccggtttttttaaaaaaataccccataatggtgggaaacggtcaatatgtgtcaattttaaatgaaccggcacccatgagctatcacctgttaagattttttagtagtgtgttatttttgtcgtgtaacatgtacaaacaaaaactttcgcatcctcaatagatagctggttcagatgcatggttaagtataaattcagggatattattgtgtggttaataaatcgcactaagtatggatggatttactttggaatttcttatcatccccagttggtagctggttcagaacttcagatggtcattcagagatattattgtgtggttaatacgtacatcggtacatggatggatttacttcaggatttcttcatattccagaatttgattcggtggtcacatttgtatgtcaccacgctttcagataagataatactagctactgcttgtacggtaaccagacacatctttttttttcctttagaaacattatacaaacgcaagcactgcacgcatactcaccctctgcatatgaacacacacgtaaacttaagcactttaaaataatactaagcctgtataaaccatcacgaacaccttgttgctgataggtaaattgtctaccacagaaagaataattagctatgaacgttcgtaccaagtttagaacttgaagccgaattagtaggttttaccataaaaaatttaacagttacgttcacttcacacaaatctcatacaaaacaaaacattaattattaccgtaacttttctatcgacaaattcgcaaaagacaatggccggtgaattcaggaatggggccttcacttaatttttagactctcggtacacatatttattctttttcaataaattatatttggatggatacagcacacttatacatgcatagtactctctccgtcctaaaaaaaagacaaactagataaggatgtgatgtaacctaggacaacgaatttagacactcggttgtctttttttttaaggataaaaagagtatgcttcaaggagtgtgtacgtataacaactatataacctggcaacatatttctacaattcgaacctgatgagatgtgtttgtcagtgcatgacagcactacgagtacatattatttagcctagcttttacataacgaaaatagattacagataataaaaatggattatattttttttatctctgttcatgcgtatacaactaaaaagtcttagaagtaaaaaaaagtattaaaaaaagatgtgatgggacaaacccttaactttcaccaataaaaaaaatcaacgtaattgccataacattttcaaaatcacatagattctagcatgaattattcaacctagctagctagttcattgacacataacactgattttaagatgaagtatatatgtacaatatcttgtctccataccaattaaggaaccaaattaccaaaattatgtaacaatataaaacctacatatgaatagttgagccatgcatcacttgcaaaaaaaaagctgagatcgagatgctgccaatgcactgtggcgaggaccggagaacaatgataaaaaagaaaaaaaaaagcaggagatcgagacgtgccgacctgtcaccggcgacgaattaggcgaatccaatgcaattcagaggctttcaacaagctaccccggccactcgccgcttcccctccaaaagcaaaggacactccaatagtaaagcagattctctccctctcctcttacagattatcactactacagcttagggcatcctttatggatcatctataatatgtcaatgcagccggtttatgatatggataccgaaaataaccctcacagataatctataacagatcataaccatgattcatcagagatagtatgccatctatgacgggcgtaatttgttaaatatatgtatacaagttattcaaaatatgttttgaaaaaataactttatgtaatagttatttcatttgtttctacccttaaatatcataaaaaaaatagaaaatcttatcatctattagaacattcagggcttatttggtttagagtaatatcaacccatagataaaaatagaataatagaaggaacaaaaatgcatgcacacattaataatctaggatttttaatgagatttaagtggataaaaaattttctatgcttttcgtcttacaactatataggaaacaaaaattttctatagttctcacgtacttcgttcctatatataaaccaaatgatataaaattaatactcaagaatctaaatctaaatcctttgcttttactccatctgtcctaaaatataagcatttttagtatagtgccaagtcaaataattttaactttaactattaatagaaaaaataaaacagatcaatcatgtaaaattggtgttgctagatttatcattaaacaaactatcgtaatatgcaattctttttatttaaaaaaaatcttatttttatatatattattcatcaaagtagcatctcaaaaattgtatcgaagtcaaaaaaaacttatattttagacatcaaaaaatacttatattttaaacagagatagtacttgctaaccaaacaagtacacggtctccatgcatgcaccgtcacatcgccggcccgcgaccgatcgcctcacactgctcgtgtcgccgacgtgtcatcgtgtttgtcctctcctttattttcccttgcttttgctatagtttctgcatgcaatgccaggtcaattaaggagagagaatttcagatgcctacttaaatacttgatggatgacattgcattgatccatacacaaaatacagtcattcaccatacctaactactgcatgtatgctatttcctccgtcctataatataagagattttaagtttgtgtttttactgtttgaccacttgtcttattcaaaaaatttatgtaaatataaaaaacgaaaagttgtgcttaaaatactttagataataaagtaagtcaaaaaaataaataataattctaataattttgaataagacgaatggtcaaacagtgcaagtaaaaacttaaaatcccttataatatggggcggagggagtagctatcagtgttgtggaagacggtatacggatatcggacggagagggtaccgctaaacgattaatcggaatgcggacgattaatcggaatttggcggaaatataacgttttgaaaatatatgtacatagttgataatagttttccctttttgataaacaaatgcatataacttaatatattccttctatatatccttaaatagaataaccatatatgatatttaaataagttcataatggatagctgctactgtatatctcaattctgatgtagtgatgggttttgttcataatgcatgaaatgaattatcaagagaatgtagtacatagcataaatgaccataatcaaggtcccaaataacatatgtatcggcttcatcaaatacaaactccaataacctgatcatcgtcaaaatcaaggaactcatgtacaaactttaagtcagttccttgtcattttacatcttgctgccttgtgagaatttcggaagagcaaacttctagtcaatagtagtaaagggcacagctaatgagctggattgtggaatcgacctttgtcatcacgccgattatacggctgattagacggagacggacgatttaatcggtaatgatcggatttatgcgttcgttaccgactaatgatgaccgcattggcgtgacgtgacggactgatctccgtatccgtattatcgaacgtattaacggccgttaacaccgttttccacaacactggtagctactacgttactacatatatactccagatatatatcgacaattagctggatcagacattcattcttcagtagtgcagacgatagagtagttgctgtataagttgcttgtctgtaacgaaacgaatggtatatttggtacatatcgaagaaaaggagaggtgattacgtacagatacgttcagctagcaatctaggaccgattggatcttgggaccgatcgatttcgacggtgtacagagctagctagcttagcatgcatttgttctgttggaagctggcataagctactcatgagaaccatattcttggggagagagagatggagatctatcgatcgaaaacgatatgcatcacaccctcacctttgtgtgtgtcactagctagcttcaggtttaagcccgattcaatccatgtgtgttgttactactatcttggaacattttctcgtcagtatgtagtatcccatctttgcaagcaacattgattttagctcagtatatgactatatgtgatgtatatgcatgttgatgatttgtacctttcgaatcttcatcagtgccatgcatgctgcatagtgttgattttttttaacgtgcaaaaggattgcacgtcaatatattaaaagaaatagagattttgttacacgacgcaatcggctagataggcctatgctggggtatgcttgggggggggagagagatagaaaaaaccacaaaggaaaaatgaaaggaactactgcgaaaagaaaacttctccaacataaagggagagggaggcgaagccacactacactcctagcaaatctccaaaagcggcaatgcccacagtagaccacagacggccttccgagtagatagactcaataagcacagagaccgaggagagtgccaattcaactaccctgaagttccgctccttccatagctgccaagagaccaggagaaccagggagtcgaagccagacgctcagataagcaggtcctagaagattgccacctgtcctaaagcgaactgccgccgggaggggagagcatagtgtcgatcgagtagtagacctaactaaaccggccactgtcactcgatcatcactttgtgtcttaatttgttagtggctacaatgatttcagctgagtgtagtacatgatcagatcatgcatcggcccatcgagatctagaccgcgttaaagagacttaaagtacatcgtcgttgactccaggagcagggcatatgtgtgtctcacaccgttgactccgtttgttcatcattcagtcatccgtagtggcaggtgcagatcagacagcaaactaacgcaccaaagcctgaagcatgcatatgcagaaaatgccatggagagacattcagtgtgtgatgatcccggctcattcctctcgatcgagtttgatttccatcgctctcatatctgaagaaaattcattgacttttcaagatgcaagggttgacaagagagatgatgtattaaaaaaacagagtcaaacagatccatggtctgatgtacatttatgaatgagagtcaaaatgcccccgaaaacatcagcttatacattccatgtccatttcaattcatctcttagaatgtcctgtcctgtcttgtttaattaatttggtaacaccaaccaaaacactactatttgttagtttaccatgaactaatgcaaccatagtccatggaaaaaaaaaacttgtagtatgaattgatgcccctttttttagcttatgtgtcggattattgaaacagattatttgttatacccttcgaaaaatacgttttctcaaaaacatttttctagtgaactgtttagaccactcattttaagctatctgttaatcctgtttcttaaaatatttatttttcatttaatcaaatcgataatataagataataatttaaatcaaacataacagaactggtgtctcaaaagaaaaaaaaagaagagaagaaacagggaactgaactgaacttgcattatgttcctttttacagta

SEQ ID NO: 46357 - DNA, 15503 bp, Oryza sativa
tcagtcctacaaatctgcagttcgatctttgttcagtcctatagttgattaatatgtttctccatgcacgcctgatataaccggcctttttcttttcattcttttcaccattaatataactgatcttcaatcacatgcggtcagagtgggtggtcaaagatttttacccagaatcacatagatgacgatttagtcaattctgttgaattaatggccattaattctccttagagcgatacaatagcagactattagccagctataaatatattttaatgagataaaagattagagagaagagcagcgggctacagatctgtagccagctacaacacggactccaagacacagtgtgtgtatgacatgtgggaccatatattaatagtataataagcaactattgtatgaattgctattagatttgctatagatgaattggagctagtagtgggctatactattaaccttgctcttataatccgttatgtattatgtgagttgttttgtgtgcatgtgtgttacgtagaggtcagaagtgttctcttaaaataattgtatcatctctttgtaatttaatgaattcaatagaagcttttattgccttgaaaagtcatcccagctcactaattcgttggtttcaggaaagaagatcattaattcgatcttgtaccttgtaccgtgtgagaggaatgtgacagcaaaaaggattcatggctagctggaaaataggggaaatggggaataaaaagatttgacattttgattttttttcaagaacagaataaaaggaaacaaaacactaaattcttgcaaaaaaaatctctaaagtttatttcatcttttaatctgtaatttattgcctaagtaaacatgccaagtgttaactaacttgagagacaaccacatgttcagagactctcatggccatgtgaattaaagcaaagaaacaggcgtttcaccctttagttcccagtttgttttggttaagttgggtagtatttgtcaattgccaccaacctctttattaatagataactccttttttttgctaggattattaatagataactcgacagctacccttttcctacaaaagaacacaactatgtacaggtagctagccggccaagaacacaacacacgtgaagagtcagagaaaaaaaacacagatttaaacataggaaacacataaatcagcttgtgctactactgaattagcatttgctagttttggtttctccacttatatctatttgaaggtgcattgctggccaacagttgccaatggcctctaatatcacatcttcaccacaattagggccaacaattggtgttatatatgcattcagttggtgatattccacttgtacatgttcttactctctctctgcattattcaaaatatttatcaagatttgcaagaaaattttgggcatcctactaccgcatagctatgcatcctaggtcacctttgggagaaagcaagcttggccaggttatggaatggagtccatggatggttggaaattccacttgattttgtaagtggtagatttgccttatcattgaaaaatatatgttgttatgatcatggtgtcttggtgctcctgtcacaactgatggcgcggaagctactagattaacatgtgtcaggaatgtgcaggccggtgcatatatgattgcagtcgaccactactcacctttgatgtacggtcacggttgtatcacccttgcatgatatgaattgtggtatcttcagttcaggttctgatgtaaatctagtatttttgagaaattttttgtataagaactttgttgcaatacctcaataaatgaagttacaaattgctctcaagattgagaaagtggattttattcactggtgtcaaatatatatcatctatgttaataatcacctcaaactattatgaacgaataaacattatttgcaggtagtgtttttatgtgaaaaatcatgaataatataaacctccacactaatgaaaaatcatgaatgtttttatgtgaaaagggttattattatttttttttatattatcagttaaagttttcatcataggttggttgcataatgtaccacattatatttcttaaaacagaggaggtgcattataagtggtcctcatgagtgtattgcaattgagtttatctttaatttgtggctacaattttactttgatagaatctcaatgattccatgttcaactactttacctcccattgctaatagattagtcagattatttggagtgaataatgtgcttgttgggtcactatgttgagtgctccacatagctattttaccataaaaaaagaggaaaaaggaacattaccatttatattttttataataaattaattaaggccgcagggtttgcgcatccaagttccaaatgccttttgccttgccgctgacgtggacccacatgtgcacacgtggaacaaagctagcatgccacgtcagcaactccctcccttgtgcttacaaaaatcaaagtaggtctcataatcatccatagccgctggatatacacaacggttaaaattggccaccccactaactacaactacaagtgattcagagaatttatcccaccaattgcgtaaaactatttggaatcaatcgtccaagtgaaaaaaaaaatgcatattcaccttccaccgagcaaaatttttttctcagaatttacatggatcattcaactgattcctcttgaagaagccagtggtcgtggcattttttggggattttggagtgtagatatttatatttaagaatatatagattcgggtttgagatagagagcaaccatcgaccataattctcgcatgggagacattacgaatctcgttgtagttttacttgtcttatcaattttgcatgaattactatatgttgaactcatactaacacgtactcggctttatctggaatctcattaaatcgaccttttcctggtggaattttcttctcatactattttcttgtttaacatgcggaaaccaactaatactttggtaaaagaaatacattaaaaaccagcttataattagtattcactccaataaaaaagagttttctaaaatatttaaatggacacatacatagccctattcggaaagaaaaaaaacaagtgcagatatacaattcttaactttcataaatgtaattctaatttatatggtagattttaaaagttaaattggatctgatatacaactcttagcatatgttagatagatatatagatagatagatacactatctttattaaaaaagaatgcaattttagcaatgcacgtggacaaagatatgtccaagttcatagctagaattatattctttttcgcatggcagtaatatataaacatataaatagatggatagagagatagatagttgaaattgttttttttctagggaggggggatggaggcactagtagatagatagatacattaattccaagatactattgaattttaattcctaatatacattttttgaagggaaaaaaagaagtttgaaaatgtgacacgcccaaatgtttgtttgggtagttctttatttaggtagtagcacagcttaagaggcacatgtgtcccaaattgcgaatctttgcagcccagtaataggggggctcacctaaattaaccccccaactcgcctcttaatcctgcacgcgccgcgcccgcgccttcttcttcctctcccgcgctttctcttcccgccatctccctataaatggcgcccttcctcttcctccgcccaacccctcaagcagccaaggcgcctcccttcctaatcctacctcgatcgcctcctccctctcgactcgatcgccatggttgtcaacaacaaggtggacagcctctcctacgacgtcgaggcgccaccggcgcaggcgccgacgaccccggcggtggtctccgcgccgccgacgccgcggggcgaggcgccggcgatgacgacgacggcggcggcggagctgcacaaggtgtcggtgccggagaggaggtcgacggcgaaagcgctgaggcagcggctggcggaggtgttcttccccgacgacccgctccaccagttcaagaaccagtcgtccgcgcggcggctggtgctcgcgctgcagtacttcttccccatcttccattggggctccgactacagcctccgcctcctccgctccgacgtcgtctccggcctcaccattgccagcctcgccatcccgcaggcacgcacgcaacctgatcacacatacacgccattgttttgcctcctgaaattctccattcccaattccaattcgaattccgatttctttgcagggaatcagctacgccaagctcgccaacctgcctccaatcattggactatgtaagtaaaagatgaaccaaaatgaccggccattatgtcaattcgatgtgatgaataacacatatgatgtatgcagattcgagcttcgtgccgccgctgatctactcgttgttgggtagctcgcgggatctggctgtagggccggtgtcgatagcgtcgctggtgatggggtcgatgctccggcaggcggtgtcgccggaccaggagcccatcctctacctccagctcgccttcacctccaccttcttcgccggcgtcttccaagcctccctcggcttcctccggtattcgatcacttcacatccatcatctactgttccattgacgatggatcgatggatcgatcacctcatgcctagctaactgatggagtatatcgtgttcttggttttaggctggggttcatcgtggatttcttgtcgaaggcgacgctgacgggattcatgggcggcgcggcgatcatcgtgtcgctgcagcagctcaagggattgctcgggatcatccatttcacgtcgcagatggggttcgtccaggtgatgcactccgtcttcaagcaccacgacgagtgggcgtggcagaccatcctcatgggcgtcgccttcctcgccgtcctcctcaccacacgccacatcgtaagctaatagctaccacaccttcctagtagcgtatcacctgcagagatgatgcatgctctcttgattgattagttaattattgcctgttcttcgctaatcgcgtggtgattagaaggtaatcagggggttaattgctattactatttatagaaagttccgcagaaatggctaggcgccaaaatagtaagggaaccacaattaatagccacacgtatgaaatgcgtggggatcagggatgcaagcatgtcgacccatgaacctgcgtacaggttatttaaatgttgcgcctaatagaacaatctagatatttagtgattcacaagtaaagtgattttatagttcttaagaaggtattagaagataccatattttttaatgtaaaatttgatacatcttgatatcttcgatactaatagataccaaaatttacactaaaataatcgatacctcttggtatctctcaaggatcgtaaaagctggcctgccttgcctgtataagtaaaaatgtaatgagacctgccgttgtaaattctgagacaatggaagagtacagaacactttcggctaggggcagttatgagcaggactaaatggttattgttagttaattagtcggcaaaattctttataattatttgaccatggttaaagacaggtaacttatctatagctaggaaagatagtatggcaaaaaggaaaggtggtgattaaaaccattacaaagtgagcttcatggaggggcccaaagggtgcttgccactaacaaggaatttgactccactcagttaaactaatggccaatagttaatggaaggtgaagttaagctacctccagcttatagggatctcataatgatgggatattttgatttttcctaaaggaattccattcacataattgattgtcgcgaaattcgaatatcttactttagtagttgggtggttttcttaattaggggatcacataaaagttcctcaattttttcaaactgtttaaacttatttaagctagtatagtactactttagggtaatctaaaaacttctttagacttgcttaataaacagttgctatgccaagaaaaagtcatgtcttatgcctaatcttccaagatatctgaacgttggactaacacatggtgtctaaaaagttagtgttggcgtgtgaccagaagtatttaaggttgttaattgcataattgtgaaaggagtttataataatatttactccccttacacttgcagaaaagcactaattcttttagtaattaattaatcgatcatgtgtacaaaaacatatgtcatgaagcactctaactagtatgatgagcagttctagtttggatgatctcacaaactaaacaaaaacaaagaatgtttatatcttgcattagtcttaatacgattagaccatatacatcaattaaagcaaggcgtgtgtgtggctttagaatatattctaataaagccattttcaattggaacatttctcttttcccttttgggaagaatggatctggtttggccactctgacgtgtcacctgttaagctggttgttcacatgctcatctctctgaatttcggtgtcttttcagtctaaacagaatgatctgataaacacatccattagactgttaatggttttcctctgagaaaagtaagtcatctgctttgtaatgacgctgttcctcacctggaatgattaaaaagtgtcaattaatgcgacaattccacggtcatgggaccatctcagaacaattcttcagaagatgtgaggagatggggcctgccaaattaataggttttaaccagaacttcttttcatttgtgattcaagatctactgaactctttttataaaaattaaaaaaaaatatgtactgaattcattatgtgaaccgctgttgtggttgccaataatttttttaccttctgattcttcagttcgctgtatacaattttctctgactttgatgcgagtatgcagccggtaacaattttcactgtatttttgcagagcgccaggaacccaaagcttttctgggtgtcagcagctgctccactgacatcagtgatcatctctaccatcatctcgttcgtcagcaaagctcatggcatcagtgttgtgagtagcttctctaaaccatttctgaatctttcatggacagcttcacatcgagaacatgaaagaaacgtcattagtcacactaattcatctttttttgggtggtgtttggacagattggcgatctccccaagggattgaaccctccttcagcgaatatgctgaccttcagtggctcctacgtaggactggccttaaacacaggaattatgactggcatactatctctcactgtaaggcacctacataaaaaacacattttatttactatctgaactattttagtatggtgatgtttagtctgaacatgaaaggaaaaatgactgaatttgcaggaagggatagcagtaggcaggacatttgcatccatcaacaactaccaggttgatggaaacaaggagatgatggccattggtgtcatgaacatggctggctcatgtgcctcctgctatgtcaccacaggttggtttgtcagttgcaccatagcttctgaacgtattaagtacttgtcgttttagataaaattagatcaaacctttaaaattctgaccatcagtaatttcttaaatgcatagttcaaaaccaaaacaaacgatatagtatatagatttgcctcgaaaagtaattatcatagtattataaaatgtttatattttataaatttactctaacataaaattagctgtcaaaatttcaaaagtttgaccaaatcttatacgataagtatcttttgaccggaggtactctaacttgttcaagtttgtttaagtttacagaaaattttaacaatatttttaatataaaataaatatgttatcaaaatatattcaacgttacattcaatgaaactaattaattcaatattatagaaaaagattgactaaaaaaaatcaaaacgacttataatatgaacggaatgagggagtaatattcatatttagataatggaaatggattatatctccggcttctgtcatgagatgcacaacaaaaaaaaagacaaagataaaaataaatcaaaatgagaaataaaatgatgtgagtaatattcatagaagctagatgaggatcgcaatggctcaccattggcaaaaaaaactctgaatgaatggacgcaggatcgttctcgaggtcggcggtgaactacagcgcggggtgcaagacggcggtgtcgaacatcgtgatggcgtcggcggtgctggtgacgctgctgttcctgatgccgctgttccactacacccccaacgtgatcctctcggcgatcatcatcaccgccgtgatcggcctcatcgacgtccggggcgccgccaggctgtggaaggtcgacaagctcgacttcctcgcctgcatggccgccttcctcggcgtcctcctcgtctccgtccagatgggcctcgccatcgccgtcggcatctccctcttcaagatcctcctccaggtcacccgcccaaacatggtggtcaagggcgtcgtccccggcacggcgagctaccggagcatggcgcagtacagggaggccatgcgtgtgccgtccttcctcgtcgtcggcgtcgagtccgccatctacttcgccaactccatgtacctcggcgagaggatcatgaggtttctccgggaggaagacgagcgggccgccaagtgcaaccagtgccctgtcagatgcatcatcctcgacatgagtggtaataagctcttgcatgctactactcctgtacagaattcatactcagttaaaaaaatgctgaaaagagtggttaattattcagtaaattaaaactgacatggatcgatgagctaattattcattcagtacaacgttctcagaaagattgtagtacaatcttgatcagtaaaaagattctcagtaaaaagagttgttaattattcagtaaaaactcacatggatcgatgagctaactgttcagtaaaaagagcagctaattattcagtataacattctcagaataatagtactatcttgtgatcagtacaaactgacagagaattcgatgaacttgcagctgttgcagcgatcgacacgagtggcctcgatgcacttgcagagctgaagaaggtgctggaaaaaagaaacatcgaggtaatagaacttctgaaacatctatctaccaatgttcttcttgtcagtttcagtgatttactatcagataatattcagatttgtcagtgacagtgaatagtaacatgagctaatttctgacggatttctgcagcttgtgctggccaacccggttggatcggtgaccgagaggctgtacaactcggtggtcggcaagacgttcggctcagaccgcgtgttcttcagcgtcgccgaggccgtcgcggcggcgccgcacaaaacacagccctgacaagagcagagatgtgctttgctaccagtagatccagcagaagcagaagtactctctgaccagcagaagcacagtagaacaaggtgcttctcggaggaggctaattaaaattaagaatcttaagatagaagcgtagaacaagaagaagaagaagaagaagaagaagaagaagaagaagaagaagaagaagaaggtggtaaaaaacaagtctatgggctgttaatttgttcgcgtgttgtgtttaattaggggggattatggtagtgcagatgggaaataactccgggtgctgatctcttctgatcgagttggaagagtttttgaagcatgtaaccagaatgcgtggcgtgtatggtgtagcttgtgatttggtagttgttgcaaagtaatccttaatggaatcgggttttgatctaagcccactcaattgattatttaggttgtgtccaaaactacagaagttcagatgtcaccttgtctgaaattttgtccctatgatattcacaagctatcatccttttttcttctctgaaatgaatggcgtagagctcattccatctgcttaaaaaagaaagaaagataagagaatttcacaaggataatatcataataatgcagaacaagaggaaaaaaggattacattatattgtatcagaactcagaagataagaacaagatcacttttcatccaaagaaaagaaagaacattatctcttcagaaaaaaatgtttctcacgagtcgcacagggcagagtgggtactgatgggccggctaacatctctttcacacaatgtgcttaattagataccccttcgtaaaaaaaaaaatcaaatcctagctatgaacctggatagcatttgtcagattcatagctagaatttatttttttaaaaaaaatactatccaggtttatagctaaggatttaattatttttttatggagggagtaaataccatgccaacggcatgacaaaggacttggctgtctagcagctatcattgctgctttcagcttgcacttttaaaagaagggaatatatgtgatctcccaatctcccttcatcatcgttcttttgacgagcctcgttgtcacaaggctctcgtaatcgtcatactttctcccttgaagaaatattctctagtttcatagaatatatgttaattttctctcataactgtcgctatgctaaccgtactactaaaatgagtacctttacatacagtacagtgacttctattgacagtgttctactaccaatattatgactaatagaaatgatctattgatttatgagttctactagtagtagaaaattaattttactaattgttgagatagtataaactagcatagtggtccgcgcaaattgcgcggctagtatcattatattttctctcatataatagcatatatgttttctcaatgtattattcaaatatattaaaatgacaacataattttaaattttgtactaactttacgaaactattaatgtgtaatattcatattttattttatatgcgtgttagttattaattatttttaatatcaaattttaattatttgtaaattatattcctatatagactctagacttgtctttcaatatttctttttttaattccgaattttcgttatctgtaaattgtatttctatatagactctaggctcttcttccaatattatttatttttaattctgaatttctattttttctaattctatttgtatgtggactctaaactcatctttcaatatttttaaatttttaacttcgaatttcagttaattctaaattgtattcctatattgactttagactctttttcccatgttttttttaattttgaattttagttattcgtaaattatatttttatacggactctaaactcttcttttaattttattatgtgtattctgaaatttagttagttttaaattcctatatggactatatactctacttctaatattccttatttttaattccgaatttctattatttcttaattgtatttctatatagactctatactctacttctaatattccttatttattaattccgaatttctattatttcttaattgtatatctatatgaactctatactcttcttctaatattctttattttttatttccgattttcagttttttataaattgtatttctatatggactctagtcttctcttccaatattctttattttttaattccgaatttcagttatttataaattgtatttctatatggacttgtctcctcttccaatattccttattttttaattccgaatttcaactatttctaaattgtatttctatatggactctgtttttctttttctccgattaatctgagaatttatagaccgtgagagcgaacgtacatgctcctttttatattcctttaataagttaatagatagtatgagtcaatagattgaaaaatatgaatggcctatattgattctattaccaatagagaccattataaaatacctcatggaccatttaatatgtgcaatatatagatggcaaatgtagcttaaatttttgaatctcgtaactcccgtctacttgaaacttgcttgcaagatactccctctgctttcaaatatacaaaacttgttttacttgtgatcactaattactcttaaataattagactataaataacgaaagtctcatacgtacgtctacaacgttatacacttaaacaatatggtattttttaagtatttataaataatcttttagaagtatgaaaataaatattttttttatgtgtgtattttaaaacaaagcgagtgtaccttttgaatttaagttttgatggtacacaagacgtcgatcttaagatatatcaacccggtcttatagagagagactcacagaaataagatgtgtgtttataaggataagtgtgtgcgtgttgcgaatgtctgtgtttgtactgtgtttcttttaaaaaatacgtgcttgtgcatgaactatttcattttgcattcctgcataccatccatccatccgtagatcaagggacggacggctgcgatacggctgttcagacggtagagtgtacatgtaagatgtaacctcgcccgttgccacggtcgcacggccacgactccatctctcctccatcggttacctctctctctctctctctctctcctcttctcgtcgccctaatccccaatccaaaacgaatccccaatctcgtccgcgccgccgctcgccgtggcctcccccgtgcgccgcccgccgcttcgcatcccggtgagaagaaaagaggtaaagctttcggttccacggcgaaagtttggatctttgatgcacaaaaagaagcatcttttcctgctttaatctcccttgttcttgagctacaagagatcctctccccgttagaaaatcttgatcttttctaagaaccgtgaaatactgattcttggagatgatcaatggtaaattagtgcagagattaaaactaggtttaggagaccccctccccggattgattgattgattgattgatggaatgatgtcgtgtgatgttaatttcagaggaggggaaatggagatacagtcatcagggaggccaatcgatgtgctcatggagaaggttttgtcagtgaacatcctctcctcggactacttcaaggagctctacaggctgaagacttaccacgaggtcattgatgagatctacaatcaggttgaccacgtagagccatggatgaccggcaactgccgcgggccctccagcgccttctgcctcctctacaagttcttcaccatgaagctcacggttaagcagatgcacggcctgctgaagcaccctgactcgccttacatcagagctgtaagcctgttgttttctactcttccggttcccgcaatgttaatttatggttctgtttgttaggatggtttgttacgtgcagaatgcaatgtagaggatttactgaatattgtagattttgctaaatcgctgcactatgtgtgtctgttgagtgttgatagtgtgattgaaaatgagccttggtgctactattaggtaaattttccaccagtaaatgaaggatatatagaaacctatgttaatgtgtcttgagataaatctgcacctaaaccagtaaatgaagcatcatgattttttactgtgtcaaacaattgagttttcgctctcagacagtaattagcgtttatatttcaggttggatttctttacctgcgatatgttgcggaaccaaagacgttgtggagttggtatgaaccctacattaaagatgatgaggtattatcttttttggtagctttctttgtattttgcatcattttgacgattagttgaagctgtaaaggataaatctatagttttccttcgtatatcctattttgtactttggagtattcagcaaactttagtactgctccctataaatggtaacgatggtatgctaaatttgtataagatgcctactgtttgtcaaggacaatgcttgtacaaaccagaaaaaaaatattgaaaacatgaaagcgtaaactccagaaagaaaggaaaaagtgaaatacatcactattcctgcactagactactaataatggttgcttcttagcataaacatgttatgtgcatgaaatgtgaactgagcgctgagccatctggatctatttttaatatgttaaattgttacttttttgtgtgcctttgtcagttgtaaatatatgttctgtgtttttattaaagttcaatccctgcataacgtacctatgaaaactgtgcctttcttcttgctcaggagttttctcctggatctaatggtaaaatgactactatgggtgtttatgtgcgagatcttctacttgggcaggtatatcttgtgaacttcatttcatttctgcctttaaatagaacagtattgtaaagttcctgttacagtgtcctttagttacccaagcacatccgtgggcatacatcattgacatagtattttctgaacataaatgcaattagtgtttgttgaatcactcacctgttggtttggcatactgagcggaaatttcaattgtggagttgctttaagaggagacatcatctcttccaccagtaaccactttgtataaggtttgtcatgatgtgttactcaaatgtttattttccatttttctgctagagtttcctatgtttcatctagttaaggatttataacaaaagaaaatgatgtatgctatggtgctatcttttttagttttgagatgtttttttctgtttaaatttgttgaggactacgtctcatatttgtttcttctttggcaagagatattctgtctatgcttgatattttggaatagctaatctagaaaatcaactttcctttcaaaaatgaaaacgaagttcagtgtgtaataatcatgtaataattgaaagttacttataatttttttaggttcatagtgaacagaaacgggtgagcaataccccaacttttagtaaatagtgaactacgaaagtgcttttttgatttttccttttactggtcggcctcataattattgccagtcagggcttctatgatattgtagttatttcgtagatttcattttccatgcaagttagcagagaacaaatagcaaattgtgatgaatgtttcatgggtgagttgaagcagtgtttacagttggccggagacaatcacaaaacaactgagtagttttttaatgcagttttttaaattccaatttattttctactatcgcagtttgtcttcacatctgatgttagaggcttagagccgcatgttactgagagccccacaccacgtctatctacttcatgccaagacagcatattaacctcacaactatatttgcttcattccattttggttgatcattttgatgttattgttcagtgtttcttttttgagctattgttctggtagatttagttgagaaataccattg

SEQ ID NO: 46358 - DNA, 3528 bp, Oryza sativa
cttttcccgtgttctgacatatgctatccttcgttgcacacttgcacgtatgctttatttggggaaggtgtactcaaatgctttacaaatgattatgtggtatgcttgaatcgaaccttgattcatcctaagttccaactggatacatccaatatgtgggaatcttgtttatagttgtttgcaaacatatttcggtgtgtatgatcttatacatttaccggtgaacagtaggggaggtccctatgtaatatatttacaaaaaagaataaaaaaagagcatttacaggggggagggaggacgaaggattgaaaacctgcaatgaagcggccagatgatcggaaactgtcttggcattttcaaggtgattcgtgatttgcccacaccatttactgaaaactttcacgtctccatgctgaccaaaccctacaagtacaacctgatggcggagttcaccattaacattcctgaacagtgaaaaaaaattgaatttataaggacactgccatactattcacagttgaccgctaaacttttgagaacagatatcagattgccagttcatcccaaatctacccatctataatagtgtttcttatgcttttatctaaactctaatcgatagagacacgatttagcttgatgcttacctgatacataccagtcaaccttgattgtagagtagtctacttgcaaactgtgagcagatgtattcagattttagaagctccgttgcagaataggcaaccatggaacaggcatgacaactacatgcctcagtttgtttgatgccattttgctgctgtcgaagtcctaagttggaatatgcaacctgggttgtagtcgacagatgcatttcattcatctttcatgcttgttctattctatccctcataaataaacctgggtcaaccagctcataaacaatctgaatgacactgtaaacaaatttatcatctcattagaacaatatcaaagttatcaaagcctcaaccaaaggatccatctactttgtgagattttttacctgcttgttggaagttttctgcataaatgatcaaatcccattgctgtagtacacatctgcaaatcaaaatgggatgctaaatccagctatagccaacatccttttcagtggcagtgcttttaatttgacttctcaaactatcaatcacagtcgatttattggttaatccatgcacactgatgagatgcagataaggcattttagtacaaggatcaatggcaattaattgactcgccgcatgctctgctaacttatcattgccagtcaatctgcaaccgctcaatagagaagtccatattgctgaatcaggttcaaatggcatcgacttcactaatccttcagcctccttaatcatgcattttctacaaaagagatcaaccatgcaagcatagtgcataatattaggtaaaattccataagtacatgtcatcgcattgaagaaatatttagcttcctccaaaaggctcatgtgattacatgcggaaagtacaccaagaaatgtgatgtcatcaggatcaacttgtgcctttgtcatactctcaaacatttcaacagcattttgaccaagattattgagtgcatatccatgaatgatcgtgttccatgttactttatctctcttagccatcaggtcaaaaatactttgagctataatcatttcgccacatttgcaatacaggctaatgagtgaattttggattagcaagtgggaatcgagtccaatcttaatggttgtagcatgaaactgctggccatgaaccatcatagaataatttgacaaacagcttatgaggctagaaacaactgactcgctaggtcgtatattagacagtagcatctttttgtagaactgaagtgcttcatggattaaaccatttgtagcgagcccagcaactaaacagctccaagtcactgaatcacgtgttggagattcattaaagagcttatatgcttcagtaattttaccttgatggaacaaaccggatatcatcacattataggtgacaacagtccttttttgcatcatgtggaaaaggtccagcgcgtcatccatatgccctcctttcacatatccaaacagcaaagttgtgcaagacataacatctatttggggcatattataaaacatatcccgtgctttgtcaagcattccattatctataaaccatgacatcaaagcagtagctgcttccaaactcttttcagtcatctttgagtacaactcagtagcatcagcaatccttccatcatttatatagccattaatcattgagttccatgagattttatctcggttattcatggaatcaaaaagtttccgggcctcatctatcttatccgaataaatatagccgcataacatggcattccatgaaccaacatgatttccttccattttatcaaactccagtcgtgcttcagtgatgtccaacgatttgcagtacatcaaaaccaaggaagcctcaagaacaaggtcgtaagcaaaaccagacttcacagccaatccatgaatgcatctgcctcctctaatacttttcatgccagcaaaagcattcactattttaactaggatcacatttgtcacttcctccccattcatcatcaagctattaaacaattcaactgcttcactgaatttctcatgcgtaacaaaacctccaatcatgacgcaccacgacacagagttcttcaccggcatcaatttaaacagctgaaacgccatgtcgacctcatgcgctgtaaagtgcccttttatcatggcagtccaggacaccacattacgcactggcatccgatcaaaagccttgcgagcatagcctacacgatggttcatcacaaggcctgatataagcgcgttccacaaggccacatttggactctcaacaccatccagcacttgctccaggcagctgaccaccccacagttggcatacatcgtgataagcgaagcacccacaaacacattaccagaggagcaggacttgaacacaagcccatggacgcacctccccatctccagagcctccaagcgcgcgcaggccgacaacgcggtggagaatgaggtatggtccggccggaacccctggcgcctcatctccaagaacgcccccacggccctcccgtgcgagcccgcccgcgcctgcacggccatgatggtgttccaggacacgacgtccctccgcggcattccgtcgaacacctcccgcgcggcctccagcctgccggctctcaggtgctccgccatcagcctgttgttcccggagacgaccgcggcggcgtccgaggagcagcacgcgcgctccaacgcctccgccgccgccgccgccagcgccagtgcccgtcgcgctgcgcagcgcgacgcggccattcgccgcttgcacgagcattcggaggttcgaactacgaagcagaaagagagcgagagagtgagagaggaattttttttatttatacatttttttattaaaaaatttaccaaaataattttttgggagtttaaaaa

SEQ ID NO: 46359 - DNA, 6574 bp, Oryza sativa
ataaaacatatttaaaaaaatcttagatctacatttcaaacgacattggatggagataaaccttatatgaaagttgtagatcttgatcagatctataactttatagtttatcacttttccatttaaaatcatttgaagtatcgaataagcattattagtttttaagcaattaaaaccggtggaaacggtttgaacacaaataaaaattttgcatttagttcccttgccgccctctggaaggatgattttaagatttgtaaattttcgaaacaaaaaattacttttgtaaatattttaataaaaaatgtataaataaaaaaaattcgggagagagagatgtctcgggctagcagcccaggtaaggcgttttccatgggccgggctgatggagggttggcctgcaaagcgatttcgattatgtgcgacccaataacgggattgggccttacgttcggcccattttggattgtgaattacatgcggctatgttggttgggccgtaaggggcttccagttacgtgggctctgaccggcctacagggttgagcccaatagataggtggccggagattatttggacttttggagcctattgttgtatacagtacatacagacaggtggtacagtaaattaaatgcgccatctcgttacaaattccatgaattaaaatgtccaaaatttgaaaactaagccaatctttgagatgaatcgcactgacaccccacatgcttgcaagtatccgtgataataatttgctcataatctaaatcaaacggagcaagcctagctactttctgaaagtaatagcatgatatgatatgcaaaatgccaaatggaagtgcaaatgaagagttggggacgcagcaaacccctcttgggtctggacctgtgctgtactccctgtgtactgtaatcactagctgaaagcctgaaacctcgctggagatgtgcagagttgagatgcgtagagcaggcattcgtcaactgatggtacttgagctgtagcatgcaatgcagcagcagccaggcaagagctaggcatgcaattgattgatgtcctgcacccctcttcgccggatcgccattaacatggccggatctacactggtagctattatcatccagctagctactagccgccatcgtcggctggccggtaggcaacagctacaccgaggaaagaaagatactactgtactcgatttagtcaattgttcagtttgatgatcatgcctgtaatcgtgattggttgagatgaaaaggtagcaggagaaatcactgcattttaagataaaatttcgacgaaaattttagatgttttaagatggaaagagtatctatgattttcagagacaattctttatttttcatcaaaagttttgcatgattgtcttattggtatataagggtaaggataacaagagcgaataagaaattgggtaaaacttttccccagctcatataaaattgggtgagtataatagttcctattttttttcccaaaaacgtcgcatcgaatctttggacatatgcatagagcgttaaatatagataaaatgataaactaattacacagttttcatgaaaatcgcgagacgaatcttttaagcctaattagtccataattagccataaatgctactgtaacccatacgtgctaatgacagattaattatgcttaataaattcgtctcgcgatttccatgcgagttatgaaattagttttttcattcgtgtccgaaaaccccttccgacatctggtcaaacgttcgatgtgacgctcaaaattttctatgtatcactcgtccattccattcttcttcttcttccagcgacctgttttgtaacatggaggttgggttgtgtgtcaggctgtcatggggacccatatgcttttatatccattttatatttcagggacaagtgtcactacaactcgcaccaaattcatgccggcggttgggttggttggtaggctggctggcttggtttccagccgctcacttaggttttaggtggcagctgcacaacacggtcgcaaacctaacgccagctagctctctctgcattgcctttgcattcattcattcagagacattatctgaatctgattctgctgcctatgtagctcctgccatgggtctttgatttgtttactcctgttcgttatgctacttgcagtttgttatgcaatttctctcacgatgaattgatgatttggtcgtcaccgaacgagtgatgctcctgcttgcagcatgcagttggtgccagaaattatttggagatcttctattggaacttagaacagatcagccaaatctgtatactgactccgtttcaaattttatttaaacactcagattagccatttatttattttgcaacacctagttttctacgaaaatattcaggttaaaaaaaagagaggagagacaaattaatcgccgtttgtttgcacgtcgctctacgttctccaaccatagttgtaatgtaatgtaaggcaaggcactttacagttgcaccttccatgcaaccacaaaatacagcaaaagagcaaagctcagagctgtcgtgctaacgacagatcatcaagggttcttccaagaaaggctcttaagaggtttccagcaatctcctctgaacaacaaatagcctgtttccaggacgattcaacagaataagaaagaaagcaatcttttaagaaggcaactttttcagacagacaattcattcaattcttgatgaagcagaagtcatttcaattattgatgaaaacgcaggaggtctgcgattcattcattcaattaataagaaaaagatggcaagaatgtacaagttaggctgttactacaatggattgcatctccacacacaaaccacctgggctaaattagtattacatcttatttatctatgtcgattgtaatatctctgctgctccggcctcaatccacagcttcttcttttcccttttcttttagaaacacaggtcaaaaacaatccagcttcagcaataagcttcacacaaacacctccatcatcctgtgtgataagcaactgcggccactcttgctccacaacaaatgaacaatgcaaaggatttcaacccttttcattggtaccaccagtcatgcttatcatcctgctaatgtttcccaatcagctgattttatcccaaaccgcttagtcatctttctgaacaagctgccaataagaagcatctctcaatcttcaaatctgaatgtgtgctgtgtgcatcacaaaacccaggctcggcatgccaaatttcccaccaacaatcatttgtcctgtgttgctagccaagttagaatctgcacttctcaaagaggttacttgccggataaactacagaagcgctcatgcactctcagctgggaaaaagcccatgttcccctcgccctgagctcgcttcggtcgccactctgtgtgagccttcacaatgtctgctccggactccagctgaagcagatggtcacactggatggaggattctgtgttgccatcatcgcattcacctgaaacagcggtaagcgactgaagcacactgtcacggccacactccttcctgtaatccaaggtcatgcttgcaagctcgtgcttctccagtatcgaaattggagcactctgaggaaaaaaaaacaaaacgtactcagaaatttgaatagcttttgaatatacagtgcaagtgtttttacagcttggcatatgactaggaactaggttactaattacgatcagacactctcttttctgatctagagatagcatgttcggatagagaaaaggaaaaagaagttacctcaagtatccaaccaatatacttcacattgttcacatgctggttgacatcaaggtcactccacttcggctgacatgaacaaaggatccctcatgagaaattttatgcatgagaaccaccagcaaaatgaatgacggtaacaagcaatattaactgacttacagtaagcccttttcttgtgaattgtttggtagcagcgccatcaaatgtggtccctggcttaggcaacttttcaccctgctcctctgatatagcagaacggccattgaaatacgggcctatttcagctctaacttcatctggcatttttgaaagtcttctagtgttcttattcatcatcacccaaacactgcaaacaagagaggaacaattagcaatcgaaaaggaataaaacatgctggtaaacagcatgaaacaaaagaaatgcaacaaatgcaaacgataaacacaaaccttgtagccctcaagattgtttgaccagagttgtagtcccgaacatgccaatctcgacgcatgccatttttgccagcagcagctacccatgtgtcaacttggaccatatctcccctaaaaatttgcaaccaaaatttcagcctatgagaaattgtgtaaactacattcagaattcaaaaacagcagaccgttttccttctcataaacttaaaattgcatcaatcgtcagaagaacaggggaaatttaatagcaggtactgaaagttgctgacatggaagattaaatgtagcatgagatcaaaactcgatctagatcagggatgtcccctaggtccacagaatttattgcttactactaattcaattactccatcaataaaggcaacttttctgatctcttgaggtgtactctatatgtaggcaaatactagccattttttgttactttatttattcacaaaatttgtccttatcacgtttcacaatgaagaattttccatttgtgtttattaatttccctttccatccaccacagatttggtggacccaaaatatatttgttagttattaaggggtcacatggtaatgccctgtaaaatcaaatgattttctaaacatgcctgccatggtgaaaagtgagaagtaacatgaacaggggtgcaacaatttgtacgaaaggagacacagggcagataccacttaatagagcagttctagttcatcaatacattgtcttgtcaaataaacaaacgttttcctcagtaaatgatttcaaaagatctatcactcatcttatcatacaaggcaatacatgttattgttatgcttttgagtgtaatactccatttcaaggcactatgcctgctaaaggttgtgggccatgaacctacgagaagttcaaagcacaggaaaaataggcaaaaatattgcttatatctgcagaacaatagaagcagcaacttagtagggaaaggttttcatgtagggtgataaacactcgaacatgtgcctcatgtcgcataaggaatgcaagaatctacgtctactcagagtctcgatgatccatcgaatgccacagcacacaaacatagggaaaaaggaaaaaaggactgaagacaagtttagctaaaaacattacaccgtggatattgagtttagctaaaaacattacaccgtggatattgagtgataaatctttcccgtaccatgtaaacattaaattgtgacactaaatgcaccggggacaaaagtactccattaagaatgaaagaaatgttatgaattaagagtaaaaagagaagttttgccatccaagaaaatgatgtggagagtagtggattgcagaaaaagtaccatgatgggtatcgctcaacaagaagctgaattttgctgacaacccatattaagttccgtttgctcatctccggcgtagcaccaaaaccatcacctaagagaccagcagttttcacatggttcagagctgtttcctgcaaagcttcaaattacagttagtatgccacgaacataatgtaccaatagtgaaaaatacggaagaaaagctaaagcagcatagctccattgtatcacctgtaaatgattcattaatgtctcaatagaagctgtacgatcagcaccaatctcgtaggaccgaatcaagaagttttgcctaaacaccagcccgtcttggatgatcctaccaaagccgaatgtgtcagccagcatgtcaggcttcttcggcttccagtcaagcagagtccactgcttctcagctgccaggaaaatggtcgtgacagctgcaagaagcatgctccagtctggcaattggttatagaatgtcttcggagcagtgtacggtattatatcctccttgtctgggcttgtagtcttcaggttaaccttggttccattaaccttaggaagggcttgcgcctgcgccttgacttgcatggcccctggagacggattaggcttcgcgacgattccgcggacactcaaattctctggcaattcaccggttgtgttcttagagcttctagccaagctgcaggggaagaccctgggacagggaagaatgcagacgccgcaagagaaccagccatgactgatttgcgtctcagggtccaaatttgctccaagttacacactagaaggggcaacctgaacaattaatcaacaaaattatgagtttcatgaggtggtatattcagaaacgcaatataatgtgtcctatagtcatatggcatcaattaacattgtctaaaaaacatggcatcaatttaaaactactagcatgcttgaaa

SEQ ID NO: 46360 - DNA, 1392 bp, Oryza sativa
ggtctgttcatatccattccacgcaaaaacatacaaaacgaaatcctgcattgcctaaggaaaaaaaatgccctcaattcgacacaaaccctatttccaaaacaaaaaaaaaatcacacaaaaaaacagaatcagctatcactccggcgccgatacaactcaccatggaatcgaccagatctaccgaataaagctccaacaaatcgatacaaaaaaaaagaaacaaaatgcaaccaacgaaaatcacgccaaaatcccccagcagcagcaggaatcactcatcactcgcctcgccagatcgccaagaactcaccggatactccacgagacgcgcccaaatcaaatcaagcccccttccctctcttcctcctcttctttctcctcctcgcccacgaacgcgcagacgacgcggattagacttgtggccgcctccgctcctcgggctcgccaactcacacgacgcggagccgttaccgtctatatatacagagcgcgtatgagatacgtattcgtatacgcttatacgaaatgacggaagtgcccctccctcagtctctgtgcggtatggtcaatttggtcagctcagtgcagcgcaaggtggagcccacaaaaaaactttttttttgtttttttatttcctctcctttgctagccgatggttctatctatcttcacgaaatcttcgagcaatcattttggattccagctctttgacaaagagaagattatgtgcatggccagcgaaatttctgtaaggttcagaaagcgagtgttttttaatagagttaggcagctcactgcatcaattactactacttcctccagacaaaatcaattgatgttttggacaaataaattataaggaaaaaattaagtgtccaaaacgacaataaatttaactgaaggtggtaagcactactccctctgttttatttttatattcttcactaaaactaaggtggagaaaaatattctattttagttacttcaattgttaagatttgaattgcttcaattctcttttcaaacatctcagtgactgaaaaatgtacatattttcgtgcatagtgctaccaaagatgtttatattatggtataaatttagatctaaaaatgtttatattttagaatgaatagagtactccctccgtccctaaatgtaatagattttggttggaatagttaacaacaatttattcactttgctcgaacaaactagaagtactgaaaaagatggtagctacagtagaaattcagttgaataggcttatttttatgtcatttttcttcttgtatgcatcgttaagttcagtgttttcaacagttctttcgaaaaggaaggaaaattttccctcatgaccccaaccatccctttcttctctccggatccat

SEQ ID NO: 46361 - DNA, 1685 bp, Oryza sativa
catgtcttgagtttggagttcagatgaaggatatgataagatcaaagctcaaacggcacagcatcaccaatgcaaaacggcacagcatccttggtccttactcatgttcagttagcactgcaaggagaaaagaaaagaataaattcagttcaataattagaataaaaaaactggtttaagaacaaaaaaataagctagctataagcttgaccctacatatcaggcccaaatggtggatggatgaatatccttgtcttagcgtcttagcagccaatatacgctatataggagcaaataaaacagcagaacatacagaatatttttttttaaaaaaaatataataatagaactcatctcataatgcatatctatatttcaatttgctaactgttggtaatggtctataattccaaaggggtcagatttactttttcaaaaactgaagtactagaaaggttcaacagtcctataatttgggggcaaagctagtgaatcaccgcagacaaaatttgggtttttacacttgccaaacaattcttttaggctgacgaagttccttcattgttcgtaccccactgttcctcaccctctttcccatttacaagaacggtctcttcaggctcatcagcatcaacttcgacagcttcatctgtgctctcctccactttgttctcttccaaaacctatgaggaatcctatgttattattttcagaacatgatgatgaatatagcactacagacatttaatcaaggagaaaggataaacggaacaatggttgagtgacacggtcatcaacactagaaaggaaagttgaaaaatttcataataagttgaacatggatagcaaaatgcacactccacacgcaatacctcttcatcgggctctccattttcatctagtgcatcttctgtttcctcatcttcaatgacctgcatccttttgaaagcttccacaagagtcatgtctgactttcagcatggttcaagtactcatcagcaggaggataatggaccctgaagaaagagaccttatcattgtaccaggtttgtttatacaatagtttcttccaaaagaattggtagcgttacatggtaataataaaaaaagcagcttctctggtaatttttacctccgagaagcaacattcttttctacagtaagtgcaacctgccagtcttcaaataaatttggatactcagaaggatctgccagagactctgcagcttttggattaacctgtacagaaggaacatatgaatagataaaaccagaacaataacagaaaatgtttctggatggaagcacacttttcaatgcaaagataagagcagaagattaagaaattactttactgaggtcatttctccatattgctactatctcagaaactttgctgggaagataagaacgtgccattaacgcagcttcaggtatacgattgctgtataatacatagatgaggtttagctttgaaaaatgatttactacaatggggagttcataacagcaaacaggatgtacatgtacctgtctatcagcaattgtatgcaatcttccaatttaccaagcataaagagacagaggaaagcaacattgtttttgccatgctcctttgcttgagaagcaagcttctcgattccctcagcatctccaagagatgaatatagtagcaacaggccact

SEQ ID NO: 46362 - DNA, 1899 bp, Oryza sativa
aatagataatatttgactcactttgacattcacatcaatgcggcgtattagtctacagtcagcccagtcataaaagcaaatgaaatcactggaacacatcgccaataatattccaccaaaaatacgttcagctgaaaatgtagggcgaatagttttcttctcctgcatattggatcattcaaaccagaagatacaatattgataaatgccaacagaatatgatgtgcaattctttgccaaattcataataaaaggtccttagaacatagtaactaattaaatcaacctacgcttaaattgtttctagatcaatgttatagctaaacataaatggagtattcatgtaggctgattggctgaatgacaacagattgtcaggaagtaagatatatagtgtaagaaaaagaaactgtcatctaggtgactaggtccaatgagatgcaaacctaaatcagtatgtaatttcctttcaccaaacatgatgattgatgaatcatgaacagacattaaaatgcacaacataaaacttttgattgaatgaacgctcgtgttaaccagaaacctttattgattaaataaaagttaactcaatagttagccaaacaatagtacattagacatctcaattgaatattgcaaggtgtaaattcacggttaaaggcaaagtgataaacaggtgaagatggtgcattctccagagtggtgattgaagaaatgaaacactacagttttactgatcaaattcataaaaggaaaggctacaatcaatgtgggccaaacctgaaatgatttactgaaaatctttattcttgatgtactttccctgatagcatactctccttctgatgaccaaacaaactccaatgcagatccaaatgacctattcctccaagccaatgcagtataaattatgaattcaccatctccacaaactacgacaaatcttccattggggttatgctttaagctctgaccaaacaaaaagatgacacatagtaagattgaatactattcaagatatgacaaacaactaacattacctagtagaaagaaaagaaatgttgtagccatctcagtctaatatcacatcaaggaatcacaaggaacacaaaatagaggtagtggttgtgtgaaaactatcaatcaaagcaattaacactaattggacaatgtcacctattgaactacaagttccatatgttctttcactaagcttattagcataaccatttacaagtcatcacaattcacaagctgcaggcatggatgataaccactatatatgctgatgtgagattaatggatgctatttatgcagaagttcaaacacataggttactgcagcactgctaacagtatcaggagtaaaatataaagagcgttgtgagttgtgacattcaaaaatacctgtgggtaaagatcacaacttcctaattctttaacagccaatggcaatctttccccatctgtaacctgaataagaaaacatagtagggcatgagatcagcttctctgtttgattgatcgattctgtttgcaaacaggccaactgacctcaaagcctgcaccaacagttttgatgttcacagtctgtatctcgttatgttttgcccaaatgatttttccactggtatccatgcttgccacaggtacttcacgtcccatttttatcattatagttccctcatcataaccaattaccatcctacatatcataaaatgtcgaatggtgttaaaaaattgaaaggaggagtgacgcagaacagtagtaaaagcaattgattacaatgcaacacaaaagcagaatgcaaaggatcttctgtttaccttcttgaacccttcatgtatccaacagcccagactcgttcaagaccatagtttagcgtgttctcaagtcta

SEQ ID NO: 46363 - DNA, 7883 bp, Oryza sativa
accgaatggtcatagattacactgtcagctaccctcttttccaatgtctaacatagatttggagcttttctatgtaagaatagcccatgcataatatgtttaagagttatgagataattataccaaaaagctatattggggaaaatttcctctaagaaaatatgtaaaaacttttggatcaaattttgaacccaggacttgagaggttgccaagagaaaaagcaaaatatccagaatccagaaatgagaaccaggaaattacaagttgtttctttcgtagagagcacttgaatagcaaacaatgagaactaggaaacagtccacatcaacaagcaaaaacacaagtgaaactgtgaaagcaacctgtaagttgtcgaatgccatatgcgaactgtgccatcttcagatccagtaatgattataggaagctcaggatggaaacaaacagcagaaatgttgtgtgtatgtccttcaagtgtctgaacacagctcttcgtttggtaatcccagacctggttcaccatgaccacaccatcttaggactgcacagaatcgtggatacttggaacactcaaaagtggatagaaaaaaaaaacctttgcagtggagtcatcagaaccagtgatcaaatagggcctgtcaccaccagtgaagtagtcaacacagttcacacccttttgatgtccatcgagtgtgaaatttggatccggagaacccaaactccatatctgttgtttcagttttagaaccattagtgcacaaatcacctcataaaaagccatatattgtgaataacatccactgcataagagattgtgaaacagacctttgtagttcggtcaagagatgcacttgcaaaagtgttagtatcctttggattgaaagtaacttgcatcacgtagtgtgaatgtccctcaaagatttgagtgcacatccaccctttatcccagtcccacaattttatcaacatgtcatcagatgatgaaagcacatatggaagtgttggatggactgcaacacatctaatataatcagtatgagcctcaaaaaccttaactttgtccatcgtgttgtagttgtagacacgaatgaacatatcgtctgcaccagctacaacccattgtttccgtgaaataaattttgctgaccgcactgaaattaagatcagatacaagttagcatcaattcaacctctatgacagattttcatttcatgtgaacataagcagatgagtacctggcaattctgaaacttcaaatgacttcaccattgtctgcaaacatacaccaaggaaaacatgttaataatcaaatggaacgctaagtatagattatgcaggattgcaggagcatgtgatggaatacgctgatttgaaatgcagagtcaattctatgtggttcaaatccaaacaatgatggtcatgatataagactaggcatcaaccgatcatcctataggtcaatgcaaaattgtaaaaggcttacatgttacattggagtaaggcaccaaagctttgacggccaccaaaaataacatattacattggaataaggcactgaggctttgcagccaccaaaaataatatatattacatataatggatcagttagccacagatggcattaaacttcagtgggagtataacataagtgtgaagatgtaataatgtggtgagaaatgcttctatgttcctcccatagtgatttgtactaactggaaagcatgatttaaggatgaatgacaaaactacttagcatataccccttcatccgtcatgtgattaagttgtaaagcaaaatttgagctcaagacatgcaaaactaataagaaaccatatagattatagaaacagaagccctaattttatgcacaatcatgcttcggtcaattagcatgagtacagttttgaatattcatatttacttcaaaagtagttgagtcttagtcttgcttaatggggaaacaatgaacctaaaatgcaactagaactcttacctgcgactgatagtcccagatgcacacgctcccggagtaaagactcgacaggatcctacaccaatgcaaaaacagcttaataatcaaataatgaagcaaaagcacatcaaaatggtagtacgaacggctcaaatcaggctaaaatgtgctaaaaccctcagaaatgcaggtcacttgccatggctccgtggggtgcagatccaccgacttgaccctctccgaccgttgcgcaaacttcctctaatcacaccatcccaaagacaaaacaaccacaaaatcagcacaaaactaaccaccaactgagacagcaacaaaccgagatctagcggaatcgggctcgccgagcccgagccagtggcgcaccttgatctccaacctgagcggctgcaggaagcacaagcagaaaacaacatttgatcagatctctccccaaaccacacccaattacttcccaacacacacaaaaaaaaaaaacgggcgagcggattgatcggaacagcgagagcgcgctggccaaagttcagatccgcgtacgtaccatggtggcggcaacggcgtgggcagagcgggggagccgggccgcgcggggggggctaaaccctagagatccgccgcggcaacggcggcgcggcgacgcggaggcggaggcggaggcgaagcgaatccgatcgcgagctcggcgggggagcgacgaggagggtgggaggaaggaaaggactaaactaaacaccaagatgaggagggggttttgtgcgtaattttatttatttttgttattactccatttcaaattagcccctgagaattattaattaagtccctttttgcaaaaaggttaacgtacgggtacgattaccaacttttgggccccagctgttgggccgcgatgtgggcccacgtgaactaaggcctggcccatattatattctttttcctcttttcttttattgtttttgcgacttaaaaccctctccttgttcttcccaacttcgcaagacgcgattcaatggtggacgagattggagcggcaaagaaggggtgaagaggtgaatcgcccctctcttttctgtaagaatcttggtgtccttgatttggttctgtgcgtgttcggagtggattttaaccagagtttcttccgtgttgaattgttctgaacagtgagttcttggtcaggttcgtagtcagtatgcctgaatcgagctcagatcctaacaacgggagaggaaagtcatccaagaggaatctcccttcttggatgggttcgaaagacggggaggaaaatccaggcagaagaagcacatggccacccacgagaaggtgcagaaaggatcggatttctccaaacttttggtacttattatctaaaccctctggcggtctaatcacaactgaaccgaatatatgttgttcttgatgtatgtatgtatggctgaggcgattccatgtgtttgttttgggcaggatggggtggtctttgtactttcagggtttgtgaaccctgaaagaggcacattgcgctcccaagcattggatatgggagccgagtatcgacccgattggacatcagattgcacacttctcgtttgtgcatttgccaatacccccaagtttcgacaagtcgaatcgaacaatggaaccattgtctcgaaggtggatccttattttagccgttcttgttagctttctttaatatagttatataatttatatcagaaggacactgatatttcacttatcctaaaaactagaattactatgcatgctaccatatatactaatacagtgcacgacagagttgacagaatattacctttattttcattgattctttactgcagcaaaaagttcttcctacttgatgccatgagttctagattgatgcacttttaacttctgaatagttaaccactgctctgcaatatgaccaactgaccaaaattccatttagaaattagaatgccaagaaagaacacaaagtcacatacagatcatgttaacttgcatcttccatcgcaatagttccattgcctccacctggtctttcagtctgaaacataggattgcaaataggaatatagtatattcttttttgtacactgtggcgccttgggtactagcttgtactgttttgtttctgttcaagagaagccatgtgccattaaaagccagtctgttcagcaatgccacgtataaagattgcagatgttcttccttgtctctgagcaagtaatttgtatcgccttgtccatgttatgcctaaaaatgttaaatgtaaatctctcggcaagttggcaacattaaatacatatcaggaaatcatgctattttatacattggcaatttggtaaacttaaaagattgacctagcatatcgacagaaatcgtaatttaccttgtaataccatgcgctggcagccatcaattaagttgaatttaggattgcttagagaatcacaattgctctctttccttgtttcaggactggatcttagaatctcacagccaaagaaaacttgttgatattgagccttaccttatgcatgttggaaaaccgtggagaaaaaataaagagctagttgaatctgacgaaggtgataactgagtgtcccttatgtttgatgtttatttcatttaggtggtccgttttgcttcacgaaaatctttggagtaacatgaaaactttaaatctttggaatttttctttggtctatggagttaatgatcattttattaatttatcacttattattattaggctgtggtgtccttaatatatgtcttatttctaagttcttatgcttatgggtccttttgaaattcagtgatatgtgctaactgcatgcctatattgtgttgtttatgataataattcaataagaaaaaaactactatccttcatgttactaatgttttggccatttccatgacaaatatattctaaaataaagctaagcatccatcatatttcctctccaagttgaaagaatctaggtttaggacatgttgtagctgcaacatttttttctcgaacgtgcaggagagctgcgcatcattatgttaagaagaagggaaagagtggaaaaggacaaattttagtacaaaaaagggcttgccaaagaaatagaaaagtactacgacattctatggccaaatactactaaggcctttggctcctgtcatacaacataacttggcctcatctctaatatcctacatgatgacattggagactcatagtaattcagggatactcatttattagacatagctttataccgagatgagcgggccagcttctttccctcaatgaagcactgactgatgcctataaactaacttgtgaaagttgagtaatagtggaagctttggagtacttgaatattctatttgtcacgcaacttgaatttgaagtagttaacaaatgtataagctatagttttctaactatgttttgatcttctgttgtagatcagaagaagccacataaagagcatcagaagcaagttgatcgatctcatatcaagacatctccctctgcaggcatagaggtatgttgaaaataaactagtgatatagccacaaggagcgcatatgatttgaatttatgcttggtaactattagctggctgcttgaacagttggacttattcacagtaaactgtataattagatattgactagctggtaaatcaaacatatttccagccaaaacctgaatacttcaattatgtgatgtctttagatgtgcttaatgctagggaagtcgtttgttaattttttagaactatcaacttctgttaaaaaaacatatttctgaaaaaaaatctgtcaacacttcgtttcgacaggaagtcatgtccaatatttttgcctacagactcttctctcaccaaacgtccatgtttttgctctgtttttttaccttgttaaggtggcctaaatcagagaaatggttctagatagaataagatgaatgcagcatgtgttcctgggagcatatcaacatgctcttcttttgtaacaatgaataccttcttcttcttctttttcatgtcttctttctccaacagctaataataatttctttatttacaggcaaaacattcagatgttactagtaagcaattttctccaacaaaaataaaacaatgggcaaagaatgatttagcacagacaatatcatggttagagagccaagaagagaaggtgagcattttatagggttaaaaagtttggtgaaagttgagttacatttttactgctaagttcaggttatatgttccctgaagtaattcaacaagcactgacatatgccctcaggccgtcatgagatcatctgcacttctaatcaatgtccaatgattttctagagagagagaaaacatgtatctgtttggcatttctttgttgttttaggtggtgtgaatggaaattactccagattaagactgttaaggtggactcataaaaatcaaatgtgtattgtgtgtgatgacaaaacgacagcaaataatcttgctatcagttgacaaatgctagtttgtagagcatatctggtagttttttttagtagtttctctgcctttcttagccctctttacagccagagttattcttgattttctatctgactttctttcttcttttctgaagccagaaccaaatgagttgaaggcaatagctgctgaaggggttatcacttgtttgcaagatgccatagaatctctcaagcaagggaatgtaagaatgcaatatccttccttatttaaagggaactgtttgctttatctattactaataaacaaaaactctgatatatccaagtgatctgtggactgagccgctaactttcaataatctaaaatgattgaattccttgttaggagatgccaaaatcttaatctgagtcaaattgtcattataatctagttattcttccattgtgatccttaagagaactcaattcagataatcaacaccaatgtaccaaacataatgttcctttcacacttgttgttactatcagttgaccatggtcaaccttgtatttaggatgtcaagggagtggcggagcagtggagctttgtcccccatgtcatcaatgaactggcggaacttgatggaagaagaaaagagggatcgttatcgaaagaacaactctcccagctagcaatcaaatgcaaaaagatttatcaggctgagtttgcccacatgcatgataatgacaagaagcatcagagcaagcctagatcagatgatgctcagtatgacagtgatgacaccatcgaaatgacggaagaagagattgatctcgcatgcaggcaactccctggggtatgcgggaggcagtagttttaggtccgttcttcagaagatgcagtaagaatactgaatatccatctttcccaatggtgtatgtgtctgggatctggatagctgcatgtgtaaactgaacaaaatatggttaatctagatcaaaattgcaccatttcctttgaaacttatgtcatgatatccattcttcaaaacagtttgcacctataccttcttgaataatttgctttcttagagtgggatcttaatctgaaattgagcaggagtttacaagatcaaattgccagatactgctcccttctgtccaaaaatttatgttccatttaggcctgctatagtaaagaaggtgaactgttgtggactcagtttgggctaaataaggtagtaggctgaattgggtaaggttgaataagtcaagtccacaaggctcaaacataaggttcacggtctagactggttactggaggttacccggactaaaatgaatcaatcagtggatctagtgtgttaatgcatcatgatcgtgatcattatcatcaaaagttcttaaaac

SEQ ID NO: 46364 - DNA, 2797 bp, Oryza sativa
tctttttctttttacccctaggggatgtattttcttctgctctgtataaaatacatggaacttcttttctttttacccctagggattgtattttcttttgctctattcaatgaaaaggcactcttatgttgttttccgttaaaaaaaaagaacaagcaggagaccttttctttattattgtaagtcaaagtttattagtaggctagaaaaagaactaaataatagggactaacatgaaataatgctccctctattttatactataaattgtgttaaacaattattttaggtttgattaaatttatagaaaaaataataacatttaaaacatcaaattaatttgatcaaatcaaaccttgaatctattttaataatatatttatttcgtaattgtattatatttttattataaatttagccaaacttaaaagaagattaaataagaagaaattcaagacaactcataatacgatgaaacggggggagtacatcatgtacatgcacatatgatgtccacaaaatggagacctaattaagcctgggaagctctatatgctgcttcttccgcaccgccggcgatcgagctgctaatctcgagctgccggagaccgtcctcgagcagctcgcgcacatcactaagctcctcgtcgccgtacaaggcccggatatccctcaccagcaagtccaccgccggcgacatcatgtctcgccggcacatcgggcagctcatccccttcctccccacccgcgcccacctcgccacgcaccgcgcgtggaaccggtgcccgcacgccgtctccttccactcctcgccgccgccgttgttcaggcatatcgggcagtcgccgccgtcgccgccgccggccggcgcatccaccgtcttcatcatcgccatcatcagcccggatacattgtcgtcgtcgtcgttgacggccgccgccgccgccgccggcggatcatgtgactgaaggtccgcgaagctgtaggaacgggcctggtctagcaactcggcgatcgccgtcatgtcgccgtcgagcgactcggtgatcgccgtcatgtcgccgtcgagcaactcggtgatcgccgtcatgtcgcggaggtaagcttctccgtcgtccatggcaaacgacgacgacgacgacgacgccatgatcgatcaaatgatgagcacgtacgcactctgctccacgtacgcctccctatttatcgacaaggtgtgcagtccgtgtcagtgcaggacgcgtaattaagtagccatttgagtcggattcggagcacggatatacgtatataatgtacgtttttttttctcttttgagaattataaagttttacacatgtacaaatttgtcagattttcatatatatacaaattaaggcatggttaattagctttctctcgtcctcttccatatcgttgctgatatgtctagttaattagcatggcatgccgacgtggcagttgagcgtgccggcgaacttggtgagctggccgacgtacttgccgtgcttggcagggatgaagtcgagctggtcgtagctgcgctcgttctggccgccggactcgttaaagaaggcgccgttcatcatcacgtcgccctgcgacttccacacccactccttgtactcgtcgtacggcgtgtactccctcttggtcacctccttggcgttcaagtcgtcgggcgcgatgaacctgttcccctggctgatgatcgtcgggttcatgttgccaccgatggcgtacatgagccagtgcgtgtagtcgttgttgacgacgtggaagaatccgaacctattcacagaggtagggtttacgtgcgtgcattcataggagtgagtatgcgtgcgttgtactgtgtaattctttaaaataaaaagaagaatccgaacctgcagcgcggcacaaggcccttgccgaagtggttgaacgccacggtgatctgcatcacctcgtcctgggcgtcgctgttgctggcgccgaagagcatgacgtggtcgtgcttggtgaagtggccgttggagatggtgatggcggtggagccgctgacggcgtcgatgaggccgtcggagcagttggacatggagacgtggtcgatccagatgttggaggaggacatgatggagatgccgtcgccgtcgctgcgcgtgcggaggccgtagtggcgcttggagtcgcggatcatgccgccgccgtgcggcaccgagtggtggatgtggacgttgtggatgatcacatgctggacgccctggagcgtgatctgggcgccggtgatgtgcacctgcgcgccacggccgtcgatggtcttgttgtggttcacgatcagctcctgccggagctggatgatcatgtcgcgcgcgaacacgatccacatcggccggtcctggatcacgccgtaccggagcgtccctttcctcgggatgaccatctcgtcgtcgctggcgtcggtcaccacgtagatcttgccagcggcgccgccgacggtcctgtggccgaacccacggacgcaccgcgccagccgcttccggtcggtggcccagtcgtcgcggcagcgccagcagcggtcgatggggttggtcgccatgcacgggccggtgtacctggccagcgagcggcgcgtggtggcgcggagcacgtcggcgttgaagcggttcacggtggcgacggggtcgctcacgtaggcggcgcggttgaacgagcgggccttctcggcgcgctttttccagtactcctcgtcggaggtggcgattgtgcgccgtgtgcgccgacgtcgttgtgaccacggtggcgacgacagtg

SEQ ID NO: 46365 - DNA, 5926 bp, Oryza sativa
  unsure (1)..(5926): unsure at all n locations
ggtgcagcgctatatatatcacggcttggggtatgcatgcatgctgttgctgcctgctgggcgctgtgctcagaatggactctcacagcgacaagggaggcgaaccgtacgttgtgggcgttttagttattgcaccgaaaatatgcatgtgcagttgtaacggataaaaacgtttttttttataatataaccgctaataggaactgagcagcgaattcactatgcattatactagtatggtgtcccgtgcagattgcgcgctagcatcattatatttttttctcatataatagcatatatgttttctcaatgtatttttcaaatatattaaaatgacaacataattttcaattttgtactaactttacgaaactactaatgtgtaatattcatattgtattttatatacatgttagttattaattatttttaatatcaaattttagttatttgtaaattatattcctatatatggaatctagactcgtctttccatatttatttttttaattcctaattttcgttatctgtaaactgtatttttatatagactctaggctcttcttccaatattatttatttttaattctaaatttttattatttttaattgtatttctatgtggactctaaacacatctttcaatattctttaatttttaatttcgaatttcagttacttctaaattatattccaatattgactttagactctttttcccatattttttaatttagaattttagttatttgtaaattgtatatttatacaaactctaaactctacttttaattttattatgtttattctgaattttagttagttttaaattcctatatggactctatactctacttctaatattccttatttttaattccaaatttctattatttcttaattgtatttctatatggactctatactcttcttctaatatttttttattttgaatttcgaatttaagttatttataaattgtatttctatatggactctagtctcctcttccaatattctttatatttttaattctgaatttcaactatttctaaattgtatttcaatatggattctgtttttttctccgattaatatgagaatttctaggtcgtgagagcgaacacagaggctcctttttctattcttttaataagttaatagatagtttgaaaaggttaatgaaaattggtccttggttttgggccgcctattctttccttctttttagtctcaacccagtctgttgcctccctctgttcaaactgtctctcttcgatccagcccagcctagtagagctacagacccagttcgtatagcccaccgccgtcttcaaccttcggctatggatgccgatgcaacctggaatggctaaatcacaactagtcgtcagcacctccccgcaagactgaacaggtggcgcgcgtggagaggggggcagcgaacgacgcgcgcggtagagtcgtgcgcaccccccgcaagactgaacatgaggtctcttaaggagtcgtatgcgataatgaaggttgatttttgcagatgtcgccagttacggtacgtttgcaacccatagggggctctcgtaaaaaaaaatcgttttttcagtagtggatactttttaatgtttgatatttacataaactttatgagtcttaaactaattactataaaaaatcccaagttccaaataatctctagattgtattacacgtgccccaggtaaaaaaaacacaagtatatactactgtactatatatatatttggagcaaattaactacttataaaatggataggaatcagagggacctggcataatactagtaataaaatagataggaatcagcgggcgtgagttgtggcttaattagtgagtaaaatagatagataccatgtataattgtatatacatcaatacattgcatttctttgttgccgttactgcttatatatagtggtaaattctcactcgcgtccaaccattgacatgtatcttccgtagtcagaagaatattatatcaaagccatggagcctacaagcacagcagctgtgacgcctgtcctcctggtcagacttgctgtgctgcttgtggtgtttactactggagcaagggctttggttcacaaaaccatagaggtataatataattttttttgcggaatttttatttcatgtcgaatcgagaatcgaccagtgggtttaaatatttttgtgtcgatatatatgttcttctgagaaatgtgtatattgagttgatcgatgtaaatgtgcacaatccaacatgcgctttttcctttctctactgtataaaagaaggttgtgcggaagtatacaacttttcaaatttagattttatgatattattcatctgagattttctgcgtgcaatttatgagtatgtttgactagcctgttttgaattcatatttggtctgctggtgtgtgtgtgtgtgtgtttttcttccccaaaatcagagcgacgatggcgatgtgattgactgcgtggacatcaacgagcggccggcactgaatcatcttcctgatcatgaccgccaaaaagttcaggtctccccttactctaaaaacgaaaagaaaatattgatctttctttactcatgatcaagacatgaaaagatataataaaatccatgctattaattaattttcttgtcctagataatgaagccagggcgaagcatcaagagcttcaccagacatggcggaagcgagggagctgcccggccggaacagttccgatccggcggccgtcggcgagctcgctcgccgtgccttctccttcggccatccacactacaaaccatccatctccaacgatggatggtccggctcatcaggcacattagaggtaattaattaatataaaaatatttttattaggagttgccaaaaataatacttcatccctctcatatcataagtcgttttgactttggtcaaagtcaaactacttcaaatttaactacattttatagataaatgtttataatgccaaattagttttattaaatcaataattaaatatattttcataataaatctgtcttgcattgaaaatgttactattttttttctataaatttagttaaacttaaaatagtttaattttaaccaaagtcaaaatgatttataacctaaaacgaatgagtagtaattaaggttgtcattatgtccattatccaatttatccacacccagctagctgtcacaaatatgatttgccatttttatgattttcggttttgattaaattacagcgcaaattaagttcgttaattgatttttttagaattaattgattgattaattatgtacaggtggctggtgcttacggcagaaatgggccgtaccatggtgctcgggcagatgtaccaaactggaaggtagacgtgcagcctcgcgagttctccatgaactacatcatggtcggctacacgctcgacaaggattacaggccttatccaagttctgatccaccaaaaactcttgccaaccagattgtggttggactcgtggtaattaccatatttttttctgtaatgaaaatcaaaaggcacacgaccaatatgttctaaatgttttaaaaaaaagttaggggaaaaaaatccaaaccatctcctttctaaatgttaagtatcacatagatttataacggaagcctataacgactactacctataattgcaaacataatattagaatattaatgtatatatgttctctgtggatatatatatttgttcgtatatatgtcactgaatgcgggcctggccagctttatatggggactctttatcaagattgttcatatattacaccgtaagtgacgactcttcatcagcgcggctgatgatcgatatatactatagctaatacatggggattaaggtgggctgagatagattaataattaactaattgactgatgatatatgtgcagaacgacagtggagctcagaccaactgtttcaacctggactgcgatggtttccatcttcagaacagctccttcgctctgggctcctcctggagcgactcactgtcgcagcatggaggcgaaagatacggcgtgacgcttagcatccacagagtaagtcaaataaatttggtgctcctgtcttctaccgtatccgttttaaaataagttcatttttcgctcatctcacacgtactaatataaacatcaaaagattatatgcatctacttcatctaaatctcgatacaactattactcactttatctactctcaacacgattactccctactttcacaaactctatcccatttcaaaataagtttatttttcgctaatctcacacgtaccaatataaacatcaaaagactctaatacgcctaaaatttttaaaaatttcagatcaaccaatggttgttaccactcttctacttaaaaacagagtctcttctttaaatggttgaacgattaattattataacatgtaaaaaatataaaaattacacaaagtaaacttatatactccctccattccataatataagggattnngagnnnncgctngcnncgnnngactactcgtcttattcaaaattttttgaaattattatttattttatttatgacttactttattatctacagtactttaagcgcaacttttcattttttatatttgcaaaaaaaatttgaataagacgagtggtcaaacgttgcaagcaaaaactcaaaatccctaatcctgtgggacggagggagtagctcataaaaatttcaaatacttacataaaagtagttggtactctgctccggtctttcctcgattcacacgcgagtgaaacagcagccaagaaaagtgctcatggtaggagccacgcataccagcgcgagcacaaggggccgatgtcacggcgtcgtcatcaccgtgcgatccagaagctcaagacatccaaatcaggcgatccactcaggcgaggaggcccacaagtaaattccctcatagtgagtggacccggtgatgtttgccgggccacgggtcagagagtgagatctaatagctcattgctatataagatcggcagggtcgagagaaaagggacatgaaagaaattgtacaaactattccccaatatttcaaactctcctctgcttccttctccttcttcttcctctagctctgctcttcttcttcctcacgaaacttctatccgctgacttcttcgctacttgagtaaatcgaatcggagagaagtgagttcgtgacaatttggtattagagcactcatcctggagaaaccacgctacacctctaggttgcagctgcatgtggaggccatggagaagcagaacaacgacttcggaaaagttttggccgagatccaggagtcgctggtgtcgttgaacaacaagcaagcggagactcaagctgtggtggcgaagctggatgcaggagtcaacggatggcgtccgcaagtggaatcggcgatccatgatttgcgcgcggaagtaggagatcttcgtcagcagctggacctcgtcggcaaaatgaatcaagcttcctcttcagcgctttccccttgagttccgtcgacggacgaggaaaggaaggcgccgttgctgcccactccgcccccaacatctcaaccagcggcggcagaggaaaggaaggcgccgttgctgcctaccccgccaccaacatctcaacctgtgatggcgaagggcagaagcaaatgggccaatggccaccactctgcaacacaactccggggaagggttcctggtgtacatctgacccagaaccttgccccgggcaagggtacgttcgattccaatctcacgcataaggggaatttcaattttgcgcataaatttgagggtgctagttggggatcagaggaatttgattttgaacagggggaacgttagtatagt

SEQ ID NO: 46366 - DNA, 1241 bp, Oryza sativa
gaacttgaatggagtactccctccgtcccaaaaaaagacaaaccctgatttccgtgcccaacgtttgaccgtccgtcttatttaaaaaaattataaaaaaaattaaaaagacaagtcacgcacaaagtattaatcatgttttatcatctaacaacaataaaaatacgaattataaaaaaatttcatataagacggacagtcaaagttgaacacgaaaatttagggtttatctttttctgggacggagggagtaactcaagaatttgaagttcacaaagattcagaattttaaggcctcatttgaatcacaggaatgtaaaaaaacggaggaatagaaaaaacacatgatttaaataggaatataaaagtaaaacagaagattgaaaaatacagaaatatccataggaatgatcgtttaattgaaccacaggaaaaacgtatgaatcaggtgagagagatagactcaaatgattttttttaaaaaaaaggttagacctcttgctaattttcctctaaaatctatgtagaattatctattccataagaattttaaaaggaaatgatatgatttaatcctttatttcaaaagctttcatacgatgttttttccatagaactacaattatctaaatttcatataccttttcctacaaattaaaataacccttcgatgaaacttctatggagtaggagtactgtactctctcaaagaaaattcagagaatagccagctagctgttgtctgttgccctcagattgagctatgcaaatcaggtttgctgttccgaggcaggcagctggacgtgatggaggaagaactgacgccattttgccacacaacagtattatctttaggctagctgctgctgatgacactgacggtttcagattcgtgggtgaggaggcagaggggtagtttgggaaacggtggtagcttcgagaaacccagccattctgccagggtgttctcttcaccggccgtggccacgtgcatgcctctgtgccggtggccccaccgcacagttgctcaccaaacaactttgaaagtttttaaaattataaataaatagtatcatttttttaagaaactttgttaaatttgattttatttttatttttttgctaagttcaaaaattttacaaattcggtcggaagaacctcctacttggagccaccggtaaacacgaaattttggagatccagaaccgaaattgtaagcctggagacagacaccatatgg

SEQ ID NO: 46367 - DNA, 9940 bp, Oryza sativa
attcctgcagccccaattcaaaagagccctaaacgcctaaacccggagagagacggatccactagctccaaggtcttgacagtcaatctcgctgcaagataaaattttgcagagctttaatttttctgccattttagggtcagaaacggaggtcaaaaaataaataaatatttttgctttggcctaacacaagactttcttctcattttctttgttgctacggaagtcaattcatttcggctacgtaccaacattgacaattcgaaatgaattccggtcaggccagtttgaattgttcgtgttcgcatcaattcctgctatgaattgatcaaaaacgttgaaaggtacatatatatgcaggcgtgacttcctggacaataaagctagctattctttaattaggtccttgcagtgaggctaagaacaagctaagctattagctaattaatttaagactagtagatgatttggtgtacagaatggacagtttgcattagatcaagtccaactaggaaggccatcatctctgaaagaatttaaaaagttaaaataattaatccaaattggcgtaagcagtataagcagctctggtcaaactaggtgatcgatggatggatcaaaattgaatatatatatatatatatatatatatatatatatatatatatatatatatatatatatatatatatatatatatatagtcaagaaccgagcattattgcttaattaattaattactagtcgatcatcatatgatgaattatttgctactagtacgtagctttcttgtgttcacctgtctactagctgctagctactttggttggatatggacatacatatacttgaagtcataactaactcgttatacatgatttattaattacagtgccagtacgtaatccctccatccctaaaatgctagtcagatatagaaaatagagagaaaatagggagaaaggggatatggtgtactactgattcgacggctgaaacaagaaggaaaaaaagtactagtaaataggtatagtaaatcccactctaaaattatagtatttgtgtgataagttcttaagctaaaactatgtaatctcccaattctcaaattaatcatcatataacttttaaggttatttataaatgatcaatatatattagtatatatccttaagtttattcgttatccgtgtatcagagtaaatgaatattaataaatacatgcatcatacacctaactctttacaaccaactaacctgcaatacaatattttgattggttattggttagaaaatagtggggatagtgcatatattaaatttattactgagtaaaagtagcacgtgagaataattgattttcgttcatcttagtgtacttatgtaatatgatgattaattagaaaaagagtgagtaatattttactacggaggaagcattaagcttagtagagactttaatcagttatactctatatgtttcgtattataagttgtttgatatttccacagttaaacttttttagatttgactattatagagaaaattagcagcatctatgatgccaaattagttttgttaaatttaacattgaatatattttgacacaatatttgaaaatattattatattttgttataaacttagttaaatttaaagaaatttgattaaaaaaattaaataacttataatatgaaatgtatcggagggagtactgctcacggatgtgctgtggtgcagtatgatcacgcggttaatttaattacagcaacggacggagatgtttgctttgctagctttgaattaattcctcgtcgttaatttcgttcatcagtactactgttctttacgaactagtctcactcactagctgccttgcagtgtcctcgaccggtcgttaatttccatggacacatcaaggccgcgtaataaacatatattgctggcacatataatttgacggatcgtactacgtatatgcccggaccacgacgtaaaatggagttagtgagatgttaatcttatcttataatacgaatttcatgcaaaaaattgaaagaagaattgtgccacgtggcaacaccggtttcgcgggatggctcgatcctgcttgtgcgcgtgcagcgtgaaacgctcgtgtgcgtgcgtgcagcggttgtccagaaggtcgtccagaagtttctattgatcgagcaattaggtccatgggggcacagcagtctatgtgatttctcgcgttgccgccgtacggctggcaaagctcaggaagctattgcttcctcctaccaccggatattgagaactaaagaaataatgatacatactttgatcagactaaaagaggattaacaggatgtaatcaaatcacccactaaaattcctacgctgcaaacatccatccttttgcagttcctgtgtttccttattttgtgtccgtattcatgtgatttatattatttctttcctgtgttttcctctacggaaatcatagaatcttttctctttagggcaatttcattcttacccctactttgatgttcaatattgatgttgcccagtattttagggttttgtttttgcccatggttttttaaataaagataaattttgcctctacttttgatgggcagattaacaatattaaatctttagcgagaaggcattcaatacccttactcatgttgcaaacttcccctgtttttgttcatgataagaatttgcccacatttagcacatgaaccttgcaaattcgataaacttttaccaacatgataattttaacataaacatcaataaaaatttgcttcaaaatttgatatcttgaaaaaaacaaatagacaagtcaagcaaatctattgcctacctgtgccaagctgtcatcgtcgcctcctctcacaaaccgccgccaccgttgttgcctcctcttctcactgagccgccgccgcctcctccccacgtcgagccgccaccatcacctccccgcgctagctgccgttgtcgccttctctcatcgagccaccaccaccgccgttgacctgttgtcctcctccccatcgcctcctcgacacgtcgagcagccgcacctcctccctacgctgagctacagcagccaccattgtcctcctctctaccatggcctctttgcgcaatgcctagcctcctcatgcacgctgcaactgggttgggtggcctgcacttgctcgggtcgtgcccattgcctagccggccggcccagggacactgccgccactgcttcacaacggggatttgggttcatgaagggaagagtcgatgccaagtgctcaagcctggagggacaccaagcggtacttggatattttctaggggtaaaagggtcaatcgataatttaaaaaatcgttatctctttctttctctaattctttaccgcattaagtccaatcccactcacttccatcaaaaacaggggtaaacgcctcattcgtttgaaaaaaatagggcaaaaaataacaaccctaaaatgtaggataaaatcggtatttgacatcaaagtaggggtacaattgtactagcaaaattgtccccttctcttttctccctcggtcaaatgcaacctatatatgtcttgtaagggctactttgaaacaaagattgagggatgaataggaaaaacatagaattctgacaaaaaatcaagcgcaaaacaaagaattataaaacacataaaataatatataaaataatcatttgattggaccgtacgaaaaatgcaagaattagatgagagagataaactcataagagacttcgcgtgatattggaccttatattaaaaatactccaaaacttgtatgaatttgggcattccttagaaatttgataagactcaatagtttttaataatcctttggttcaaagaatcatataaaaaaatttctatagcaaaatttattgtttctatatagaataaaagttcttatatttttctatatttttctttcaagtaaaggggccctaattagttacttcactaaagtcgaatgagctgggttcactttaccatgcgcggcaaagccacacggtttttctagttagaacttagaactctgcatcgatcgatgtaaatgaagaggatcaattcgtactttagcaggaaaatttaacatatatagtgcgaatgatactgatgagtcagtatagtactgtattttgtacttaagcacgtaattgatcgatcgatcgcatagttttttacggctatggaggtcgaatcaaaacctaactatgcatcatacggtatatataatatatatatctatcgtcgtctactcaaaattgattgaatatcaggtcagttttgctgctgtgaaaagaagtcgatcaggaaggctggctagctgctggaagcatctgctatagtccctctggttttattttaattgacattttaaataatgatacggtctacgagatatatttttgaacttatttttctattataatatataataaataaatgcatgcttacttttattataatgctttaaaagacaaatctatatacgttgttttagttcctttaaaaataaaaattataaaagtttaacgttaaccttgtctaaaacgttaattaatatggaaccagagggagagcatatacttactactccatctgcattataatacttgtagtatgatgccggtaaactggagtgaagttccaagagaggaagtgttgcatgtcagcgtgtgtgatcgactgtgcatcagacaaatctctttgggggcgcgcgcaaacaacggccggagttaacgagatcacacccaacatcgtcgtcatcgatccctgcagccgttacagcatcaatatatgcttggaattacaccccagtttcagaaaaaaaaaacaatttttaagaatgaatctgtggatgggttcttgtttcgattcatcccaaaaactattttttttggacgaacacccaggctagctgctccaagcctccgatagcagccatctgcccgtctctctctctctctctttgatttatatatggatggtattttttatgattaaatacatattaattttatttcaactttggttaacactgtttcgtgtgaaaactttctgtatataaaagttgttttaaaaatatcaaacaaatctatttttaaaattataataattaaaacttaattggtcatgtgttaatgatttttttatatgtcctacctttatttgtattttcatggaatattttcattttcatagaagagaagagaagagtgggaacttcagtttagttttgttgggccagaaatcccagcccaacctacgggccaaccatgggccacagcgcctaagcccactggccactcttctgggccagcccacgcacgcaccttgcctttctctgtggcctgccagctctgcttcaggttttaggcaaatggtacagtttctttattattttggagcggagttagtatagctgcttcataaatttgtatggagccgagttttttctgtttcacagctccactctacctcaaaagatccactgccctttaatttttttagtgtattcacacaaaatgccactgaactacctcttgctaccctctctcctcccgttctctctcctccccatcctcctaccgacggccggcggcggcatgtagtggcggcgagcggcgggtgggtcgcagcatcggtggcaggcggtgacggcgggcggcggcatgtggtgccgagggcagcaaggagatggcatcggcggcggcgtgcgggcagcggtgttgacaggtggcagcctagctcgcaagctgatcggctgcggcttgtgggctgcccggcggcgcagcgcgcgggctgaacggcggcggcaacggcagggtgacgccaacaagatgttcgacgaaatgcgacgagggatgtggtagcgtggaactgagtaatctagctaaacactttttatactcatctcagttcttataggagttagctctcactaaaattaaagtttagatttgaaagttggagtttagaacccaccaaacgcctttatatactcgactacaagtctacgatgtttctctcttcttgaccaccgtgcgtatcctgccaattacactaagagtgtgcatttccatttccatgctaattaagtcactaacaaccaaaacaatgccgtgatttatacgctagctgattatacatgagtgtgttctcgctctgtctcaaaataaacaaatctaatacgggatataactcattctaatactataaatttaaacatacatctatcaaaatttattatattaggatacgtcgcatttcgtttgatctgagtctcaaaataaacaaatctaatacgggatataactcattctaatactataaatttaaacatacatctatcaaaatttattatattaggatacgtcgcatttcgtttgatctgaaacggagggagtacgtacgtgtgcgacattataatattcttgactctgatggcattgcattgcatgcgtaagtttggtcaagaatgagtttgcttgtctatatcaacagtgactgagaaaaatcccaagaaagaaattaagatgcatacatagacatagaacgaaacgtcgtctcctaatagtcagcaaatgacaaatccagacacggaatgagacgtaatagtcatagccatattccatccacttgtcatacacttgtgtatgtagagtagactcttagccaccaaggaaatatatatgtgtgtataggagtatgtagtactccatccgttcttttatttttttaaaaaaataaaaaggtttccaaccttcaaaatttattttaaaaaataatttatagtctcttgcttatctactatcaattgacaaatcgatcgacaatcactaaagagtgttatcccttcgatatatcttatatatctgactagttagcaatactattttttttgttagcaagggtattttgattatttcttctcactactaaatttccatgaaatggcaaaaaattaagtcttttttttgacacaatgagcatatgcgaactaattaattactcctttattctttattctaaaatataagacgcccataattttatacaagtcagcattaaactaataatatgtatgtctggtgttatgtatatgatacaaatactacaaaaattctgaagtattttccttttctaaaaaaatacctctaaaatgcatttctaatatctgtattaagctcctgtggttagttaggatggtactataagaatactgcagtctgcagaggtgctgtgaaaaccttgtagtaactttggcttacatttgcttttgctcaatccatgcatattaagtgcccaacagttaagccaagcaatctgataagcacacctatcttcttttcctagtaaaccttcaattaatctcacaggtcatacacagtaaataatgtactgcacagcccattttaaacttcagaaagaactcaatgacgcatgaatcatcttacatatatcaaacacagtagtgagcattgatgacttgattaattatctcaatatatccaaatgtcatcatcatcggcaaacaagattaggtgaaccgaagtagttggtgtaagtaaaagggagtgcatctgtttcttgactgcacactgaattaatttgtgtcctgtagtgcctgctgttctcagctctgaacctttgccaaacataaatgacgaccgtgtagaaccaaaatccaaattaatggagtataataagtacataaatgaccatatacaaatcttaggctcgaaggaaactaaggtcatacttatatggttgcaaaaatattaatgtatggaaacaaaaccgccatatgatgatgcaagggtgttttaccaggcaacaacttggaatcagaaaaccttggaaatctgctctataaatacttccatttcacatcaaactctgtgtgcaaggttgaagagaaaagtgagcttagatttgtatcaaaagagagatcattcttggttggcctgatcgatcgaagaggagaagctagccaagatgtacaaccctccggcgcagcaggacatgtcctactacgatcactgcaccaagcggcatgaggagaagggctgcctctacgcatggtcagttcatctcttcttcctcccctgatcagttgcagtaattaacctgctaaattaatatcaacattaatttttactacttactagttgtttgaatttcactatgagatgaactttatcgtgccacttcaaggcgtttgttcttgagacctggttgaaagggaattcagattctaggttctcagttctcacgtgttcttgcaagttgcatttttttgttttggaataaattcggaactgttggctaatctctgtcgaatctcctcttcctcccttgcacaatctgatattatttatttttaactcatttctacttcaactgcaaacaactcatcgatttgattagcaataaaggatcaccatatcatgagttaattagttaagcaaagcacctgcatatatcacttttggtgttaatagatacagtacctgccttgcgttcagattaatttggacaagacaagaaaatctggggccatcaaacagaaccttttgttcatgttaataatactacttaaccatgatgtgatactagcaatgatggcaagcagatggtgagtttggtgaccttgcatgaacaattaatcagtggacaggccacttaattggaagagaggatcttgttcctcaagcacaaaccatggaccactccttaatagaactcagagatgattaatactaattatttgtttgcttttatagttggttggtagtttgtgcagttgggcagaactctgcttattccagcctatcagaactgaccactcaaacatgagcctcttgttccaaagaaaaagccaagtagattatccagtcagatactaggaccaatgagcagaaaaaacagagaatttttctgaagagcatagaaacaaagcactaatttttcataatttgacaaaaaaaaattacatcacttgctgacatctgggtccctccagttcagatgatagtacatcacctgtatggagtatggaaaaatgtggcctttcttttcctggcctataaatggtatccactacttccaatcctgcaagcaacaagagaggacaggagaagaaaaccttggcccttgaatagttgtgttcttctctgaaacctttttagagaggtgagtgcttgttcatcagaagcagagagacaagatgtataacgctccaatggcacaggacatgtcctactatgaacatgtgcagaggcgccatgaggagaagggttgcctctatgcatggtgagagcaatttgtttttttttcttatgatgttcttcttgttctcctgttttggagacacaattcaagaagaggatggctggatgagtattggtcaggatgattagttagaaggatcttaaacttgttttcttgcagctgacatatctttctctctttcccctctttgatggagtattttataagattcttttttttcttggacttttgtaagcaattttttttcttttcatgcaaatttcttcagcttcttttgtctcactggttagctttgaacaaccttacaaatagcttcagatcatgaacacacttattagtgttcctttttttacttagaaaatcaccctgcttctcatgcttggcttagttgctgaaagtttgaattagagccgaactccagcagtacacatcttcagaagtcaatacacctgctgaaactacttcaactctgctacactctgtttctgatatcgtcagtttttaagtttacaaatcatgaaacttttgtgaatcttttttagcaaaatcctgatcgatctcgctaactatttctctcattctgattgcagca

SEQ ID NO: 46368 - DNA, 3862 bp, Oryza sativa
acagtcgtacagacagattcttcctactgttttgattgatccagtgacaagttgagcaggttaacctgccataccaatcagcatggaacatgcaaatggtttttcaattggagttgttgcagggtacatccactattgacagtagacatcacatgagcaggttattggttgcagtttacagagtagaagacaaagatgtctgcagactgcagccatgtggtgctgcagaacggctgcatttctgttacaacagaaagatgaatggaatgagtagtgctgatttaagcccattctggcagtttcatgctaacttctttatggattgcaactgtgttgtaaaatgaaaaggccaacatggttaaatggatgtaatgctagcccataatcttatctgctgggtagtttcaaaagaagccgatgatcacaaccttcaagaaagagttaaaacaaacagcgatcctcttaggctgtcatcggttcgcctaatgctggttataagcagtacggtttatcaacaagaaaaacgataatttgtgggtaaaaattttatatatgtgtccacataatttatttcctactgtttgacgcggtccacagatttctgaaatctgaataatctaacacagaatttccaccaacatgacagggcagagcaggaaacagtccatccaaggatgcttctttatttccaaaggccattacattcatttgataaaataacctggaggtgaaggctaataggctgtgactttgagcaaaagcttagtaatggatgcgaaaatatcgcatcaaataattcaatgtcgacaaaaggaatgagcaatggggacataaaggtcaggttacataatagagggaacaaagctaggcttaacaatgacagaattctgtgccaaaagaaagacaaaaactacagctatgagttgtcgaaacttaggatgaagatctaatctaaaaagcataatgggaccatgggtcctagttctgaagcataaacgtttgcaagaagtggtgcagcttcaagaagaagttagatcgatggcccatactctgtaatcatgctctagtgtcaaggttgctttgatgctatatcaaaattccaaggtgacgataaaaccaaagctgtttatcctcaagcagatttccactatttcaccgtgcaggacatgaggtggtgtaagtgtctctcatgcatgcgaatctcagcatcaggtatcatgtgatctagaaattcctcggcgtcgctgaaaattggagagaacaagataaaaacattttagcatagtctactcctgctacatatcaagcaaaacaatgtagagtctaaaaacaaaaaagttgtcgctgtctgtggttacaaggaaagacatgaggaccactttggggaataaggacccacgcggttgtgcactgacatatactggatgcaagaacattgcatcaactagctcaccgtaggacatggaaagcgataggtctagtaaagctttagtaataattttcctttttgtaagaatatagcatcaatgtgaagttgtggatgtctaattaagactaaaagtttcacagggaaccagttcactgacaacttcaaagtcctaggaaaccttgcaaaagaactaggactctacatatataagtaaaatggacgagttattgaaaggatcaaaggagtaatagaacttcattcttgctcaagaaaaatacctcactaagagtttcatagtgagtggtcgattaagttaagtgcataagaccataagtattagtggaagtgcagttacaaattagctattttcttaaagcggcctgcatgcaagttgtataggtcctttctttagtgaccatatctgtaaaggaggacacaatgaagtaattaacactaagctcttcatactcattagtgcacaatctaataatcagattcgattgtgcaaccaaattttactgacttgtctgctacggtcttcaatctaattcgtcataagatgctatcatgtattgtcgatttctgtttctttgagggcacttgattctgtttcttaacccagccgaagcaacagcatcaagcgacatgctccctgatactcccagcagcatgtgtttaaatctcaatcccgatatttgattgattgcctcacgtgctgtttttcaagagaaaacttttttgtgttataagataatgtcctaggagcatgatttctggcattgctaatgctgaagatgcgtcatagttgaaaataagtcatcaccaaaaactgaatgattctctagtttctttttgtatatatactgaatgatgaactacataattaagctgcatatgtaccagatatgatgttgcaaaatgctggattttacctcatgatgagaatacatgcatagatatctctaggtcatatccatatcatctcatatcatgcaactgggatatttggttcaccaaggttcacaaaagcctcagcgcgcatcatgcgtagagtgacagtatcccaagagacaagatggtcgataaagtttgtaacatacattcgcctgtcatcctgaagcatcaaaaggaagcatcaccagtgatttatgatagcttagtacttggtgaattacaattttaggtataagaagaaaaagaggatctagaaaataccttgtaatccaagtagtaagcatgctgaaacacaaaagtagatatgtcaatatttagcataatgtaatatctaaacgcagtgtcatttccttacctcccacaagtctagattgatgagtggctgcaagagaagagggcatggaatgtcatcacaaaggtttatacttgggatgctattattctaaacatttcaaaaggaaatgagaaaacatacaatatcaccaagtgcaagtggactgatggcattttgtgtatggactaccgaaaattttcgttcttttctcttcactgaaacaagcaaaagatagaccagacgtgtataaatcagactttaaaaactaaatttagattgtagaaacaacatttcaggaagtcagattgaaccaacagtgcctgtacaggctgaacttcaaagaaaatgaaaataaaaaacttacagacaagccaaacccagccagaccccaaaagtgataatgctgagcgtataaactcttccctaaaattagtaaaagagccaaaatccttctctatctgctgcaggacacctcgccctggtgacccaccaccttctggctgcattgattcccagaagaagtgatggttccatacctgtatttcagaagattgaaaattagaaccataataagcctactgctcatccttttttcaggctttcagttatgtgcaacaattaaacatgtacactgaagctatcaggatgaaaatttgatgggtacaaataaaatatccaactaatgggggaaaaaagccaaataataacaacattacctgtgctgcattattatattctggtaatgggttgccgttgttgtatgcttcttttattagttcctccagagtgtacccatagaacatgctggtagcaagctgcttattcaagctatccacatagtcttgctgatgcttaccccagtgaagttcaactgtcctcttgctaatataaggttccagggcatcctggacaccataggacaagctataagttaaaatcttttccttttaaatggcagaatgtaatctgtcgaggcaatattaacaggtgaggagaacatacaagtttatacggcggagtagtgagagcgtagtaagccacgacttttgaataccttcgagatctacagccctgcctttgttctctctgcaacaaacagaaggcgtaaagattgcaaccagcactaaacatcatagtcaagggcc

SEQ ID NO: 46369 - DNA, 23562 bp, Oryza sativa
gaaaaatgagacgtggctgacttaccgtggtgaataccaacaacatagagaaacgatcttgtctaactacaatgagattatatgacactacatagacccaccacctatacaaacctgttcttaaaaaactagggcttgaaaaattactcacaaaagctgaatatccaccataaaggatcactaacttatcaaatagtatattgatttgtaacatcacagacacacatgatctttagcggtgtcatgtttgagaccgataataatatggtacaaaagattatagtgccactcataatcaattattaatcgatttaaagtcctcaaattcgcactatcctaaaatctgcaaggaaaaaacctgcaatgccctcgaattccaaacgtctaactctttgaaatgccagtgtctcccttccccttcctatcccttttatcaaatctcaagtcacaaatcgaagaacaaggcagctcgccaaatgagaaagcttccagcgagcgcacgagcaaggggcagaaagaagaagaaggtatccatgggtttcgcgacgaggagctcaccgagcgaagccgacgaggcaccgcagccggcggcgaggggagaacgcggagagcggaggcgaaagccgccatcttttcttctcctctttcctctgccgcgctatctatccaccacctctgcaaaagaaaaaatcgaagcttttttctttttcacttcgtctctatctcatcccaggggcaatctcgtaaatttacccgagcaaaccactccagtgccactggcagttgggccccgcgagtacggacgaacaagttaaccgaataatgaatgattaggagagacgtgattagtttagtagctaatcctctgtcaaattaatcatcgtccccttttctgctcggattaatgcctaactaatctgtcatgtcaagagcgcagaggagcactccgcgtcccaaatcccaaaccggagctagggttgctgctgctgccactcgcgagcagcagcgccccctcacgctgagccgcctccggctccctcgccgccgatcctgcgcgtgcggcggcggcgggtggccggtttgaaggaggagaggaggtaacggtagatgggttcttggttttcttttgccccccgcggctatttcggtttctagtggaagctggttgcctgtggtgtaaattggggattacggattttggccgtctgattctccattttagctgtccctggatggatagatgagtttgctgtttgtagctgattcttggtgtggtgtcattccaaggactgatacttgattgtgtgctcatcttcatctagaacactgaaaacatatgtggataattgtttatgatgaatttaggatccagtgatctctccatgtttatttttagaaaaaaaataagtttctcacaggctaaagaatactgtaaatttcaggcttttggtcgtcactccttgcgcaggatgggtgggagatatctgcattctccacctgctgttaatttaatctgtgaggaatcaacttttgtgcgctcaacaagttgctgtctccactcttgtctgtgtttgagatgcaaaacatcgaatttgaagccatgtcgaacactggtgttcaatatgccatcaagggtatgttctttctccatatctgcagtacactgtgcagacaaggctaacattttagcttcagggtagatatttagtcccacaaagaataaaagaatgaagtacattgtgtgagctttagtcgcagcctgccagaatttgataactatttcactagggatacatttgtggccggagaaggactctgaactttgtagtctcatactcacagatggtgaatgttctctctttttgtacagcgcttcaatagaagagtggctgcgctgccagatgtcgatgatttcttttgggagaaggatccaactccaatcctggacacgatcgatgcacccatccatttgaaaaatctatctagtaaggtcgtcagtcatactatcttaagcatagtagcatactctctaactatgttatggctgaggaatttttgacaattcccattgaaagacaggagttaaagcaactagctggtgaagttcgatcggagatatctttcataatgtcgaggaaatgccaaccatgtaacactggacattctgttgtggagctcgctattgctatacattatgtcttcaatgccccaatggataagatattatgggatgctggtcagcatgtatgatccctctatctttttgttttgtgctaagattttgcctccagtaagctatcatataccatttcatataatcggaaatgttttaccttttgtgttcaatattttttctcatctgcagacatatgcacacaagattctcacaggaaggcgctcactctttcatactattaagcaaagaaaggggctttcaggtttcacatcccgtttcgagagcgaatatgatccctttggtgcaggacatggatgcaatagtctctccgcaggccttggtatatatagtgttgcctctgttaaatgttaatacattaattcatgccttgcacttcaagaactgcttgctttgttgttagacctctccttctatttaaatggatttccttaagatattgatttcattgtgtttggaatccgtacaatattccatagtttttttcatcttcgactccgattagcttccatgcattttatcaatagttcagctacctgaaacagagaaaaacagtgcttcttgctttttaaaccaaggtatacagtgccgggatgtacgactcaaaatataattcaagaaatataatataagttctgatgtattcaagttcatatccttctggtgtggtatcagcagtcatgatatgaaattcttaaactatcttattttgctaatggagttaataatcattatagaagtttgcatagtctattagaatcctaagtatgtttctacatttaatcatgaatctcctgatgttttattcttttatgtcaaatgatttccttttattcgtttatagcttgaaaatgatctcttgtcagggatggcagtcgcaagggatctaggtgggaggaaaaaccgaatagtaacagttataagtaactggacaactatggctggtcaggtgtatgaggcaatgggtcatgccggtttccttgattctaacatggtagtgattttaaatgacagccggcacaccttgcttcctaaagcagatagccaatcaaagatgtctattaatgccctctctagtgctctgagcaaggttcaatccagcaaaggatttagaaagtttagggaggctgcaaaggtaaaactttatgcttctgtatgacataatgtactagatttgaacttgctaataaaacatagttttttttaactgtcctgttatttcctgattatgattatagtatagacatatagtttctagttgattgtttcttttcagttctcttttttatctggtagtgacaaatgtacttgttactttcaacttattgttataaaagcctgctaattgacttgctgctgtacatattatgatgaaaaatttccaggaagttttggcatgggttgtctttctactttcttaataacaacagtcttgcactgccttgagtttcctgctttgatacgaattttgtttcctttctagggactttccaaatggtttggtaaagggatgcatgaatttgctgccaaaattgatgagtatgcccgtggtatgataggtcctcatggagcaactctttttgaagaacttggattatattatattgggcctattgatgggaataacattgatgatctcatttgtgtactcaaggaggtttctactctagattctaccggcccagtacttgtgcatgtaatcactgagaatgaaaaagactcaggtggagaatttaatagtgagattactcccgacgaggaaggtgtgcaattacaaattgtcaacgaaattttctgcaatcctatgaatatgatagcgtacattctgctttctctgttttctcattttacattctggatgtcttgctttgatattaatacagagagataagtgaagcaccacagcatgaatttgaggaaggaaacagcgcgataaggatttgtttgagtggcaatatgcatgtgaatgttgtatttgtttgaaaaatgatagaacacactactgaaatttcaaatgaaatatgtgaatcggttctcacctgtagaatcattcacaattcacaacattcaggaactttaaggtttcacatatcagttatgttaaatattacatgtataagtcaactatcctttgagatccttcctacatgtctttgcacaatcaaatcatataggatactaaaatgaatctataatttattaacttttttctctgctaacagggcctccagactcaagccaagacattctaaagtttttagaaaatggtctttctaggacatataatgattgctttgtagaatcactaatagcagaagcagagaatgacaagcatattgtggtggttcatggaggcatgggaatagatcgatcaatccaattatttcagtccagatttccggacagatttttcgatttgggtatcgccgagcaacatgctgttacgttttctgctggtttggcatgcggaggcttaaagcctttctgcataattccatccacctttctccagcgagcatatgatcaggtgccctttgctcccatctccccatgtattcctcctctctaactgtactccatatttgctctgctacatggttgaaacaatcattagtaggctttgtaagccatcttccaaattttcatgtactacaataaaatagttgaaacaagcatagtttctgtaatagtgggctatagactaaagctccacttaatctgtatggctgctttactgcaagtacttcgcatttgataaagctcacatatatgccagatagtcgaagatgtggacatgcaaaagataccagttcgctttgcaatcacaagtgcaggtctggtgggatctgaaggcccgactaactcaggaccatttgatattacattcatgtcatgcctgccaaacatgatcgtcatgtcaccatctaatgaggatgaacttattgacatggtggcaacagctgcaatggttgaggacagacccatttgcttccggtatcccaagggtgccatcgttgggactagtggcactttagcatatgggaatccacttgaggtagctctacttcaatttctttttttgattctaagcagaagtcacttggaaaatagtacagcttgaaagctatcagttacgctaatgctgggattcatgcccacctaaaagctggtgttctttggtgaactgaaaaaaacaagctggcaatacctttgtgcgcttaaacattttgcatgctgttcttattagttttggggactctctttcagattggtaaaggagagattcttgctgaggggaaagagatagcttttcttggttatggtgatgtggtccagagatgcttgatagctcgatctcttctgttcaactttggcatccaggcaactgttgctaatgcgagattttgcaagccacttgacattgatctgataagaatgttgtgccagcaacacgatttcctaatcaccgtggaagaaggaacggttggtggttttggctcacacgtctcgcaatttatttcactcgatgggttgcttgatggcaaaataaaggtaagaatttaaactcttacacggattttaactcctgttatctagtataaatccatccaatattcttgcaagttgcaatggagcttcacccttttgtattgcaatatgccacttgccttgtgctccattcatgttttgtataaatgataatttcaaacagtgactttctgttaacttgcagtggcgacccattgtactaccagacaggtacatcgaacacgcttcgctcacagagcagctcgacatggctgggttgactgctcatcacatcgcagcaaccgcactgacccttttagggcgacaccgagacgcacttttgttgatgaagtaagaaggaaaaatgagctagaaaagaatgaaaagttgtgcagcaagtttgagctggtagaagacagccaaattgctgtttcatggatattcttcagtctttcagaggaaactgagattgccatggcagatacagcctgtgtgcaccactgaaagagcttgcaagtttttatctgtgctccagatgcttactgtaatctgttcatgggggctgtacatactataaaccctgttttgatgatgattatgttaaaccctatcaagtgcttgtaacaggaaggggataatcatcttgctgatgtaaatactcgaggaataaatgtgctgtgtgtgtgtgtgtatgactccaagtgaagagagagctgtgtctaaattgtaatcgagtaacccttcagaactttggatgcagtgaatcctctctgaatgagatcataaaatgttgaaattgggtgtgaactgtgaatgaacggctaaatcaaatccttcaggctgttgacttcttcagaaaacagcaaatttatcattactgagccctctcaaactgggagcatcaactactcctgtaaaatgttgagaaaggtgtttgactttgagactgagcacacatgggcatatgacagcaatcatgaagccaattaaccaatcgagcgatgaattactgatacaacaaaatctctggcacttttatcatgcctcacacaacacagcctcggtgtacatattctgggtagtattacacaatgtggccattaggccctctattaaaaaccaaatacaccagggaggagttcagcttggctccaactatcaagcaaggttcagacatggtagccagtacacaatcttttcatcaattgaatcagatccagtcagcgttctgtaatgacagcaacaaaaaaaaggaccaggttaggttgaattcttattgttacagaaagcactgaaataaagcattgcgtggcgggtattaagatgactattagtgcccactacagtttatatgttggcatattatctgactttgaaaataaagaaagaaaaatgcataaacacattgtagtcttaggaaccaaaccttgctctattctaagtaaatcttggttgtgattgcgggaagctgcttgccagatgactcatgcaattcatatgtgaactccatatccatgagccgatgattctcttttgagcgaaccattgtgaaagaaactttaacattgtccccttcgtttactttcagaggcggagtcagcaagaataccttgaaaagaatcagagcaatagtaaatatgtgtgaattgtgccagataactatggtctatgatatgcatttccataatgacaatcaattgaaagaaattattgttttgaataaaagcccttatacataaacatgtgccattcaaataaagatattgctctttatctaagtatcagttttgcatgaaaggttttgaaatctgtttgtccttacaattaattgtaaataaaagagagactggagcttccctctttacatgatttcttctttacatatcaacactcacacattaaaaagaacaatacatacatttcaaattatggactagctggtaacaaatttctgcagttataaaatacaatagcttaattccaggaaaccaacctgctggccccagtgagtgccaccattcacatcaggagctgtgcttaactcaacttcttgagttgcagggttttgcttactaccctagaaagagttaaagagaaaatagtgagcatatctcactgaatcatgagataaattaagtgccagttcagtttgacatactcgaaaatgaacatcaaaccatccagcaagagctgctaatcttgtcatatccagcttgattggcattgtaacctgtgctcgaacttctcgaatctcatcaaccgttgctgtcaagcaatcaatttccttaataacagcagcttgccctataacttggtttggatgaagattattccatatggcagactgcagaagaatacaaccaaatgtacactgagcttgcaggaaaatgtgcattcactactatttttgctgagaccttaggaacaaccagaacaagtaatccagagatactaatggatcctatattacatacagaataaaataagtaatgaactatactaatcaaatatgtgctgcaagcaccttggtatttatcttatcatgaatggattcttgcttaacaagtatatttataagattgtttaaattgcatttttcttgcagacagcacatgcaatacaaaagattaaatcaaacatgccagtctttgtacagattcaggcataccttaagatagtatttttcatgttctgcacggtatgcctttgtcaaaacattcatgttgaccccataataagactcggtatcctcaacaaatagattccagtcatgcatagcaatctcaagatcttccatcttattttcagccagatcactccttattggtgctagccacatccgagcatgactgggatacctgcaaccaaaattgattttacattggctgaaagtgaaacagatatttcattgaaccaacaacagaattgagaggttattgccatcttccagaaaaatgacaagaccgtatttgctaatgtaatcaaagatattggataactaactaactaactaccacggtttgctttccagagaatgaagagtgtgtgcaacattcaaaaattctgtctatattagcatgaatagaagtataaatagacttacattacaccgtctggcttcaaccaacgatcacgcgcacaaatgacagaatcaaacatcgattccctcaatagaaagtagcccatccactccgatataatgacatcaactgccgttccaaagatatacagaaacaaagcaatcaatactcaacacacattatggtaacctcttgtttccattaaattctttataacttttcctctccttaggaaacaaattcttaagctatgtttcgttcgcaagagatcgaatataattaccaccagccacatcaattcccccttattttcagagactaataacaaccaatcgaggaataaaaaaaaagagagaatcacctttctctggcaacacaacgtcctccatggacccctgtatcacctcgacgatgtcggcgacgtcgttagcccgcgcgagctcgcgcgcgtgctccgccatattggtggcctccacggcgtacaccttcctggcgccagcctgcgcgctccagatggcgaggatgccactcccggtacccacatcaagaaccacctgacaaagacagatccaccaaaatccatcaacacagagccccaaaatcgcaccgaagatatcaaacccaaccgaccttgccgcggaagtggtgggcgttgcggaagacggcggagtggtaggcgtccatccggacgcggtcgcagagcatctccttctggtggtagaggtaggagtaggtgcagaagtagttggcgaagtccacctccttgtcgaccaccgccgggcctccgccggcggcggaggcggaggcggaggcggcgccgttggggagggacgccatgggaggagaggaggagaaagacgaggtttttggtggggaagaggaggacggggttgggttgctagggtttatgggggtgggatttttaaagggtggctatcgtgtgtttccgccgttggattgtgctttgaatttcgtgctccaagttgatggtggtggtgttaccatttgaacttttgaagatagatactgcagacagtaaaacctgagaaaatttgtaaattttagattgttgtcgataactttatatatattaaatttggacagagacgtattctttaaattatgtgagatagtaaaggacagtagcaatgcaagacacgcacttctcgggtctcacttgctagctaggcctaaaactctataaggacatgagttttcacatagccatgtgatttaggagcgggggcgaccacgaccgtgaaggcatgatgtgataaggatatgacctccacaatgcaccctcacaattctcttcctgcatgtcacacgccatcgtttcgccacgggagaacgagtgtcctattttggcttcgcgttcttcaccgggggacaacagaggccgatatggcgtgaaatattacgagccggatgccacgtagatatgcagtgaagatcctaggtaaaagaagtgttatttatatacataaataaccaatcatacttaaaaaaaagttaaacaaatgaacacaatttgttcaactttaagttactctacacgtaattgtcgatcctttttgtttttttcttttgcaattatcttattttattttttttcttttagaaacaagctagtatatctatatcactatatgaatataagtcacttagtcacgtgtaactggaattatttttcatatcaatagtacatgcctatcgtcgaataattaaagaaaatcttaagacccaatcattgtggtatctaaaataaataaataaaaacgagatatatgcacaatcaattttgtttggttcaccaaaccatactaataacgatctatccatcgaaaccactatcatttggtaataataactttaaaataaacaagtcaaactaaccaaaccgtggttgcatttaaacaatcatctcactgttctaacacactttgtttacgaatttcgttgcaaaatttgttaaatttttacacccaagtggattgttctgatttccgtgggccgacaaaaccaccccaaattggcccgaaagctgcctcctttttcctcctcctaaccaccgctccggcctctccatctcccgccgctcgccgtcgccgccgccgcccgccatgtggaagcgcgcgacctccgtcctcctccaccaccgctccgccctcacccgccgctccccggcgatcggcggcggcgtccttccccgtgctctcttcttctccacgctcggtaacattccctcccgaactccggcccgatcccggcaggtggtgaggcggcgatttgacggggcggtctgtctgtctgtctgtctctgtcccgcgcagatgcggcgcaggcgaggacgagggtggaggacgtgatgccgatcgccaccgggctcgagcgcgaggagatcgccgccgagctccaggtcaaccacctctcctcttgatattgatttattagtggaagtttttttttttttactagatggaaggtctgaatttttttttcatttcaggggaagaagaggtttgatatggacgcgcccgtcgggccctttggtaccaaggtgagatgagaggctgagagctttccatttcacatcaattccatggatgttttgacccgtgtatttgagagctattgaattgattggttagatggagtgtgtgattgctgactgaattaatgctgatgtgtagtgcttaagacttgtggccatggatgcaacgctctcttaatagcttgacatgttcccctctgatattaggtgataagcttctttggctcaacggaatcggcgaagagataggtgttagtttctgatgttgcagatgcagcagctgggtcacggcagggattttgttcactgaatatgaatatgtgagattgtagcattggttcagctaccagttcttttccctacataggaaagatttttatgcacaaacattaggcaaaagttcaacacacatacgtttaataaagtcattacaacataggtaattctgtttatgtttacactgatctgtgatttgtatttttgtgggctggtcattggcaaccgaagtttttgccttgctgtatggtgtgtgcattccagcttatgttatttgctatgtgttggcttttcgtatggtcacatcttttgctattctgtacatcttatgtgttgacttttcgtatagtcctgttgataggaaaaacttgcataaatagctgttttgttcacttgtcagatgtgcttgcttaagaaaggttgggctgtgttgcctgactcctgttgtgttaacaaagaggattttgtttgtctttgttttcattataactttagtagagcattttttttcagcatgttaaaataattttggggattttgtaggctataacattctgaatttccatgcataattatgggggcctgtcttatatctagtacttggaggcatcttgattttgcttttctttagagaattgttgattagcaatttcatgttaagactttcctttacatgctcatagaaatatattttcacttggaaaaccctgctactatatcttgtgagtttattctctgattctgtccatgtggatccggctaatatggaggtttctagttgaaccagcaatgttggaccttttagttattggttgctcaataatagtacatttgatcatgaagttgaatttgcaatttctatgttgtctatctccaggaaataaaataagtgcagtgttttgaaaattcttcgctttcccatatatctctagtctctaaggcagattgccccctagttgtggtgatcgatacatgtacggatgttatacaatttatttatttattcagtggtttcttttgttttatcacccctattttcctacaaattgtttttctcatgacatttcccctcagacttgcattaggtgtgatctgataaggttatcagcacattaatgggcatcattttcattctgttttggcctgttgatgaatggtactactctttagcgtgttgcatctaaccttgatttggtccctttgtaccttttgtgtcactgttcagtttagttcattccactcctgcgtgatcgaactggactaatattttttccatgttgtataggaagctccagctgttattcagtcatactacaacaaaaggattgttggttgtcccggtggtgaaggaggtatagtacctgtgcatgctaatttccttgtttttgacctataaagaagcttctaggatgaaatcttctcctgcatcttctctataaatattcatcgactaaccaccaatggaattaacttaaactgcaaattgcaatgattgatattttcagaggacgagcatgatgtcgtgtggttttggttggagaaaggcaagccacatgaatgccctgtctgcactcagtatttctcggtatgttggtactttctgttgacaaaatcgcttgccttgtgagagcaatttctgcatgagccactaaatcgcgcatatgttggtatgttgtcctgatgttcgctgagctatcaacttgcaactttatgttcacagcttgaggtgataggagaaggaggagatcctgatgggcatgacgatgacgacgatcaccaccatcattaaggttgcagaagtcacctctagcaataaaaacactggatatggccatatccatgtcaactctcaattcagatgacttggagcagcagtggattttggaaaaacaaagtttgtctttttagagatttgttcatgcaaataacaggattcagtaaacaatgatatgcaattctctttttcagcacaccttagtcgaattcaaaataggtatgtttgtttgtttgtcttgatggatgattccatgttcaatggccacctggaccatttattttggtgtatgatctgttatctgaacatttcacaaaccttggtcctgttcaattcagtttaaacaaatgaagtcagcattctgatgatccttctccctcctatccagttcagttatctttgattataaccaagcagttggatgaaacagtcaattgcttttgtaatttctttatatgatccttaatttcctactgcttacgtggtcaatttgttgctttgatgagtgagacagtgatgcattcaaacttggatttggccaaaccagcaccacacacttcaccactcactgatgtcattcacgtgaggatgcattcaaccaaagtgttaactttaccacacaaaataccgaaaattttggacggattcggcgtgacagaattccaatttgcactgcatttaatccactttattgatttgaaccattcctgatctccacacctacatatcttttcccttcatttttttttgatcaggtcagctccttactactgcaagataattagataaatccaatagtgatgcactaggcacaaacattagttgaaatgtagctatcactcttaagatttcagtgtgttttctcacatgtattaattgctaacccatcatgtcaaaatccgaaattaactcgcgtccaaagtgagcaaagaactgaccatggcgggcggcgtcgccggcgacggcgagccggtgacggcgtgacgtcacgtggccgagatatggagagcaagacggccaagatcgtcgccggcgcggccgccgccgtgctgctggtcctcgagctcgctctctacctccgcttccggctgtcgcggccgttcttcctctccaccgccgtcatcgtctccgccgcgctgtcggcggccgccgcggcgctgctgcaccacgcggcgggcgagcggaggcgggcggcgcgcatggcgaggcggctgccgtcgatggaggacgagcggatccgcgtggagtacagctacttccgcaaggtcgccgggctgccgcgcaagctcacgctcgagtcgctggcggcggcgacggacgggttccagtacgccgtcgggcggggctcgtcggggacggtgtacaagggcatcctcgacgacggcacggcggtggcggtgaagcggatcgacggcggcgccgaccacgccgataaggagttcaagtcggaggtgtcggcgatcgccagcgcgcagcacgcccacctcgtccgcctcgtcggcttctgcctcgtcccgcgcgggccgcgcttcctcgtctacgagtacatggagcacggctcccttgacaggtggatcttctccccgcactccggcgatcgccgccgccggaggtacctgccgtgggcggcgcggtaccaggtcgccgtcgacgtggcgagggcgctcgcctacctgcacccatgactgccgcagcaaggtgctccacctcgacgtcaaaccggagaacattcttctcgacgacggcttccgcggcgtcctctccgacttcgggctgtccaagctggtggggaaggagcagagccgcgtcgtcaccacggtgcgcggcacgacggggtacctcgcgccggagtggctgctcggcgtcggcatcaccgagaagtccgacgtgtacagctacggtctcgttctgctcgagatggtcggcggccgccgcaacctgatgcaggcggagaatggcgacgacgggtcgtcggcgtcgccgcggtggacgtacttcccgaagatcgccggagacatggcgagggaagggagggtgatggaggtgctggacaggcgggtggtggagtccggcgaggcggtggaggaggcggcggtgcggaggctggtccacgtggcgctgtggtgcgcgcaggagaaggcgggggcgcgccccaccatggcgcgcgtggtggagatgctcgaggggcgtggcgccgccgcggaggccgtggaggcgccgccgccgtcggacatgatcgtcgtcgacctcctcgcgctcgacccggcggcgcgcggccccggcccgttcggcctgccgccgccggcggcggccagcgacggcgggatgcaggtgacgtcgtcggggatcagcaactcgttcgcgctctcctacctgtcgggacgatgacctcacgctctccgcacggtggctcgccggaggagtgacgtcactccggcgacgaggtttctccgagccccagttgggttcacgtgaaccgttggatgaagcacgtgcggacgagatggtggtcgtgtggggttcggagaaaaattctccgaacccgtgttgggttcacgtgaaccgtcggatggagatcgtgcggtcaataatcaaacggacgtgagtccagcaacactatacttgggatttgattgattatcttctggttccacagctaattagggtttagatcgatggcgatttgatgatcgtctgattcaaagtttatttctttcgaaatagaggtacaaactgaaggattatttgtttttttttgcaaaacacaatttgtgtgtttaaggattgttttgctttgtggtgacattgttcaatttgttcattcatgctatgttcgttcgcgagacaggggagattgagtctcgtttttcgcgcgcacgcttttcaaactactaaacgatgtattttttgtaaaaaaattctataggaaagttgctttaaaaaatcatattaatccatttttaaaatttaaaatagttaatactcaattaatcatgagctaatggctcacctcgttttacgtatctttccaatctctctaatctcctactcctcaaacacaccctcaatggtccaagcatagatcgaactgatactctgatagagagcatgcttggttgaaggcccggaaaaattatactccctacttccccaattataaggtattgcactgtttgattattcgtcttattaaaaaaattaaaattattatttattttatctgtgacttattttattatccaaagtactttaagcataacttttcgttttctatatttgcacaatttttttaataagatgagtggtcaaacagtgtaggtaaaatgtcaaaatcccttatattgtgggacagagggagtactcatttcctcgcatttaatttgatcagagctcattgtcagcttcctcatctaaacattgttttcatattctgaacttcatttttttttctttttgtaattcgaaatctctttgaaacctctgtatgtttgtactcttctgtcagacctgcgactattgaaaaaccttcgtcctaaaataaacttttatatttttgggtgaaggtagtcatttcaaaattgtcttatattttcgagtggattaaaaaatgatgaaggtaacagtagcagccctagattcacttactcaacccatcgcagtcgctgacggtggggcttagactccgtgtaacaaaggaggaaacaaaccccttcggcttaccgatgacgacgacagctccccccttgactgatttgaagcctggtcacatttcagccatgtcgaccaccaccacagttcctttaccgctctaggctggcgtccacggcaatgagtgcgtggaacaggttttcatggtgttcgatttggcacgggcaacaacgttgggctctttctacaatgaagatgatggccttctctttgacctcatctacgcccgtccaaccgtcgtcatgagcacctcccatcccaggggacaatagtgtcgctggaagcgatttggtaggatcaggatctgagcgagacctctctctcatcatgttgttggcatcttgggcatcgcctatctctcccatcaaccggatgcatgagtagaaggagaccaataccttctcttcctgccgccaggagcagttccatcaccgtcgcactctgtctccttgatccggtaaaataggggttgggtgtcgatagcgggaacagttgattatggtgcggtacaaatttccatataatatatattttaaaaaaagataccattcaacaattcaaaatagtatgctcatggagagcgataaaagaagtagctaatccaaaagagacaaatctaatgaagcctaagagcaagtttaatagcatagctaactactagctccaaatcatttatatccaatctaataatttattcatacaatagttatctataaatatatattataccattaatgactgatcctaccctctcatacacagacaacatcttaaaatccatgctatagctggctagaaatctcacttttcttcactctcttctcttacctttttcacatattcttataaagttatagctggtttatagcatactattatacacaggggcggatctacagtatatgggccggtgccagacgacaccgacgacttttgacaaaagctatagcaaaactgcttatccatatattataacatcatgatctaagcataactagcatactatgacaccgatatatatgttatgacaccaatgaattgattttctagacctgccactgattatacatgctcagtcagaaaaatgtgcttcatgatcacggtttaaaccggttgtcacactactgaatcggtgatcataaagcctataaaccggctcagtgaccggttcttttttcccaatgtctcactcacggtgggcccacctttcactcctccaatgggcgtatggatgagcatggcatccagatccaagagaaaaaaaaaaaaagcaaaacaatcccgtagcttccatttccatggccacaaaaaccggcgacctcctccaccccgccatggcctgacgcccccgagaagctgctgcggcgggaggcgatggcgacgaggggaggaggcggaggaggaggagggaaggaggcgaaggggaaggtgatgggcccgctgttcccgcggctccacgtcaacgacgcggccaagggcggaggcccgcgggcgccgccccggaacaagatggcgctctacgagcagttcaccgtgccctcgcatcgcttcagcggcggaggaggcggcggcggagtaggaggcagccccgcgcactcgacgtcggcggcgagccagagccagagccagagccaggtgactcgacgtcctgcccgtatgatcgattcgattgggggtagtgtgtgcgactgctaaattggtactagtaggcgacaattctgtgcaaatggagctaaacgccttgcaaatcgaatcgaattagaagcctaaattggtaggcaataattctgtgcaatggagctaaacttccttgcaaatcgaatagaactaaaagctgggaagataatttcgaggcacaaatggtgccctcgacgtcgacgagctaggtcagagggggcgtttcacgccttaccctttgtagttatctcggttgggatagatgaattgatgggcgaatttagtgcaacggagctaaacacatggaaaaattggataagattaaggccgagaagcccagtttgaggcacaaatgccatgttccttttgtgctgattaatctatcatgccgtcgacatgtgattcaattacttgcaaatatagtcatacaattgtggtaggagtaacatgcttgcacgttgtcatagtgtcattattgatctttctccgtgctgataactcacttgtgttgaaggcgaaagagcagaacaaaaccattatatgcagtttacatcagctcttccggtaaagttttggagacggggcataagttccttgcaaacaatatcggatattatagcttattgcaaattgtatatggccagatatgctatgattgtgtttgctgaggtctggtgtttgtaatatacaaacaaaaaggtccacatgtgaaactgcatgtagcgcaggtggcaaagagtagccgtagtgctgctcaacgtactgtgttctattctccctgacgtgctcaccttccttaaatcattgacactaggttcctccttagtgtcttgcatttttgcctgccgaaaaaaaaaggtccacgtgaaagggaatgataaaaatggtggttgatatgctttgattgtcaggcacacgttcaacctgtatgtgataaatatcaacggttttctaatactgttttcagcaaggatttaggagtggaaaatattctttagaacaaatctgcaatagcctcccacaacacatccaactaccttttgataatgggatagttatagacatgaagtgcgaatggcaaaagtccaagtcatagatttccaaatgaagaaatgtgaacaaaataagaaagaaagaagtccatttgcagtattatgtctcttttgcccttctttgggtcgaaaataaaataaaaaatcgagatcttaccatgagatacttaatctcccaccactttttctaattcaacatggaagttcttggatagtttaaatacgcttcctaccaattagcgtggaatcctcgcaatttttcactaaatctagtagtactgaaatggattttattttcttccaggtttatggacgtgacagttctctgttccagccgttcaatgtgccttccaatcgacctggccattctactgaaaagatcaattcagataagatcaacaagaagattagtggttcaagaaaagaactggggatgttatcctctcagactaagggcatggatatttatgcttcaagatcaactgctgaggcaccacaaagaagagcagaaaatacaataaagagttcttcgggaaagagattggccgatgatgatgaatttatggttccttctgtcttcaattccagatttcctcaatatagtactcaagagaatgcaggggttcaagaccaatcaacaccccttgttgctgcaaatccacacaaaagcccttcaacagtgtccaaatcatccacaaagtgttataacactgttagcaagaaattggagagaatccatgtttctgatgtgaaatcaaggacccctttgaaagacaaggagatggaagcagcacagacatccaaaaacgtggaagttgaaaaaagttcatcctttcatgcttccaaagatatgtttgaaagcaggcatgctaaagtatatcctaagatggataagacgggcattataaatgattctgatgagccacatggtggaaatagtgggcatcaagcgacaagcagaaatggaggttccatgaaatttcagaaccctccaatgagaagaaatgaaatttcctctaatccatcttctgaaaatactgataggcattataatttaccgcaaggaggcatagaggaaacaggtacaaagagaaaaaggttgctagaacaacacgatgcagagaaaagtgatgatgtgtcaaggttgctagaacaacacgatgcagagaacattgatgatgtgtctgattcctcggtggagtgtataactggttgggagatttctccagataaaattgttggagccattggtacaaagcatttctggaaagcaagacgtgctattatgaagtaagtaaaactatccttttgagcttagtttggcccactcaaactagacttgtttgcagctctaattacgtataggtagctttgatgaataaaatttgttttgtttcccttgctttactgttatttgctcttaatttgcggttgatcttaatcatcttagacagaaaaacatgatgactatctcgtttgtttttggtttatttcatatttgaatgccaatagatgtcagctccagatgatatttcaaatacctcatgcatggaaactgtgcatacttatgccaaattttgggcttacaagtcagcatgtctacaaatttctttggcagaattaatatatatctagttcaacatttgctgattgtaattggattagttgtctgcagaatgccggcatgttttattttcctttcaactaggtcaatcagttttgttgttgtctgttgttcttgtccacctacacctgtactactgaaatgttctcttttggagatgtcaatgaaaattttaatctatagtggtttcaattttattttcattttagtcaagaagaatggcataatctcatttaaaaagattgtaaaagtgtccctgttaaagtgatattgtaggtattgctttaccaagctactgtatgattccctttattgttttacactctaatcttctttaaactctatgcagtcaacagagggtgtttgctgtccaggtttttgagctgcataagttggtaaaagtgagtctagcaaatttctcttccttctagccactcttaagcaggttaattcgtggataggattttgtccataatctgtttataacccacacttgtatttgacttacaatcaggtgcagaagttgattgcagcatcgccacatgtacttattgaaagtgatccttgccttggcaatgccttgttgggtagcaagaacaagctggtggaagaaaacctgaaagcacaacctcttttagtcgcaaccatcgatgacgtggagccaagtctacagcaaccggaggtatcaaaagaaaacactgaagacagcccaccctcccctcatgatactgggcttggcagtggtcaacgtgatcaagctgcaacaaatggcgtctctaaaagcaatcgtcgagctacacctgttgcttctgataacaaacaaaataactggggcgttcaacttcaaccacctcaaaatcaatggcttgtccctgtcatgtctcctttggaaggccttgtctataagccttattctggtccgtgccctccagctggtagcatattggccccgttttatgccaactgtactcctttgagtcttccatcaacagctggagatttcatgaactcggcatacggtgttcctatgcctcatcagccacaacatatgggtgctcctggccctccttccatgcctatgaactacttcccgcctttcagcataccagtgatgaacccaactgcaccggcacctgtagtcgaacaagggagacatccttcgatgccacagccttatgggaactttgagcagcagtcgtggatctcatgtaacatgtcacatccaagtggcatttggagatttcatgcctcaagagatagcgaggcacaggccagcagcgctagcagtccttttgacaggttccaatgcagtggaagtggtcctgtatccgccttccccacagtatcagctcagaacaaccagcctcagccctcatatagcagccgggacaaccagaccaatgttatcaaggttgttccacataattcacgaactgcttcagagtcagcagcacggattttccggtcaatacaaatggaacggcaacgagatgattgatagccatgagaactggcaattttatgctggatgcatttgatgacttggtaaatgtagagaagaggtttgccagattatggtgacccctatatttatcctgaccgtttatagacagatgatgatactgtatattctcaagggcgggctccgtcagggtgatgtcgccccttcgtcaatttgtaatgtattttgtacagtaggacaggacagtatctgtttaactttaacgctatgtaaagccattgctggtcagttaagcagaataatactaaagctaatgagctggggaaaagaccccgctctttttatctctttcttttgtgaaccctgattacgagttaaggccccgcgccatttgtggggatttgctcttataagtgtgtgatctatattgcaaacagaatggagatatatgatttttggatatatgtaatgtgtgccagtattttactgatgaaaccatctatgaatgaattgaccctgaaatggagtagcacgttttcagttgtgagttgagttctgaacatgccgtaaggatttgtgtgagatctataggagaaaatttctttacagatggagataatctatatatgatcg

SEQ ID NO: 46370 - DNA, 20612 bp, Oryza sativa
aggatgaagggcgacacagaagataatagagtttagaattgagaatttacagagaaaaaaaaattagagttgtcaaaacggaataatttacaacaagactatagacccccccaggcaacttaattactatatcatattctgaatactttatgccatctgaaacctgtttgaaagatatcaatgtatgctttactctactgttacacttgagactactaaaatcattgctggcaaagctaagtaatagccattttgagatagcaaacctgagaattgacagctagaacagtcacgaaaaccacataggaatagtttataacaagaacaaacacctttgcaactcgtctgcagacaatgcaactctgaatatctgcaaacagtctagactgtaaacatcacctcaaagtttcaacttctagagactgcatgtccggcgtccagaacacagcggaagatgggttgccagatggaggagcttctgaactgtcgacgaaaacctccgtcacgttgtactccgatgaaaccagaagatccctccacgcaattcttacagctttcaacatgtcggtcacctccgccatggatggcctctccttccccttggcgctcagacacatactccccaccttggcgacctcctggagcaggggcagcgcctccatgctggcaccagccaagcttgtgtccaagatgttctccaccctctcctccatcgcccgcaggaacgatcctgcgaggctctcgaagtcgccatcgccatcgtggcggtagatcgccttcttcccagtgatcagctccagcagcacgacgccgaagctgtacacgtcgctcttctccgtcagcttcctctcctgcaggtactccggatccaggtaccctcgggttccctgcaccatcgcaatttgctcgacagcttcattggacagccaccgtgatgccccgaagtcggtcaccttcaccgtgtagctatcatcgagcataatgttcagagactccacgtcgccatggatgataggccggttcgtcgacaggtgcaggtatgccaatgcttcagctgattcttgagcaatcctaagacgaagtttcagtgaagcataccgcctgctatcgccatggatcaggtaggagagagtgccattggagatgaactcgtagaccagtatgggcacttcaacttccaggcagcagccgatgagcctgaccacgttccggtggttgatctgcgagagcatgatgatctcctgcacgaattcctcggcgtctgtcacgtggaggaagttggagcgcttcacggcgacgacattgttgtccctgagaatgcccttgtagacaatgccatgaccaccggcgccaagcttttgtccgctgtcgaagttgttggtcgcattctttagtacctcttctgtgaatatttccactgtattgacttgccctgagataattttctggtataatatgtggccaccgttctgatcgtagaacctctgcttctctttttccagcttcattctctgaatcttgatcagcagagtggagatacagatgatgaggaagatgatgctgatgcaaatacctggaaatggatgattacctatcataagctcgactagccccattatgacagacttgttgtttccgtttgttggaatggaattggttaggttgaatagaaacggataagtagaaaatttcagaaacaaaacaacctgttattttttgctaagaaaacaacatatatagtcgaaaaaaaaactgtatggtttgcatctcaattcgctgtaaatatgaacagttagagaaaaagttttggcagctgaaaaatgtagcgtgaaaaacatattaccaatgaccagcttcacttgtgggacgcattccttgttctttggatcatcgctgtgagttcctagtgggcacttacagtcgtagctcccatcggtgttagtgcagatgcccttgcaagaattcgggaatcttgtggcgttgcactcattgatgtctgcaatattaacaactgaacaaagtgaggaatcaataataataacttcatatgaatccatggagaacagcaactcgcatatatagggtgcatatataattaatttagcttgctctgtgtgtgtttgagagagagtgatcaaatttatttgttggagtccttttgaacaaatttatcccctccatctcataaaaagacccaattctaaccatgaacctgaacacatgcgtatgaattaattctgacctcggcagccgtctttgaggtagggatttccctcgtaaccttgggtgcagttgcatctgtacccgggcgcctctatcacatcgatgcatttgctgttattggcaacgcaagcatacgactccttcagggctgcttccttgcaggtttcattaccagcaatccactggagaattataggaatcccacgagcgagctcctccatgaaattgtctgctttggcataggaactcttgaacttgaattgatccttctcgaccacgaacgcatagctgcgtgaactaaaattaagaacttttttggttgtgttataattatagaatcctaaactgaacctcctaaggttggttgaaatggggacttggcaacaacccatgccggagcactctgggccgtcttcgatgctaccctcgtcgaagcagaacgatccacataagctggtgaactgatcaaactgtccattgctaccatttttgtctctgccgtagatgaatgcaacagttgaacacccgattgctgtgaatctgttcttggcgctggaaaccatatggtgattaccaagtcgtaatcctcctctggacgtccatgcaattggatcaaattcattgttgtacttccatgctaccgtccctgatggtatatcggtcaggatgcgagcctcactctggactacatcaaaattcgtgaccctaatgtccggtctgataaaggtatagtacaggaaaaccgttagtacaggagtagttaattattttaaacttgaaaatgaatttatctgatattttaaagtaatttttagtttccgcatgaaattcaccgtttaacaatttgaaagaacgtgctaacagaaatcaagataaaatatttattttaatcagaaaatctgacccaatataagcttgttcttgcttgcatgagatattaaagccgcccttcggtcggaagcaaccttctcttatgccaaacgggtagggaatgttgacgttgccgcacttcgctggagctggacaatcgggctggggctgccagatacttccagacccagccctagccccgtcagatgcaccactatgctgtagtatcagcagcatcaggctggttgccacaagtactaaggctcccatcggatggcctaatcagtaaaagaaaaagccaaaatttaaatttttgattttgtgatattttcaatatagtttctttttcaacattgatttttaagccaccaagaacatctatataaaagttttacctataaatttatttttattccataaaaaaccaaacgatggggacctaacttcttacccaggtaatgagcaaagaggtttagagcaagtttaatagtactagattcaaatcatctatagttaatttaacagtcaatttatacaatagttgtttataaatatgtaccacactagtaatacctggtcccacttatcagacaaacattgtgtcttgtatttgtgctgcagctggctacaaatttgttcttctcgatgtgtgtttatagttggtttatagtatgctattgtgcctgctcttacaataccgtcgtaaccatatttgtcggtgacatgggatcaggagtatcatgactagaggtttgaggcagacacaatcgcacacgtagcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtgggactcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcatccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgttagtagacagccacgattccacgtcgcacctgctcccggcgaaagtggaggtagttgtgggccgtctcatcagaaggtgactcggacggcaactatacaaatctccgtccatttatgaaaaaggggggggggtaagtccccacaaaaaaagagagaaatggtgcatgtggtatccccttaagatataaaaggaggaccttgtccactgagaggggggactagacttttccagattagaaacccagaacaagggagaggctggctgatactttgtagctccttcatacacagatctcccaaaacacaggagtagggtattacgcttctcagcggcccgaacctgtatacatcacccgtgtcttgtgtgtttcctgtctcgcgagccttccacatatagagagcttagaatctctccctgagtccccggccgaaccggcaaaggggggcctgcgcggtctcccggtgaggagccccacgctccgtcatctggcgcgccaggtagggggctctgcgagggattttttgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccaggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcataaggaggaggcatggacttagaacccctccggttccggtgtggcagcttcggccgcccccggatccgccgctcagatagggcggcgtgacaggaggaggaagaagaggtcagcccataccgatgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgatctcgcggactgccgtgcagtcaaaagtttggctgaacggacgaggaagtgggaggaggagaggaggcaggagcgccgagagggcaaatccccggcggttccttccggtaatcggcgaagtgaggccaagcagaaggcctccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtgaccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcacgctcgcttgtctggagcagcgcgcggaccacctcgccgctgcatccaagcccgagggtggcgacgagaggcttggcgcttccgcccccgccaccccgaggcaacggatgatcacaggcgatgaggtcccggtcaaggaggttgccctgggcgacggcccgtccaagaccacacggatcggtggtcttctggatggcaaataggaagacgcgctcgtctccttcctgcgggcaaacgctgacgtcttcgcatggagaccggcggatatgcccggggtccctagggaggtgattgagcaccgtctcgccgtgcggccgggcgcaaggccggtccggcagaaagtgcggcggcaggccccgaaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcggggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccctgaggtcatcagcacagaagataagtgcgccccgcaaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgtatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactctcagctggtcgttaaccaagtctgtaaggagtaccggtgctctgacccgcagatggacgcctacgtgcgccaagtacggcgtatggagcgccattttggcgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggactgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctagccacgggcgacggcactgagctgcctaacccgtggaacatcgaacaccttcgtcgcttctacccctgaggggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctggggactcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggtttcgacctccccggcggacgagtccagcacgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgcttcccggatggtgacggcggccttgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggtggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacatgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcttcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggcttccccggcctggcgggcccgggcggcctcctcccgagcggtttcctcggcctggcgagcccgggcggcctcctgggcggtctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcacggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaagcgccccgagcgcgtcgctggagcggcgcaatccgacaacggaggtagtcgccgtacaccatggcccctgtgagcccctgggatcgtaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccatggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcataggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgtgtgtggcgaaggtagggcacatgaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtgggtatgcggttgtggcagtcgagatagatcatatcgtgcgtagatcatatcgtgtgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgagggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtgggactcacctaaccacatttattgcggtttggctgagcgtgtcacgccgcatgtaacgcagtgcagtgcactcgtttatccggtctgtgaccagtcacagaccggtcagatcgcgggttaggtggcgacagacgatctgacgcacgcatcgccccatcccgtcaggacgagggcttctaggcgctcatccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagtagacagccacgattccacgtcgcacctgctcccggcgaaagtggaggtagttgtgggccgtctcatcagaaggtgactcggacggcaattatacaaatctccgtccatttatgaaaaagggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggtaaaggggggcctgcgcggtctcccggtgaggagccccacgctccgtcaatattagtttctgaaacctcgtgtttttcttggtaaccgtgtggttatcgccgggtagcgataaactcctaccagaactttaaggaaaacccttcattaccaatattctatcgataatgcttgaaatcgttccaaggcaaaagatttgcctcatttcgttgacagacaagataaaacaacaccaatccaaaataacggcaaattatcatacaccagggccggaccttcaattttatggattctctttgttcttcgttaaacaccaaaaacatactacctccgtccctaaatatttaacgtcgttgactttttaaaacatgtttgaccgttcgttttattcaaaaacttttgtgaaatatataaaactatatatatatatatatatatatatataagtatattcaacaatgaatcaaatgatagaaaaaaaattaataattatttaaattttttgaataagatgaacggtcaaacatgttttaaaaagtcaacggcgtcaaatatttatggtcagagggagtatatactatcctcgcaaagtaaatttgcatgtcaaaggaacggatacaacgtccaaaaaaaagactttttgagttaattcttctaccatatgcacgtaacattcctatatatttgaacctctaaacatctcaactttacaaaatacttgagcatgcaagaattaactatgagcctgtatagtaaggtatgagagcttctgacctgaaagtaaagagcaagccatgtattatgctacgtactttccctgtccctcagatactcctgtgaccatacgatgaatacctcctatacatagagacatcgaacatgctgataagctgcctttttattcgtttgcaccaagcaacaacaatatcgtcctgaaagtttctgcatcagaaaagacttgactagtgcgggtcatcgtctttgtatcgaactggagtaataattagtctgaacaaaaacatcgctttatagtcgtacattcttttcaaaataaatacagatattcaaatttaaactaaaggctgcacttattttagaatagagagagcactaagtaggtggtgtctgaaactgatgaaaataaagattaagttagagtatgtgaaataagaaagctattagcatatgtatgattaaataaattataattattacaaacttgacaaatggatatatgtgatattttaaagcaacttttatatagaatgttttcgcacagacgacggaacgcaccgtttattagtttaaaaaacgtattaacgggaaaacgaggtaaaatctagatatttgtgactgactggtcgaattattaccacggattatttacacgccttgaattgcaaccacgagttggagctgaagctgaaggctcaagtacggccggcatctttgccagcctgcccgatagccggccgattgtcggagtagcttctatcgctgtctgtctatcggcctttgaacggctcaaggaaatagacatctgacagtaatagcatgggccacacgtctaacagcgatccccgttctaggcccaactgatatatgggcttccattaggcccgcagtaaattggcccaacaacgacggcccacgttaaacctcggaatctttacggcccaactttgtttgggccgtatgttcaccacgatatacgggaaggaacactggccgtagttttggcccaacaaaccgtactacagtttctccatcgtacagtattatctgactgttcagcagtacggcagctgacatgtggggcccacgtgtcagtcacagatggtcggttgggtcggcaaaccgccagtctgcaacggccaagctgaaaccgcggcggatttccttgtttcgtgggagacgagacgagacgacggctgcccccaaaaccgagggctggagggcacgcttcacagtgcacacacatatgcttcatcttctccagctatccatgcagcttccgtccattgcagtagtagacaatcttatccactgctcattcatgcattcgattatattctcttctcgtactcgtaaagaaagatgttttggacagcgaaacggtctccaaaacacaactttgacttattgtttctataaaaatatttattgaaaagtgatatatgtatacttttataaaagtatttttaaaacaaatctattcatataatttttatattttcaaactcaacaaattaagagttattcatgatttatattcccaagggtttgatcctaaacgacttcctttgcgagtacggatagagtactatggattacttaaagtcatcagagcaaatttaatagcgtaagcatatgctagttctaaaaattaaaacatcgtcatatcatccatagccaatttactagcgtataaaaaatatttttcatgtaaatatacactacatcattatatttggcccatcatatcttggagcacagctggtagaacaagtttataactcgttttttctcacttccgcgtatgcttaattgcttatactaatcagatgtaaaaaaaaaaattagccaggcagactgacaaaccggccagtacgtgtcacctcccacgtgtcgccgttctgttctggacggtcagattcatctcgcctctgaaaactcaaaattctttttcgcagtaccttttaactctgaaaattgactagatgtactgaaaagagtcgggtacaacatgctccatccgtttcaaaatgtttgacaccgttgactttttagtacgtatttgactatttatcttattcaacaaatttaagtaattatttattattttcatattatttgattcattgttaaatatactttcatatacacatatagttttacatatttcataaatttttttaataagacgaatggtgtcaaacattttaaaacgaagggagtataataagcgccacatgtcattgatggcaaatagttatttcaagtggcaaacagttaaaagcccccggtttcagagagagaacagttaaatgcccccggtttcagagagagcatagtgccaccgaccaatccagcatgcaaccgcctcccgattcgtccctcccactcccactcgtggtttcacctcaaaaccatggtctccttcatgcttcccgccttgctgccttcgcatcctcctcccttgcattgcgttgcttgctgctgcctataaatccagagctccccttcaagcaccatctcaactcactctcgatcaaactagtagccagtactcctcgatctccttgggttaatcacctccttcgcttcagactttctcttcagctcccatcccatcatcgtcttgatcgcgatggcaacggtgacccgtgctcacctggagcagaggctcgccctggccaagcgctgctcgcgtggtacgtatacgaagtcatcaactactcctacaatgttcttcgtctttgcgttaattgaattccatggcacctaactgaatataaactgatgcataatacctgcagaggcgaacattgcaggggttaaggcggctgccgttgcgaccatcgcctccgccgttccaaccgtaagtgtctactatctcagatcatgctacgctaggattaattagccctttttctcgtgtcagttcttcattagcagagtaggagtactaacttagagcacattttatgtgttgtttcatcgatcagctggcgagcgtgaggatgctgccatgggcgaaggcgaacatcaacccgacggggcaggcgctgatcatctgcacggcggccgggatggcatacttcgtggccgccgacaagaagatcctctcgctggcgaggaggcactccttcgagaacgcaccggagcacctcaagaacacctccttccagggcgccggccgccctcaccctgccttcttcagggggctgcaggaat

SEQ ID NO: 46371 - DNA, 2528 bp, Oryza sativa
cctgcagcctaactctcatatgtatctatacaagaaaaatgataggaagttgcagatacttgttacagagagaatatcataggaattagccctacatgggcatttcagagtaattagctagccagcacatttgagcaagttaattacagacaatcttcacccatctaccgaacagaaagctattagatgaagatgactcttggtcgaagcacaaacaggtgattaatatcagctgcggagaaatttagattgcggcgcacaacgccatactgcaatcatgcgacgtcggccccatcaagcaacgcagagagcgaacagcttttcttatcctgctttcgacttttgtgcgctaaaaaaagacacagatagatgcagagagcccccacacagatggagagattatcttcagacatgatacaagaagtggacaggacggtaatgctagctgctggtgtgatggtgccgatcgcccacaaaccggcggcgctcatgccatcgactgatcgatctatcctgtttcagaaaacacaagggccaagatgtttagttgcccttcagatttaatttacggttatctttttgggggagaaaagttaagaaattttacagtcagttttgaggcaaggtgagagtataactgtagttttctctactggcaatacgtgtactagagctacgtatagtacttgcacaatgtacgtatatacatacagtgccggcctgacaggtgggcccacggcaacctgacagcctataaaatatgctggtggccatacacgcagctcacagaatcgacgttgctgctgctgctgctgctgactgaaccggtttcgcccgaaaactaggagcgttttcgcggtcgcgtcgcgttcgtcagagcgaaaactgccggcaaccgagcggcacacatccacggattcagaccaaaactgacggcaaaatcacaacacaacgcgtcacgatggtcgtcgcattcgtgtgcatgaatcatgcatggttgttcacgggtgccgttcaaatgctactatacaaaattcagctgtttactgtggctggctggcttcaccctaccttgttcttcttcagagaacaaaaagtgccggttcagtacgtacacatgacggccgggtctccatatctccgaaaaatctatgaatcggatcaagtaaaacatgagtaaaaattcggcggtgtccaactcgaaccctaatgcatgcgtatgcgagtgttgaatcgatttgactaattccgtcaccaattcctatcactagcatatcagcacaaacagtccagcttctgctaaaatcaaaaactccctcatatatatagttagcttttcatccatattctcaaaagctgtagttaaaaaattcagaaaataaactagaaatagaagctgggaaacccaatttctgtaaattctcgaaagctgattatcaaaccttcctaccatttagaaaacttattctacaaatatacccctaagaaaacttattttaaaaatggttgtttttgtggcgccaatgttattggcgccgtggtccaacgtgaagacgttaatgacgttgacgctatccccatagcccctcagtgaaatctaaatcactaatgtgaagggagatagtgccaatgttgttagcgccgtgaccaccgtcatgttggatcatgatgtcaattatgttagcgccacgaaaagaataataatttttttagatatatttataggatagcttttttttttaaggaaaatgcagctcatcgatcgacccaaaaccgagggcacgctagcatagtgcacacgcatgcatcatcttgagggggtgtttgaatacaaagactaaactttagtctctatcacatcggatgtttagacactaatttaaagtattaaatatagactaattacacagatagaggctaatttatgagataaatctattaatcctaattaatctataattaacacatatttaatttaatatttattttagcactgcattgtcaaataagttagttagacatggttaacttattatacatattagctcaagtagtataagctaataaataataagttagctataccattaaatttgctcttaaagataatcaggcaggctgacaaaccggccaatgtcacctgccacgtgccgctcagattcatttcgactctgaaaagtttttcttttggcagtaaaaccgataatactcttttctttttaactctgaaaatgttcaggatctactgaaaagaaggcatgtacggagcacatacatacgtacgtggagtggagaagtacgtcagagaaaacagggtgcgggaaactcttttaaatacttgggtgaacgtacatccgtttcttgcatgtcatttaaatagttatgaaaaattttaaaaaaaattgacatgataggttaatatataatatatcacttcacaaatatgtaagttcaaattcgacttctaaaaattataacaaaaataacaagacttctaaaaattataacaaaaataacaaatttgactg

SEQ ID NO: 46372 - DNA, 5237 bp, Oryza sativa
ctgaatctcctttcagatatctgcacttgagagtaaattagctagcacattcgagcaagttacagacaattctcacccacctggagtagctagcagcagtagcattcagtcccaaaacgtacagaaagctatcagatgaagatgacgacgcttggtcgatcgaagcagaaaaacaaccgattaatatcagctgcggatcagaaaatcgaattgcggcgcacgacggcgccatactgcaatcatgcgacgtcggccccatcaggcaacgcaaaagagcgaacagctttttcttatcctgctttaattttgtgtgctatagaaaacgacagagatgcagagagagcccacacagatggagatcatctgcagacatggtaagaaatggacaggaaggggtgctgctggtgggtgccgatggcgacgcccacaaaacaggagcggccatcgatgacgttcagccgaccggcggcctacggtttttcagaccggccggcgatcgatcttgctctttcagaaaatgcagaggccaaatctcatgttcgttgtttagtgactccagaattacagtaatttttttctgatcaagcagatttagtgctagtatcaattttccgtcagttttgaagtctacagtgactaactgtaattttcactagtagagctacatataggctatattcggatgtctttgttggaaattaatcctttgtgcgcatgtaaaacagaacaattcattagcacataattaattaattattagtttttttaagaaaatgaattaaaataaaacaattttcacatataactttttttcttaaaaatatcatttaacggttcgaaaaacgtatactacagtggatggagtattcctgcgtacgtacggtgccggcctgacaggtgggcccagagcaaacctgcaaaaagtctagaagttcattggaagcattaccaaacagcctatgcacacacgcgtttcagctcacagaattatgcctttgcaactttgagagagagagacgttgctactgctgctgactgagccggtttcgcccgaaaactaggagcgtcatccgtcagagcaaaaactgccggcaacacatccacggattcagagcaaaactgatggcaaaatcacaacacaacgcgtcactctggtcgtcgcattcgtatgcaaatcatggttgttcacggatgggttcaaatgctaaaaatattcagctgtttactgtggctggctggcttcacctaccttgttcttcttcagagaacaaacgtgccggtttctccaaatctccttagaatctatgaaccagatagagtaaacacaagcaaaaaaattcgttttgtcaaaaactccaaacctaatgcatccgtattcgcgtgttgaatcgattctcccaattcggtcaccgttttgactccatcactagtatctcagcacaatcgaataattttttcagcgctttgaatcctgcaaattgtgtttcttgcactccattaggcaaagcttgagaacattataatttctctccagaatatcatgcatccatgctagctacgttctacctagactactacaagtaggagtagctaattaactagagttattcttctacctaaccagatctctcagaccatatcatcctgaagaaaaattcaagattttgggtagaaaaggaaccaagcaaccaaaatatttagttaaatcgaatccccaaaccctgtgggtgcaccacagtttcaggctcaaatccgttggtccctgtaaagcgttgtacaaatgtacagtgctagctgctgctttctgaatgagtggagtgcactatgcagtgtgcaggttggccaccaacttccaaacgagtaaaactccggaagcagaggtccattgaacctacccggctcgtgggtttctgcacaaaaccgtggccgcgcgccaccaagttcatcccatccactcctcgatctcctcgtacgcctataaaatcatacggcttcttgctctcttggcaatgcaagccaactgaacgaactcaagaacagattcaaacaattgtagctgattcctctctgcttctcgttgttcttggttggttgttgttgtagaagaagaagaagaagaagatgtcgacggtgactcgtgcctacttggatcagaagctcgcactcgccaagcgctgctccagaggtgaacatttatgctgcttataagtgatttacctgacggtcagtcactgtagcttggttcttacattggtggttgaattgttgcagaggcgacgctcgccggagccaaggctgcggcggtggcgacggtggcatccgccgtcccaacggtgagctaaactgacaacgaaacattcagattttcagagttttttccttgtgtactgatcttgcgatgaaatctgctgctgtaaaaaaattcagttggcgagcgtgaggatgctgccatgggcgaaggccaacatcaacccgacgggtcaggcgctgatcatctgcacggcggctgggatggcatacttcgtcgccgccgacaagaagatcctctcgctggcgaggaagcactcgttcgagggcgcaccggagcacctcaagaacacctccttccagggcaccggccgccctcacccagccttcttcaggccatgaggaacactgaactttcacagtgactgatggaagcctggataaactgctactgctgctgagttcatgcgtaatggttctataagttgtgatgtaattagttttgttgttgttgatgatgaaaatgaaatcaatgagaactagtactttgtttttttaccctgttctgaacttcatctgaaaactcgttgatgtcttcaccttcttcaaaacagttgatgaacacttatcccctagctagttagttggtgtgaaatttgaagccaaaagctataattaaaaagattttcagatagcacatactctccgatagtcaaaaaaaaaagagacaactttcatacatgaatcttttctttttcacaagggagtacttttatactagtattgaataatgtagtggatattggataagcagtgtcaagtttttcagagtgcactaatgcaaagcaaaggtgatgtgaaccttcagaaaatgtagtactgctagtatatacagtaacagagcaacggtacagtgatctggtagactggtacggatacatgacgacgccacgtcacctcgccggtatagcatatcgccagctcaatatatggccaaagtaaccaagattgatgtacgaacgaagttctgttttcccaaatcaaccagctaaactgctgctggttttatagagaatgaattcttttatagcttaacttcgaaaaaaaagagatttgtagaaagaaatgtttctccagatgcttttcttaaaaaaattgtttaggaattgaaaatagtatcttagagttgaaattaaattggcatatcccttacaattaacgctaccaagtgcatttcctaaaagttaggctgtgtttgtgtttagttccattcaaacttttaaaaatttcgtcacataaaatatttggacatattgtcaacgtttgatgtcgcgattccggtatttgcatagtatggggatcgttggtactaggatatatgcgagacttaggtaaaagagacggagaggaggatttttatacagtttccggcccctgaattatcagataataaccctactcctgttggctgaagccggtcgttgctcttattcactatgatcacaccagtacaatatttggggtaacttatctaactgttgtcgacatagtggattgaagtatcgacaacagggtagtttttctcctcgaatccgtgctcggcgagatcagaggcatcgctagatctctacaaccggcctctgtaggtaccggatagggtcagtccaggcatatctctgatgtcgatatccggcggcacgtcttggcgtatattggcttgtatgttgatatgtatcttgatctgttgttccctctcccctctcctcctaaggtgtcttgtatttatatccataggtgttccatttttcatgtagaactagggaaaccaatatggatacaattcgagtagtttttgtcgtttccatataaaactctattcttccttccttacgcggaactcctcttatatctgaaggatatttccatataagacatagtatgtggtgggtcctgccgagatttagtcaactactattaaatatgtggtatctataaccctgacacatatgcatggagcattaaatgtggacgaaaaaaatcaattacacagtttgcatgtaaattgcgagacggatctcttgagcctaattacgccttgatatgataatgtggagctacagtaaacatttgctaatgatggattaattagacttaataaattcgtcttacgatttacaggcggaatctgtaatttgttttgttattaatctatgtttaatattttaaatatgcgtctgtatacataaaatttttttggaagaactaaagacggccttagtcccctttcattttgccgtctataaatatatgcagagagagagagagagaggagagagtaaatgcatatcaactgttcaagtttaacggcagcgaccgttcgaaaaagtttaacggcagcggccacggatacagtgaaaaacatggaggaggatggtgatctgatctataccgtgggcagtgattgattgatctaatcaaccagttgcctgctgatgatcaccacaaacccaactggatggacaactaacgcacagtaccgaacccttcatactactcactttccgttaaaaaaaaccaaattaaattaaatgacacattctaatataacgattctaaacatttaattaaagttgtaggtttctgtgctcaaaatttgattgtccatcttatttaaatgttttatgattagtatttttattgttattacataaaaaataaatagtactttatgcgattattttttatattttttaaaaataagataaacggtaaaacattagacacaaacaaccacaactgcgttataacaattgcacttataaatagagcggatggagtatttttcagtagaatagcagtaaagcaaagttggttggatctagcaggagatgataaggtgagatgggagagactgaaatggagcagatcgcatcagaaatggataagcgatccgtactttgagtggggcagcaatgcattgctagtgagca

SEQ ID NO: 46373 - DNA, 6550 bp, Oryza sativa
  unsure (1)..(6550): unsure at all n locations
tagtgtacatagcattaaatatattgtcacataaacaaaaatataatgtggcaaatatgatgtggcaagagagttaatgaggagatggataaaaagatgaagaagctatttctcatgcaagaaaccatatctacacaagtaccatgaataaaaacaatgggatagatagataaaaggagagagagaagagattattgcatgagaatttaatttaaagacaccaaccatattggatatatggtttttacacatgatgtctatatgacatggtaagtatggaaactactgcatagtttctgggttggggatggcccaagagcaattgcaataatagactataaaccaactataaagtaaaaaaagtgaagtgcagatttttcaagtagctctagcacgaacttttagacgctatgtatgagaggtgagaccagatattaatggtgtgatatatatatatatatcacaaactttactaactagtttaaagcaagtttgaactgaatttgaacttatttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcatatatatatatatatatatatatatatatatatatatatatatatatttacatgtaactattttatgaatataatgttagattagctttataaattggctatactattaacttaagaaccctttgaatcaaatgattcatttatgaattttaggaccgctttgaatagcatgaatggaaaaacggagaaaaatgaaaaaaaaaacatgtagaattttgataagaatataagtgcaaaacagagaactataaaacgtaaaaaaaacacaggaatgatcgtttgattggatcgtaggaaaaacgtaggaattaaataagaaagataaactcaaaggaaaattttccaagaggcggttagagctcttgctaaattatcttcaaaatctctactggatttatcattccataggaattttaaaagataggatattattcaatattttattttaaaaatctttagaaaatattttctcatagaactgaaatccttcaaaatttaattattttcctacaagtcgaaggagctcgtataggattcaaatcctataggaattttttctatgatcatttgattcaaagggatgaagtttccgaatcctatgaaatttctatataatgactcattgcatgtagattttggaatgaacttagtaagagctccaacctatcgaaaaattttctttaaagcctatctctaatttctgcttttttcatgcagtataatcaatcagccattcatgtgttttgcaatcattattttacgctcgtattcatgtcagaaacatgtttttctcgtatttatcttctttttttttttgcaaacctacaattcagagggtccatactcttaagtaatccagctttgggggcttcaaaaaagaaaaagaaaaaactaatccagctttggcagagccccaggcaccgacctgtagttgcatcagcaaaccatggctggacgcgtggacggataggaacagatcgagcgaggcgaggcgaggtagtgtacgtgcgtggcggaatatatggtatcatcgtgaagcagatcgaggccggaggcggttgccggcaacggccacacgcgcacacatggtttcgccccaaaaccacgtcccccgcccgccgctatctgcctccatcgtccactgattccttcttcattccgctacatcgatctcttgggtcttggcttgcctgcctataaattcgcaggcccccatgcctctccccaatccaatccatccatctcccttgcttgccgctacactcgatctactctctcacacactcctctgatctctctctctctctctcgctagtcgattggcttgcctagctctctcaaactgctctagtgcagttcagcaaaaactaagtgactgaaactaatttacatggcaacggtgacccgtgcacacctggagcagaggctcgccctcgccaagcgctgctcgcgtggtacgtgtagtagtcatgaactacaatgttcttcgtctttgcgttaattgaattccatggcacttattaactgaatatatatcgactgatgcatatatacgtgcgtgctttgtgaatctgcagaggcaaacattgcaggggttaaggcggctgccgttgcgaccatcgcttctgcagttcccaccgtgagtaaactctctttatatatatatatctctctctcacacacacacacaaatgcgtcttcttcagttcttgctgctagcttttgtgtgatttcttcagtcttcattcatcagcagagctcatcaggtacatgtactaacttattatctgcatatgtgtgtggtttatttcagctggcgagcgtgaggatgctgccatgggcgaaggccaacatcaacccgacggggcaggcgctgatcatctgcacggcggccgggatggcatacttcgtcgccgccgacaagaagatcctctcgctggcgaggaggcactccttcgagaacgcacctgaacacctcaagaacacctccttccagggcaccggccgccctcaccctgccttcttcaggccctgaacaattagaacagcatatgcatgcatgaatctgaaacttgatcacagtatctagctctcgatcgatccctgtgtcatataataatcgatgtacgcccctgcagaaccatttagagctgcttctgtagagcagtggtgttagtactcatctctgtcgtatctgccattagccacctaattaaatacatgtactgctatcttgcactggggctcactgcatgtaacactactgcagagtgcatgcactcctcataatgttcagaaatcacaagtggtactactatatattccgaccactatgtattgattgtcggtaaacagagaggtttgtgcgaaatactaatcaagttgattactgcagtggttaaataactggagataaaatgggtttatatatatgaggcttgtagcttcagcaacatgagcactgtgttctgtgtaccacctttctgcagatgatgggtcatttttttttaacttggttcaaatatatcgatcctcctatatggacaggtctctaaaaaagtctcaaactgaacaatcaagattaaaaaaaaggtggcggtttagtctgcacttgctgacggttttgacaggctatagttttatatgtatattgtctgttgctttttcttcaacagatgaacaattgaatactgtatgtttttgtttgattcttattccatcaatcatgcatgaaaacgattacgggcattcttaattccaactgtggcattcatgcatgcaaaaagttgccctaccattcgcgtacgtatgttatgcagggttggaaattccggaacgaaatttcggttatttcggaccccctccgatacgatattatttcggccaaaaattttaaactttttcgtaaattttggtagctaaaccgaaaggtttagccctgatgttatgtatacgtacatagatgaattaaaagattaagaaaaccatgcatatataggtgaaattttcaaattaaagtctacacactaaaatttgttacaaactctagttgtttagctttttataaccaccctgaactaggtaaatcagacgttcgagaacatttgctagtaagaactttttaatgtgcatacaccactgctgctaggtggaaactggagttactggtggatatcgtgtgcatttggtgatgatatcaattactcattaatagcaaactatagaaaccatgacccatctaaacattcagctgaatcatcatcaacagcagcacgattaaacatcgaataattaagataagggtaattttacatgacatctaaagttcagtacaatggcagctgcagggctccaaaacattcagcttcactgtggaaggtaccctaggctggatgtatcttctgatagccaagacccctctgtgaccttccatgataatgtccctatctagtggggggcatttgccaattttgctgccaggagtatcacacctaaaaccagtctgagaagcatccaatgtcaagcactcaagggaagttgtactctcaaggatatggcatgtcagctcaaccaagctctttacagagatgaatgatgtgaccctcacactcttaaggctgtgatgctgctcttctcgtattgatctcagatctgcaggatgtgcaaaaattgaaacattctgcacgtaccgctgcattacctaggatgtgaaagggagaaattttaagtgacatttccaccacacaactactaattttcattcatagcagtaataatatatgaatggcaactcacagtcaggtagaaagtctccagagaaggtgcagcatgaatataagaagccagggacaaatagtcataggctgggaaatatccaataagggcaatgctcaagtgcctgaggcagaggaatttgctacacagcttcggtgcaaaggccgtctgcataaagaggtcaaattaattatgctacaacccataagacagaatctagtctcattcatgtgtcaggcaaaatttctcatacctctttgaatgacttcatggcaagagattcaagatttggcatgatggatggaagttcagcacgagcatgataaacataaccagagcgaaccatgcataggctcttcatttgcaaagtttctccaagtttcagttgcgttttgtccccttgaaatgcaaaaatggagacattaggagcttcattttctatcagtttcagattgtcgcacccaaacaccttcagggagatgagccgctgcagtaggcaaggtaccttcaggcaaacaatcctatcgcagtacctgatttccaactgctccaatgcaagagaatgggaaagaaagcagcttaactcgttctccgtaatacgcacacaacagagatacaatctcgtcagacttcttaagccaccaagtgtgactgttgggtggaaggaacagttagaaaggtgaagatattggattgagtctccactcccattcgacagaagagagcatgggaaattgtactttgcctggaactgggtcagtgaaattatgagttcttcaatccctggtttaacaccaatctgaagccaattgttgagatatgaagagcccttcccactataatctgaatataccttaatcgtaagttttttcacgccgatgcctgagtgccttttgagaatgtggtcgactttgctgtagaaaagtccagccaattcttcctttccacatgcatttctattcaacccaaatgcttcactactgaaattgaggttgggatggcatctccaggaacttagaaaggaacgagacacacaggcagctcgggcagcagctcgcattggcatcaaggaatgtataagacgccagatgtcctgcttgcacaagcatatgggagagaagttaaacattgtactaattgtgaagacaaatggttgaattagatggaagaaagaaaggataacttatggagtaacaccttaaccggtccaatgctacctgcctgattatgtactattgtactatgaattgtatagttgaattcttctaggcaaatatggtctttacccaaatgaggtgttaagtgctcagcacatatttgtttctttgcatttgtgccagaaagaatggatggaatgatgtttaattgtctaatagcatgttgctattcaatggcagcaaaacaaagaagattccaatgcagcagggctgtaggaggttacagcatcaaagtgctccgttcataaactttaatagcgttggtggaccaatttgtgcaattgaagcagtaatcgtcataatttacttgcactacactactactagtaagatgtttcatcatcaacattttatttatggtgtacctctggaaggtctggtatctctatgtcagcagcgccctgagaatcgccatcttgttggcagggtgaacactttcttttagcccgtaaggcaatcaatccatctgcagcacaagatgcatggtttacatcagtgttttaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46374 - DNA, 8562 bp, Oryza sativa
ttgagtcggtagcggacgaggcagatgaatatcgcagagataaacatcgcgaccaccatgaagtgctgaaggattgctaccttttggaacacagacaagataaaaaaggaactcgatcagggtgagcaacgacaatgcagacatggaagagacggagatgaagaacgagagctaactaattaaccaaaccacctgctctctgtgctgtgttcactctccctctgcttgcttgagctcttgtgacttgtgcttgagagatgagacgctctcactgatggcagagcaggcatgagtaccgagtagtgagaggagatagtagcatggaaagaggtggccgggtaacagctactagctcaactagttaatttgtgtccaggatacttgctagggtggcgattgtgataaatggggtgtctacattcaggattcaggggtgttaagttttagcgtgtcacatcagatattatataggatgtcacatacatattcggacactaataaaaaaactaattccaaaatctatcggtaaaccgtgagatgaatttattaaacctaattaatccatcattagcaaacgtttactgtagcaccacattgtaaaatcatggagcaattaggcttaaagatttgtctcgtaaattagtcgtaatctatgcaattagttattttttagcatatatttaaaacttcatgcaggtgttcaagcgtttgatatgacaatgtgtaaaattttggaggtgggatctaaacaggcccaaatacggagtacgaagctcacctgaaactgtgtagatgtgcaaaacgacaaataaaaacaatgatcaagctggaaaaatgcagttacgaagaagttgttcagattgtagctaaaataaatcttactaaattttggacatgctaaaattttggcaatttgtcaattgacaagttttggttggatttattatgtatttaccacagttcggtaaaaactaaattgatgcacatatttagtagctttacttttaaaaaagtatggtttaaaatgacatctacctaaacaattctgaacacatttacatttaaaattgtttacatgtgtaattgagtaaaacgacaagcaaaaaaaagcatacgtaatatccagggagagcacatgaaaaaatgcgtacatattttttagatatgtgatacaaataaagtttttacggctaaactctaataaattaccattagaagatatgcgtaatttgttctagatattttatatgacatttattagctagttgatgtgtacacagaacacgttatctacgaaaaaaattgaaaaacatatcttttcttcaccagttttagagaaatatatacggttacgaaggattagcgtgagtatccgttatcacatagggaagcgaattcgtagcgagttcatcacgcgcggcgagttcgcagccctaacgaaccaaattgcgtgctgcagccgtggcttcaatcaattaattactcactttatatccaacgtttgtttcactttatatccgacgtttgttttgttcgtcttatttaaaatttttttaattagtattataattgttactagattataataatatatgaatagtattttatatatgatttttttattttttataaatttcttaaataatatggacagtcaattgttagacacggatgtccacgactgcatttaaaatggaaagtaggaagtaactaattagcgttattagcgcttaattaattagtttatatttttttaattagcatcgttagcgattaatttatcattaaatcattattagtcagcagtttcgctgctcagccaggcgaactccccgcacgaaagcgcgcgtcaccacgagaccgcttctttgatctgagacgggtatatttttatcaattcgtttcaaacgtatgtattcctaatttcctataaaccgattaaagaattgtatcttttcaaaaaaaaaattccgttatctacaaccacaaacatttgttcaatatttgagggataatgttaatgtataactgttcatggattggaaaaataattttctccctaagcatgcatttaggctgattgtgcaacctggaaggatcgaacctagggcaatgtttagttcccttcaaacttctaaaaattccgtcacatcaaatgtttagacacatgcatagagcattaaatgtggggaaaaaattaattgtacagtttacatgtaaattgcgagacgaatcttttaagcctaattacatcatgattttgacaatgtgatgctacaataaacatttgctaattatgacggattaattaggcttaataaattcgtctcgcagtttacggatgaatctgtaatttgttttgttattagtctatatttaatacttcaaatgtgtgcccgtatatacttaaaaagattttagcacacgaactaaacacggccattgtcgtattcataaagaccataaccaatttgcaaaacacataagtacagccaattaaaccctcagccaggaatctttgaacacccctgcgcacgcggagaagcagcccagaagctaacgaacgaagtataatgatccaccaagcttggccatctttgtgtcgtatcgatgaacaagaaagcatctaacaaacctgtcaaccactgtacatatatcatttgaattaatatatgggtgaaattaagttttaacacaagatggtattagtatcagcgaacgattactattttctaaataataaattgttcgtactctggattattgcaaaagcataatataagtgactctaggagtatattgtacaacttttaactaacgaaataaagaaaacatataatataaaaaagtatatgggtgaaagttttaatttgagattgtattaggagtatcaatgaacgattgagggcttctttattgcaggaattttagagagagaaaaaataatggattcgattactaatcactcatttggattggaagaaaagtacataggagaatttgaaaattatttgtattttttattttcattttatcttgagaagtctaagacaaatcgaggcatgtgatttcaaattattataaatttaacactcatcaagcaaaaaaaaatattttatacacaaatagtaatgatcttgtgtttcatcctattcctatatttcaaaagatgtgtgtcctattttcttatgtgctttttaatattatatttttttcacatgtaattttattttattcctatgttttttaatttctgcatctttttaactactcctttaaaagcctggagagagtaactgtcgagtaaatttatgtaggtagatcttcctttgaattcgatgtaagatactgtaatgatcacagggactccgttgtactccatcacatcttttctgttctgcatcacttcactgaagttggaagttctgcagcacttcacagggacagctttgaattcaacgctatggactgggagtagcgtcttgtttgcttagagcaaatataatagtagctataagaagcttaaatgctgaggtggatggaagaagagaggagagagatgagaagcgggctgtaagtttacagcctgcttagtcacaggaaccaagaaaattgtgagacagacatgtggaccatatatttgtagtgaagagttaaccactatataaatacatagatagtatataagtaagtagctggctgtattattatccttgctcttatactgtagcggagcagtagtactacttattattcctacttctatacttctatgggaccactggaaagggacgaagagaagattgtcggtgagaaaaagagaagatagagaagatcaagaattaagaatacgcaaatgcactcttttttttcccttctcagaacacatcattgtactctgtgaaaaattgtacagtacattctgcaggcaaaaatatggccttcttgtcagcatttgcctttgtttgctttcaacaaggtctactaccttaacttctctacctcatcactattaattgtacagtgcatactatacatagttgcgtgtatatcttctctccacacccatcaatacgatggatttgcttcccagaatctcccgtttcttctgcaagaattgatactactacctgcctgttgctccattgaagttgattgaactcatcaatcctccaaccgatttgctccccagatttcctgcatgttccttctgcaagagttgatgatatactgtatactctagtgattactaggtgtgcacattgatgtcctactctcagcttctcgcgtgcattaaataaagtgagatgatgactatgcactgatataaataatccttgtagcttaggcaatgcttgcaattaaccaacaacatatatgtgcgatagatcaaaattaacaagactacagcttagctttatttaacaggaaacattacattaattactatgttagatcaaaagctactagcagggttgaattaactaggattatttgatcaacatgaatccttgattattttttaaagaccaaattaattaagaccttgaaattaaggcctggcttttatctactgggtgctcagagaaattaagcacaaggccatattaaactgacccgatcgaaacacattcacactaaactctcaggtagaaaccaaatcgatcagcacttgacggaatagtaacacacattcttcacacaagagctagccattgtctgattttttagataaagaattgtagattgtctgatagtcaagaaaaaagaaattaagaccaagatcaagaatacattcttcacacaacagctagtcatattctgatcagttaagaagaaagaaggatcgagataaagaatacaggcaatgattaaacaacagatcaatccaacgtactatcgatgaaatacaacatcatccagtgatccaacaactgaagctaagctagatagcaactacgagtacgaggtgagtaggacccttcttctcccgctcgccggccggattctaccgatcgaagagattataggggaggaggaaatacaacatgcatgtgcctagcttacatcacagagctaccatcaccggcagaagaagcaacgccgctttgctgatgctgccgctgccggccgtcgcggcggcgacgtggaagtcacgcggctctctgttgataggcagcgaagccgaagccggtggctgcgtcgtcgtcatcttggcaggggccggcgaagcagaagccggcggctgcgtcgtcgtcatcttggcaggggccggcgaaggcgcgtggtgcaagccgcgcggctccctgttgatggggagcgaagcagccggcgttggggtcgtcgcgacgccggggagacgacccgccgccgtcgtggccgccgcggaaagcacccctaggaagatgacaagaagagctgcaagattaacaccacgcatcctagctgcctttgagcttttgagggaggaagagcagagcagtgatgtaggagtatcacaatatcactagcagtgaactgaggagagatttggatactctccctacgtgtgtatatattggaaaattaaggaacttttctacatacggcaaccaataataatgtgttttttttctaaactgtactgatccataaacactaatccttacccctggattgtcttttattatagtttgggtaacatagtactacctcctgaattttgtgctaaaacctatgtgattttattagaagggtttatttcagttaatcttttattagtggaagttgggaatttatcccaacatcttatttatttttttctctttttacttactctgcatcgtacctccaagatttaacagagttgttgttcttggtctgcaatatatggttgggttagcacatccaaaaatttcctacacacataaactctcaacttttttttaaactaccaaatttccttaaatttctccccaattctaacaactaaacacagcctaaatctaacaaatagtacatggcttgcacagttgcactgctactgccctgagcaaaagtgtgcggcggcacgtggggtggggaataatggcagatgacgtctaggtcagtgggagaggccagtggatacatgatgtggatgcaatatatatggacctttcgatccaatggttcaaaaagatctagcacaatgtttactaccaaattttatggcatcatttgtttaggtttaggctgttaaggtgaattttcggtgtttgtagcttgtaaaccgatggcttagagtcctagctctagtctacacgtgcgaaaagaaagtacaacataacttttcgacttaataatgcaagaatagcttatatttatttttgaaaaagaaaaagtccaaccaatagtaggtactaggggccatgtatggcccgatatctgaattaactagttggcaccccgcgccttaccgcgggatttgctagttttatcgtcaaataaaatataaaataaatgttttaaaataattacatataacacacacactctctctctctctctctctatatatatatatatatatatatatatatatatatatatatatatatatatatatatatatatatatatatatatatatatatatatgataatgtgacttcatatatagcctctgctattataatataattcatgttttattttttttaaacgtcattgtgtattcttgtgatatatgagagttattttcatgcacaatctgaatatcgtcatatttaggtagtctgcacctctttgctttatctcaaccttgttttgaaaataggtttgggttactgtatgttatccaattgtttataaaaaacaaaacttacaccttatgaaataatttaatttgtatttgaaaaaatgagttaagtttgcattatcttttaggacttggaggaaaaaaaacatagtattatgtgcagaatggataacaatgtcatgcatgatcatgagttaaaaagaggtgactgaatgagtaatcaatgattatattagatggatgtggatccaatggctgataactctttactaatgcgatccaatgacttaaaattattgatgatgtagcttcttacatgccttgttttatagaagtaaatgcctcttagtggctaccaattatataggaagataggatttgagatccattaggatgaacattagtctacacagcgatttgccgtgggaaatactgagcaattctcaatatatttttttcaacaatcaagtaaggagtaaaaaggaaaaaaaatatgaaacatcagggttttatcagtatttaccatgaaacaaacaaatgatatccatgttttgatgtgaaagatattgataagtatatgttaaatattataaaaatgatagataaatttgttaaaatattgtgtaaatgatgtgaaggatgatgattggatatgtttgcatgttgatttgcagaattaaataaattgtagatgatgttgcatgcttgcatgaggttaaatgtgcaattattgctagtgggtgataatatggcatggttgtatgttaagctttagagtgggatataactttatactttcatagattcatacaagatcgatccaactcttcatgggacaaatcttcttttggttcgcccctacaatagtaggtaatttggtaatttgggtttgtagagtagtaattaaggtatgtcgcagtagagccctccaggacctccataggcgacgttgtaccctggcttgtcggcgccgaagcccagcggctgggcaccgtagcagccaggcgtggtgacgacggtccgatccaccgagtcctggaagagctgcccgacggcgctgatcccgaggtacttcatgatggtggcggcgaagcgagcgccgccgcacgccggcaatgccgctgcccatcggcgcgcgtcgtcgtgtggttccccccggccctcgtgtccaccaccctcccccccatctccacatacgacccctctgggaaccccgtgtcgaacgcgtcgtccgtgtagtagccaatctcctgatccatcaccgccacccaccacaccaacttggtgtcatcctgcatgcatttgtagtatatatggaattacaaattaaagccaaaacaaaaaaaataaactttcaaactaaattttgaagttaatcttaagatatattcaacgtagtttttttatattaacttttaaatcactaaaaacacatatataaaagttttacttataaattatttttttattctctaataagttgttttggtttattagggaatatatgagtaaccgacgatgccgtaagtctaaaattgtaatttgaactatgtgacagaaaaattggaagtttgaaagggattaaacacactctaaggttattccggttttcgcctctcccaatgaaaacgctggaattttgcgggacgggcgcagcagaccccgtcggcacaccgacgacgcagtcgtgcgcaggctagctcggctgtcatgaactcacttctctccgattcgatttactcaagtagcgaagaaatcagcggatagaagtttcgtgaggaaga

SEQ ID NO: 46375 - DNA, 701 bp, Oryza sativa
actggatggatcaaactggtagcaggaagagccagtttgtacgccacttcgcccacacgatccaacacctgaaacggaccataaaacctgaaagataacttgcaattagcgcgggtgaccactgattgttggacaaacggttgaagtttcagataaacccagtcgccaacagcaaaagagcgctcagagcgacacttgtcctcttgtgatttcattctggtctgagcgcgtaacaaatggctgcggattaaagattgcatctgctcccgttcatgtaaccagtccaacagatcctccgactgacaggcagatgtagcagacagaccaaaatagcgaggctcgtgcccatacaatacctcaaatggtgtagtacccaaagcagaatggaatgatgtattgtaccaatactcagccagagcgagccaccgactccattgagaaggacaagcgtgaacaaagcaatgaagataggtttgaagacattgattgacatgctccgtttgtccatccgtttgcgggtgataagaactcatacgcaattgtgtgccagccaaacgaaagagagtagtccacaatgtgcttgtaaagatacgatcatgatcagagatgagcgactgaggtaatccatgaagtcggtgaatatgttgcatgtaagcttcagccccatccaaagccgtgaaaggatgactcaagggaacaaa

SEQ ID NO: 46376 - DNA, 1102 bp, Oryza sativa
acaaaaaagacgtctggatgtaaagggttacattggttcacaacaaccaattttcatatgaagggaggcaaacaaaaccaactacaagagcaaacaacgtagggcattccctggagataattctatgataagggcactgagaagttaattatggaggataacaaatatcaacagaaaaatcttctttttcggggcagactatatgcagtacagataagcaagatagaacatccaagaaactcttacaaacatacgaggcaaagtaggtatgcaagtagactgacccacctaccgcactttctgcacatggacctataaccagtgacaaggttccacccagcatactagggcaatggtaggcgctaggcggcatcctcccgcctgctgcacaagtattaacaggtaacctagctcctaggcagaaacccagctcacacagcgcctttctgaacaatactcaatattagtggtaaagcaagcaaaggattggtatctgggttggtagaccaagcccggttgcatcccaacaaaaatcccaccaattaacaaaattccaaacaaactgtaaaatcttaacaaaacagtgagtaaaacatcagccatgtaccaacaaatttatgcaaggcaacagggtgcaaaagaaaaggtcagtgcaagtacaacccaatttacatatatgaaaccagtgttgttaaggcagtttaacgcgacccaccactgccttagcgccatagcgctgaggcataaggcgttgctttgccatatgagatggttgaggcgtgattagtggagaacatggtagagaaattaggaagaagaaagggggtatttggtaaaaggcccactaagccaggcagccagcccaccaaagcccaacataggtcttcatacccacgtgttctatacttctgtgccctaagaggcatcgtactccaccaggcaccagcctccatgacgagcagataaggcaccagccattgcggtgaggaagaaggtgactgcaagccaactagggttctaggatgagcttacccctatcttcttttcctttttctactgttttttcatctaaggccttcttctttcccttacatatatgaaa

SEQ ID NO: 46377 - DNA, 1340 bp, Oryza sativa
gcggcctgggagccgcacgggccgcaacccaccaccactcccgaagcttctctcatggcggccatggccgcggcggcgaagctcacggcggccgcctcctctctcctcctccggtgagctctcactctctctcttccttcgagtccggtctactgcagcagtgttagtcaagcagatattacttctaaatatctaatccaatctttttcttacatgtctcttgtgcacaggcgctcacccttgctgcggcctcacggtctccgactctcccgccgcttcgctccccaaaggtgtggccgctttcatcagagatctgacttatgcccatgtttcttttgcgaatcatttttggaaatttggaccaaggttgggtgttactactggcattcaacttttgggcaactttggagcagttttctcttgtacttatggatgcttaggagacttcattctatctttagagcaatcaattaccagatgattattaacagaatcaatagactctctacatgcccattggcctgttatatgtgcatgattctagatttagttagccatgaagggtcaatcaacggagtgtagtgtgctctattgtttccaacggttggtactaaaaaaagtataagcaatgaacaaagggttgatcaccaaatagcaattaccgaatcccaattagttatattgctatttgatataaactcaagtctgtaaaacaattaaatccaaaattaaacaagtgcctaaacaatatggtggcatttagatgtgtggtgggtttacggtaatgctatgaaatcatagttctctcccatcgtctacaattgatggttcttgtctaatattgagtccgggtgcttttcccttttcctccagatttgtgcgccacattgcttcatcgacaaatgaagaagctgctgctaaagcagcagcagcaacagctgatactggaggaccgaccatgtaagctttctcattttactatttcataatcccttctgtggcagtggcactgagtattcctctttgtttattttatggaagttttgacaagatcattgcaaaggaaattccttctaatgttgtctatgaggatgagaaagtgctggcatttagagatattaatccacaagcccctgtgcatgttctagtcatcccaaagataagagatgggttgactggactagacaaggtatggaatgttgttcactagtgtttgcgagaggaattctcaatctctaaaactgtgtagcatggcagtatccatgtacttcgttatgtgcttatcttagtacaagccgatgccctttttaactgcctatggaagcaaaattggctgcagg

SEQ ID NO: 46378 - DNA, 4098 bp, Oryza sativa
tgtcttctttgagcaagccttccatcagacattatcacctcatgttggaagaacatatttttaggctgaaccaaggcatgtcgaaattctgggctatcttctatacgccgcgaaaatagtggctgagaaggaaggtatagctgaagggtaccgtgtcgtcataaacaatggacctaaaggatgtaagcactcccatgccacatctcttttctacttactggggtttgcacatgttttcacttttcagtatacatgctacacatcatccttcaacgtattttcggtgttgatacccatgctcatgcatgagctcttttccaccgccatatttttcagtatttatgctaatactgtatcatcgctctgtccacaggtcaatcagtctatcacctgcacttgcatgtactaggtggaaggcagatgaaatggcctgctggctaattaaccaagtgggatgctttctgtactattgcctaagttctcttgtagtaagacaatatgatcggttgaagtaatacccgcattggtgaatggtgttttctatccatctgtaacgtctttgttgtcaatgataccttcacaacagagcccgtgagaatgctcaaagaatctgttagtgagattgtctggtcgttctgtaattacttgattcgagcctctaaagtttacataatcgttcggccacaatatttatttgcaatacggatcgagggtaataagctagattcttcgtgctgtaatgtagttttgactttctcaaggcaaaacgatcgattgaattgaaagaacagagttatcgacttgtctaatgatgcttgttttaatgttttataaatctgattttgttattcaaactggaataatatagctggaaaacgggtggatcacgtttcatgcagctatctccagaattgaattcagaagataaacaaacccacaatccctgagctgcaatctcaatacaatcaagtcactgtcacttaatcaaagtttaaacaaacccaatcctccacctgtattcagatgataagcaaatcaagagctgaatttcaaatggagcacaaacggaatgatcaggacactacaaaattttcatgtctgatttgcaagaaaaatgtttcagcttattacattccttgggactcctctatccagaataatataatgtggtaggagaggcgagatggctcattgtcatgatggtgagttgctgcatagtttcttgaaatccagcagttaggggattgatcagtgtttgccatcttcttcctcacaaaacttcttgtacttctcatcatccatcagcgagtttaactcacttggatcacttatcttaaccttgatgatccatcccttctcatatggacttccatttatctgtgtaaaattgcagaagcaaattgtcaactgaacatagcagtgattactcaaaaattagtctagcaagggtagcaattgcgactcacaaatcctggtttttcacttagttcatcatttacttgaataatctctccagatactggtgcattgatatcactggttgctttcacactttcaaccgcaccaaagttcgttccttgtgatactgtggaaccaacttctggaagctcaacatacacaacatcacccaaatggtcctggaattgaaacaggacatattaagccatcacactatcacagaaaattctattttgaggaaaaatgctgtaatgcatgtcaataacacgttgaagttatcaactcagcaagagacccagtaatatagcatattgaaggctgataaaatgctggtgcagcttgcaaatgtatcaaactgattacctgagcatggtctgtgacccctatggttgctgaatcaccctcaaccttcacccactcatgagtatcagcatattttagatctttaaggactgccaagcaggaaaacaaatatgcattacttattagagtgataggctgacagcgaagcaatggatattgtattcatttgaaaagtttcagtaaatgctccaatcagttagatacgctagagggatgcagtagcagtacactggaaaaatctaaaaagatgttttgaagaaacataaaaccaagttgagaaaacaaatatggcacaaggtgcatgaccaccttctcttgggatcacctatttttatttctgaaatagaaacaactataaccactacatatggaatagaaatgtaatccgcatatatgttgtgttgcctgtgtaatctagcaagatgtaatttgcagtctagtaccaatttttggaagccctacactgtaattccataaatcatctgcacatttcatcatctcaaattctcaataaccaaaagggtaattcacatttcagtcatccaatcggtgcagagtcttgcctatgaactaatgaacaccccaagaaggaactagcaactagaaagtctagaatggtgcatcaagccatcaaaaacaaataaccctaacattagacctaatcctcctccctgatataaacgatcgacatgcctcacaatgaactatcgggtcaccgctatactttacatacgaaagtctcctgcaaacgaactgcgcaaatctgtgacgcgcgcacacaagcagtgaagcaaaaacatcacaaaatttcagatttaacagcatacttcctcccgaaacccgataattagggtagaaacagccgagtcaccccgtcccaacgcgcagagcctttgatccccaattccccataccacaaacagtacacaactacacatataatacaggcaaaatactaagcaggagggaggacaaaatggcaaagcaggagagggggcagatgccataccggtggagaaagccctggggaaggaggagatccgaaggtaggaggcggtgcggcaagcccagagcgcccttgaggcggcggcggcggcggccatgatcgagcgagctgttccaccgccgagctcttcgagtggaccaaccccgccgccaccttggagagagaaagagaaaataatgggctttctcttaatgggcttttgttagtgggctgtagtttaggcccatgttgaattgggctaaactgggttggttaccagtttgcctctgacagcttgaagagatattggaaaaagtacaccgaaggtccctcaacttgtcatcgagatacaaaatcgtcccccaaccacaaaaccaaatatgtgacatccctcaacttacaaaaccgtgggactacctatacatttgttgacaagtttttctccaaaaatttgacagatgtaattatagtacaatcgtagtgtaattacactgtaacttatatgtaattacactgtaacttacatgtaattacagtgtaacttatatgtaagtttcacataattttgaatcgttagatctattacaagatttgttttggtgaggaagaaaacaaatcatagcacacatatgtgaaaaaaaattgttcccacgacctccattttaccgaaataacatgttacagacagatttttgaaagttagatataagttacaccatagttacagtgtaattacatgcaagttacagtataattacactacgattgtactgtaattacatctgtcaaatttttggggaaaaatttatcgacaaatatatagcaaaatcagaaaccgtttactctaggtccttcggtggttttgaccctggttttatccgacatggcggctgagtcagcgtgggacccgtgtgagcccccacatgtcatactgtccacgtcagctttctctttccctcttctctcccttcctcctcctcctcctcctctctctctcttctctcttggcatggcgtgcatcgggtggggaggagaccgcgccgctcgcccacgccgcccgcgccgctcgcactcgccggccgagtcccggccgtgccgctcgccctcgccagcgccatgtcaactttcagctgtcggcgagtctgccgagatgagcggcggctggccctctgcagcacggggccatctctctaccgccggatgcactcaaggacaacgcccccgctgcccctaccgtcgacaagctcggccgcgcgcccgtcggcggtcggcgcggttgggctccatgccac

SEQ ID NO: 46379 - DNA, 2897 bp, Oryza sativa
tttgcatggcctatgacaaggcagcaaggctgttgccgacaagctcctttgccgctgaagaaacccaccacaaccgtgatgccgctcccgcagctcgacggccacgacctcgcgccgacgtcgtggtcggaggtcagcaaggccctggaggtcatcaagcctacgctcaactccaacacgacggagaacgccaagagcccgcatggcaggcggtggagacgtggcgccgaggtcgtgtcggcggcaggaggatcccccgtcgtcgtggacggcggagaggaggccgacgcgatggcggtgggagcacgcggataggaggccggcgcaacgggcagcctttggcggccggctgctggtaggggggagcacagtggagaggaggccggtgcgacgggcggcgggcggtggccggcgagggaggagcgcggctgagaggagggctggcgcaacgggcggcagtcggcgacacggagcacgacgacgactcggggtccctcccgtcgtccctatcccagccgccgcttgccctgctgccgctcggactgcccccgtacttagccgctcgccctgccgccggagttgggctgagacggggcgccagcagcagtcgtcaccgcactcgcctgccgccaccgcgctcgcctgccaccgccactgccaccatgaattggctcaagctcggttgaccgccggccgcccgtcgcggcgccgtcctcctcctctcccgcttcgcctcgttgacgcccgcgccttcccgccacccgcgacgcccgcgcctccccgtcgacgcccgcgcacggccgcggcacgcccacgccgtggagctccgctgggctgccgttgtcgccgccgccgaccgccgtcgcggcgccgtcctcctctcccgcctcgccccgcccagcggccgccctgcatagagagagagagagagagaggaggaaccgaggaagaccgaccggcctgcacagaagagaagagagggagagatatgccctcatcgtttggcttttcttttaataagccaaaacggcttattagagaataaaaataaatttgtaggtaaaacttttatatatgtgttctcggtgacttaaaagccaatgctgaaaaagaaactacgttgaaaatatctcaaaatcaatgtcaaaattaagtttgaaaattcaaaatttggctttttctttggctgaataggccatccgatgggagccatagatgactcagcctaacatgtagggtccacatgggtccatgctgactcagccgccacgtaggataaaaccggggtcaaaaccaccgaagaatctactgtgaccagttttaattagttgagggatgttcggtatctagttttaccggtatctggttttgcggttgagggacgattttgtaactcgatgacaagttgagggaccttcggtgtactttttccaagagatattctccaatagaatattcttctcctctgatcccacgaggaacgttctctagattgcttaaaaaccatccaaactgttatgaaaaattctaaagaaatttgaaaacgcttatacaatatatttatacaactccacaaaatcctaggtctaaactcaactcgcacgtcaagataaaaaaaagataaaaaagacaaatttaacgtatgaatagcaatgtactattcacatctaaatttatctttttttctcaacgtgtaggttgaatttggacatgatttttggtaaagcgatagatattattataccctatattgctaaaaaaatcataattgtttactactatttgtataaaatttaaaagaaaaggtacacgagaggatataatcccgaaggattagaatccactcccctctcattttcgctttttttttagaattggtccagaaattaagggtcatttctgtacgaaaacgtaaaaataacttaaagttacattaagtggttaggtcgtcattatcgtcctaatgaaattattgcgtactccctccgtcaaaaaaaaaacaaactctggtttccgtgtccaacgtttgaccgttcgtcttatttgaaaaaaatataaaaaaaattaagaagataagtcacgcataaaatattaatcatgttttatcatctaacaaatatgaaaatactaattataaaaaaaattcatataagacgaatagtcaaacgtcagtacggaaactcagggtttgcctttttttaggacggagggagtactggttaggtcatcataacagctcattcccactatatatatgtagtacatttttcgatctattccgggtacacgatcaacagttcgcaccttgattgacgctaattttagcccaaaatactcccaacaagaaaacaaaaagaaaaaatgaaattactacagcaatcagcctcgggaagcagcaaatttctcataggaatttcactgtaaacaacacgttgaaaccaacggcgccgaatgtgcaaaattatcagcagctggagatcgatcgatcgaactcatcgaagacgctgtgcaagcaaggacagtccacagagccggatacgagtgcgtacatcacactgcagctaagctgagtagggcatcgagcacgcgctgaacggcagcatcacgaggggcgggtgggcgcgagcgcgagagaccatacctagctgcaagccttgacgagtagtatcggagttggggacgacgaaccataacagtagggatgaagagggtcccagacgaaagcctagcccagtgttcactagaccagcaatgggcacggtcatactttcgagcgtggtaacctttctggcgacgctgtcgaggtgcccctttgcccttaggcaaggatctctataggaaaactttgtccagttttttagacaggcagcaatgttatgctatcacgtcgcacctta

SEQ ID NO: 46380 - DNA, 4185 bp, Oryza sativa
aaagtcctttgaatcaaaggaatgaaccctatggaatgctatgaaattcctatggaatgcctcttcccgtacaagttttggaggaattttaataagatgtagaacctcatagaagaaatcctttgagtttttatctctccttaaattcctgtgtttttcctgtggtccaatcaaatggtcattcctatatttttcctgtgttttgcaatcctctgtttcacacttacattcctgtcagaatcctatgtttttcctattcctccgttttcttcattcctgtgattcaaaggggcccttaagcaccaataatactacttcagaataacaatcagtagtgtactggtgtgtttgttttgttgctccctttcttcaaagattacgacagattaccagtattatattgcgaagaaagaggaaatgccttcatttagtggaatcaagatcaaaccggacccaattaattaattaattactccctccattacagaatataaaaattttaaagttggacacagttattaagaaaatagttagaagtgaatgatgtagggttgtgatcggataagtagtggagataggtgagaaaaatgaatgacggagggttgtaattagttagaagaaaatattggtagagaagttatattttagaataaattctaagagataaaatttgttatattttggaacggagggagtaaatcggactaataaaactacaaaatgtaacaaacacactacctcacctaaagctaaccaccgcaaactgaactagcaagctggaagaactctgcaaaatttgctacctatcgacctcgtcacctccgctgtttgtttgcagtcattcgcagcggcagcgatggatgttgcggccgccgcgggcgtcgttggtgggttcttgcaggtcgtcttcgacaagtactacggctccaagctcgagcagtgggctgctcgctcgggcctgcacggcgacttcctcagcctcaagaaccagctccacatggtccgtgccatgctcgaggcaggcggcggcggcaacgccccccacaacgactccctgcgcagcctcatcgtggagctcaaatccgctgcctacgccgccgacaacgtgctcgacgagatggagtactaccgcctcaaggagctcgtcgaggacaccagtggccgcgacggcggcgcaccgtcgtcgtcggctcgccaggtggtcggccgcatactggtgcctgcgcctctcctgtccaatccattcaagcgagccaggacgggcgccgacgaagccttgcaagggcagggcgctgacacggacacccccaacttcgatcaggatgcaatgtcctccaagatcaaatcgatatcctgctgcctcgagcagattgctggcatggtgcggaggatcatcgagctcgacaagttggtgtcgatggcgagcttagggcatgtacaaccagaggtggtggtaagtctgcggcagacaagctcctttcccactgaaactaagttgtttgggagagatgagtctaccaacaacatcataaaccttatgcttagaacagatatggagtctaggtacaataacttcaatgttcttcccattgttggcattggtggagttggtaagactgctcttgcccagtctgtctacaatcatcaaagagtagttgattcatttcaagtgagagcctgggcatgcgtttctgatactcttgatgtgcgcagagttatagcagatttgatagattcgatcgatggtggccaagaaactcccaagtttcatagagtgcctagtcttgatgcaactcagagaactctactgaggaaaattgaagggaagaggttcttgattgtccttgatgatgtgtgggtcagcagccactgggagaagctttgtggtcccttctccgcggggatgtctggaagcatggttttagttacaacgcgacagagaaaaatcgccaaggccatgggcacatttgacagtttgacactgcacggtttacatgataatgaattttgggctttcttcctacagtgcacaaacatcacagaggaccacagcttggctcgaataggcaggaaaatagctctcaagttgtatggcaaccccttggctgccaagaccatggggagattcctttcggaaaaccacgaggaggagcattggtgcaagtttctgaatagaaacatatgggaactaaaacaagagcctgacgacgttatgccggttttgttgttgagttatcagcatctccctctaagcttgcagcgatgtttcacctattgtgccatatttccaagaggctataagttcactgagcaagagcttatatttgcttggatggcacaaggccttgttccaacacctggagaggatcagacattggaagatgtaggaaaggagtaccttaacgagttactcagttgctcattcttccatataatcgagagtggccactacatgatacctgggttgttacatgatcttgctcaacttgttgcagaaggggaattccaggcaactaatggtaaattccctatctcagttgaggcttgtcacttgtatatctctcattctgatcatgctcgtgatatgggcttatgtcatccactcgattgttctggtattcagatgaaacgccgcatccaaaagaactcatgggctggcttgctgcatctaaaaaatttgcggactataatgttctctgcctcttcatcaatttggtctccaggttctgaggtagtctttgtccagagcaattggcctagtactatcagactgttgtctctgccctgcactttccgaaaagagcaacttgcagcagttagtaacttcatacatttgcgttacctagacctcagatggtcacgccttgaagaattacctgaagccgtatgcaagctttacctactacaagttttgaacataaagcactgtccgtgccttcttcatttacctccaaggatagccaacttattaaactttgagcatctgattgctgatgaaggaaaacatttactcacaggagttccatgtgttggcaatatgacttccttgcttctgttggataagttctgtgttaggaaaaccaggggctttgacattggacaactgaaaaggttgaggaacctaagaggtttgttgaaagttcagaatctcgagaatgttgatggcaatgaagaagcagcaaaggctagattgagtgacaaaaggcacctaactgagctgtggctgtcatggagtgccggttcttgtgtacaagagccttcagaacaataccacgtcctggaaggtcttgcaccacattcaaatgtaagttgtctccatattacaggctataggggcagtactaccccatcatggcttgctagtaatctcagccttagctcactagaatatctttatctagattattgttctgaattggaaattcttcctccactgggactcctccctcaccttaggaagctgcatatagtcaatatgcacgcgctaagaagaattggctctgagttctatagcagtggtcaggtggtggggtttccatgtttggaagggctatttatcaaaacaatgccagaattggaagactggaatgtagatgactccaatgttttccctagcctgaccagtttgactgtagaagattgtcccaagctgagtagaattcctagttttctatggagtagagaaaacaagtgttggttcccaaagcttggtaaaatcaacatcaaatactgtcctgaattggtgctgtcagaagccctccttattccacgcttgccttggctccttgatatagacattcaaatttggggacaaacagtgataaatttgcgtggtggctgtcttgaggtttctgaaatcaatgctaatactagctcaggcccaataaatgctgttctacaattgcattggctaaaacatgtgtctagttttcatatttgggcacaggacagtctttctgtacacccctgcaagcaaaagacagaaccatcagcatgtaattctgaacacatggtaaattctctacaaacatcagcagagaaagttgaagtcacagggtatggtattactgatgaattattgtcagcaattttggagaatgaaatctgtccttcaagtttatctatatcagattgtccacaaataacatctcttgatcttagtcccctaagatcattaaaatctct

SEQ ID NO: 46381 - DNA, 1322 bp, Oryza sativa
cctcaactcccctttgtgtgcagtgctcacttctctgaagaagctaacaattcattcggatttcagggtcacttccctctcaagacaacaggtgcaggcacttctactcttaacctctctgcaagatcttgggtttatacaatgctgcaatctacattctcttcccagtgaactgcacaaaatatacactctcaagcagctcgagattgattcatgcccatgtgttgagtcattgccaaataatgggctgccggaaaagcttgaaaaattgatcatcagaggctgcaacagaagattgtatacaggtgcatcaatgatgggttcaactagcaccaaagtgcacctagtagatagatgatataatagatttaggttcatattagtcggcgaccacgaatataaatagctcgtgcaagtgcacagtaatcaagtagtctacgtagtcgcttttggatgtcaggctatgcaacggtattaatcaaaagatttattcacctatttttatttctgaaaactgttatagatacaaccgtttcgtatggaacaaaaaggcaacccacacagatgttttcatctgacttgataattcctcttaacaatctaattaccatgacatgcatcctccatacattcttagatctcgataccagaatcctccaaataatagctttactttttgttctgatttgcacacaaaagtctcctccaaacgaactgcacaaatcttgacgcgcacacaagcaatgcagcaaactcatcacagaaattcagatttgacagcatgcttccttccgaaacccgatacttagagcagaaacagccgagtcaccccgttccaacgcgcagaacctttgatccccaattccccataggccataccacaactacccaactcggcaactacacgagatacaggaagggataaaatggcgagacgggagagggggcggatgccataccggtggagaaagccctggggaaggaggaaatccgggaggtaggaggcggcgcggcaagcccggcggcggcggccatgatcgagcttcgagctaattccaccgctgagctctgcgaatggaccaaccccgcggctccgagtccttgaagagcgagaaggaataagttcacttgaggtccctttaacttgtcaacgaatccaattttcatccttcaaccagaaaatcaaatacaacgggtccctcaactatcaaaatcagtgcaaagcaaatccctcaacggttttgatcgtggttttggctgatgtggcgcctacgcggccggtttgacttagtacttgtcatacgtggcggtaaggggtgcag

SEQ ID NO: 46382 - DNA, 2529 bp, Oryza sativa
attcgttgcacccacacaagatccaaaacggaaacttagaaggcacgcggatccaatccgaataccaacggcggaggaagaggcgcgcagtgaaagagagagaccagcggatctaccacgctcgccatgcgagaaaaagacggcgcgcaacggcgaactctgatcaaatcccaatcaatagccggcccgattccttgcacccacgcaagatccaaaatgaaaactcagacggcgcgcggatccaaaccgaacactgttagatttaattgggtaattgatccatttaaatcaaataaattccaaggctcattatgctagcaattatgctaggaattcatgtgtattcattttcttatgggatatcaatgggatgaagagtttatgagaattaatccatttgactagggaattggtaacttatatcaattactcctaattgatggatggttgatggttgtgtagtggaggatggttcatggctagttgatgacaattagttgctctattcctcttcctattccattggtaacctacatcaattactcctcattaatggttggttgatggttgtgtagtggaggatggttgatggctaattgatgagaattaattattccatgactcttacccttcatcttccattccttctataaaatgagaatggatttgatctccctaagaagaagtgagacacactttcatccatttccaaggctgttgctgctacaataatcccatcccgacgagtgtgtgcacacgcgttgggagagtaggcctccgaaaccatgcaaaccatgcactgctacgacgtttgcacggacgggcgggtgatcaggtttttggggagcgcaaggcgcgactactcattgttcgtcaatgtctacttcatcttcaccaacatgtcgaacactggagacaacggcaacactggagacaaggagaaggaggctcccgacaacaccaacggaggcaacactgcctcaaactctagcggaggaccattcttgggtataaccttcttacattatttcaattagaagttttactgttaatgttcatcgcaatgtcaacatgcgttattatgtgattgttgatgcttattctacgttaagcatgctcatgttgattacattcacctctatcactggatcaaatcccattgtaaatatcatgtttaacaccaacggcgggaaacgaccagtggatccgctgccttttcccctctccgtgcgcgcttgccgacgaggaaggatggccgggagggagagagaaggacgcgccggtcgctcctctcccgtcgccgtggatagagaggatggtgggtcccactgttttttccttttgtctgactgacatgtgagccccacattgttgtttttattttttatttttatattttgcttctagtgctacatcaccgtcacgtaggacgaggaccaagtcaaccggccacgtaggcgccacatcagccaaaaccaccatcaaaaccgctgagggacctgctttgcaccggttttgatagttgagggacccgttgtatctggtcttccggttgaaggacgaaaatcggattcgttgacaagttaagggacctcaggtaaacttattccgagagagaaagagggagaataatgggctttctattaatggggttttgttaatgggcagtatttcaggtccatgttgaattgggcttaactgtgtaggttaccagtttgccactgacagcttgaagagatattctccccccccccctctctctctcttttcgaaaatgctaatggcgatcgattgcccctagcgatcaccctcctcctccatgtggttttcttttttggcactgtattacttttctattttagtaaatttatacacctaaactttgtacacctcaagtttacatatctaaagtttatacacctaaagtttagagacccaaagtttataagtcaaaagtttatatatccgactcaaatttgaatttaaattcaaatattttttatatatagtatttctatacatctaaagtttatacatataaagtttatagacccaaagtatataagtcaaaagtttatatacccgattcaaatttaaatttaaattcaaatattttttatatatatagtatttctatacataaatttttctaacttttttttattttttttaaaaaaattatggtgtagtaggaagagaaaaaggggaggagaaaggggggagaggagcgtatagggggatgggggtgatcgccggccattagcaacgcccctctcttttcccttttttttagaattggtcgagaaattaaaggtcatttcggttagaaaacgtaaaatatgttaaagtttcattaagtggttaggtcgtcattatcgtcctaatgaaattattgcgtactggaacccaatgtgattagtcaataacagctcattcccactatctatatatgtagtacatttttcgatctattccaggtacaagatcaacagttcgcaccttgattgacgctaattttagcccaaaata

SEQ ID NO: 46383 - DNA, 766 bp, Oryza sativa
catatataaaaagttctgcctataattttttcttttggttcttagttcattttttccacggcttattagccgtagatcaaacaatcaaagacttactctgatgccaagtaatcccatgccatggcttgtttttgagtccttgaaaatctccattatagtatggtaaaaagatctcaattcttatttgctgattccaaatgtgatacttaggtttctgccgagaatctggtgaggaagccctatattaattgggctgtcaaaagggtcacacggtgtttgcaagttctctggcctcgttcccgtacaaatctatttggctcaaatgccactggtttggctcttccaacaagcgatgtagatcttgtaatttctcttccaccagttcgtaatttggtgagttgcattactatcggtatgcatgtaactggtagttcaaatgtacctgcctacatgccatagtgtgcaattctaagttgtggctgcttccaggaacctataaaagaagctgggattttggaaggcaggaatggcatcaaggaaacgtgtctccaggtaagatgccttgactaacagactgacgcattctctagtatcagtatgctgtttactctgcattctaaactggtcgatggcatattatcgaattttagcaaattactttgttgtgatgaatttgggttgttaatgattgattgtattgtgcacaatggcgctttattatcctcttaaggtctggatgccaagttattaatgcaatgaaactgga

SEQ ID NO: 46384 - DNA, 17264 bp, Oryza sativa
  unsure (1)..(17264): unsure at all n locations
tgatgtcaattcaaagtgtatttactattcatatataaattattgcagtacataaaatgtcacatgcggaccatacatacagttataattatcagcatgctcttgttttcttgtcaactgtcacatgtcatctcaaatgaatgctaaatgttctatatactgtcaccttagcggatcatatggatgaaataattatgttactctcggagtgaataattctttacaatctgccataagtatttgctttactgagatcttgtagaaaaagaatatgtttgaagaaccaatgggttacaacattttgattttttcatagtgtgtaggatttgatgccacaatgacatggttttgttagacattaagtcttatatatacatgaatgagcaaccagccagctgtttattaggtttgagatatgcacatattgcacacattgctcgctagatattgtgcataaggacatgagtaagaaagtttgcagatcacaagcttacatctatcaaacaatgtttcatgagacctaaggcccccctgtctatttattcaccttcttttttcacttacaggtctgtgaattaactcagcaatttcctgctgctgtgcctcttgccttaatactgaagaagtttttggctgaccggagtttggatcacccatattctggtggtctaagttcatattgtttggtatgtaacttttcataacacctgctgttcctgtcgtggctatctattactctctggataactttcttaggtgtgaatgatgtcatgaacttaaactgacaccttaccgttcaaattgttgctataataataaaaaaacattatgagtgaatagctattttttttctccttaactttagtagattagtcccagatatttactatttggtgatttaggttttttttttctggattaaccctcttaatcagatgcatttctatccatagtattatctagcactgtatgacttagccttaaagaacagacccagtaaagtacggtcctcagctaactaatttgtgcttgtaccttgccacttttgtacagtagttcatacttgctgatcttcctttcttccatttcttttttctctctttcaattaagggcaaatccagattatttgcatcaatattggtatcttgagagcccactgaaaaataatcctccagtttataacttcctttgcaggtactgttaatcgttcgttttcttcagcatgagcatcatcttggtcggcccattaaccaagtaagttgcaaatcatgaatagagaagaagggttttttatatgctctatttcattactagttcttgtatctttttcctattagacgtttgcttctgtatcatccggttgttattttggtaatcagccttcatgtaacttgtaacaacaggcaaagtcattttttcaatctctcttagttaaattcagttttcttatttccttctaagttaatttcatatctgttccttcatgtttgacagaatctgggcagccttttgatggatttcctatacttttttgggtaagaaaaatacatctggaccctttatcctttaatacataagggaggaccaaacttcaaagactatagggctcatatgcgatttatcctgtgcaaattgcaatcgttttggagtagtaatataattatcatctaagatggaatttaattagtgagtaatctggatatcaggaatgtatttgatccgcgccatatgcgtatctctatccaaggaagtggcatttatttgaaccgagaaagaggtcacaggtgataaaattaaatatcaatgtatcagtttatctgtttctgtcaactattgccttctgtaatttttccatatgcttgatttgcagcattgatccaatacacattgatgatcctctttgccctgccaataatgtgggcaggaactgtttccgcattcaccaatgtatcaaggttacttataattctccctttgctggttgattggacctttcttctgcagtatgtgttttttaagttgtttgtatctttattttctcacctctggaattttgttcttactattttctgggttatcatactgtgtatggtaaacttcagaatttctaaagcaatattttagtcttcatactgtattaggactaactttgtttggccttcaagcatcaattgttggtaacaaattgcgcatatttactaactctactgtttgatcatttgtatggcaggcttttgctgatgcttttactgttctagaaaatgagctgctgcagttcagtgcagaatgttacacacctgtgtcatcattcaacctactgaagaaaataatgccaagtattgatttcgatgagctatagagatgagaagagcctagggattccacacagtacaagcgatgttgggctggaatgtcctgtactgcgtcctggacactcagaatggttatgtcaattattaaaaaaggtaactattaacaccacatgtcaatctgggtttcactctacatttgctaggttacaccctaatattagtcctatgagttgcaacataagtaatgtaagatagatatacaaagttgcaaactgcccatattcaagtgcgttatttggtgaagttgtgttccaaagtattgtaacttctatcctgctctaacttggcagctgggggagccttgaaatggctaattcaggaacaagaaggtgctgcacgcagaatgcacatatattcagggatagttgttcctgctccccatgtgacagtgggtttcaccacgtggtacgtatattaaactatcaaatccatattgatatcatgattaacggatccttaacctttcccccaacattacagtttccaacttccggatgcagaaatgaactcattcctgctgttcacctgtaaggttatggaaagagcagagatcagtatatctgttcgaagctacaaatcctgagcagcatggtgggataggctgctcaaccgcagcaacaggttgaagtggttggacgatgaccgtcatgaaataccaataacaacaaatggaaggacgtttatatcgtgagacactctggcagttaggctatataaactcgtggaagacgaaaagcatgttactaccttcatctcaaaatataagggatttcggcaatgcaaaaatcccttatattttcaggaaggaggtaatacctacgaagaaatctgctccaacgtgtagcatcagttgaactgtggaagtgtcactggcagtttgtcgccaggcataacattggaagcacgagtgcacgactggtgtgcggaagcaattgtacaaaattacgtcaactaagagacatggaacacaactgattccctggagcagtcaaaagggtaccctgagcagaacaactgattttcggcagagaacttcccaagttataggaagtatctgttccatgaactgtagtactaatttagaatttaagttaattcacccttaagttattatacttttcatggatttcggattgttgcagtctgaactatggaattcaagttatacaaacttgtaagaacggcaccgtagtgtatagtacatctggatgaaatgttgaatggcatatgaggccaaggcgtttggtggcagatttggcatttggatgaaatttacgtactgcatacagtatgcaccaagtagagtctgcacattgcagacacattttttctgcccgtctgcaggactgccggattgccggtgacatcaattttcattctcctcccaacagtcacagcctcacaggtcatcatgactgcatgtagtattatgcatgtagtattagggcacccacaatggttatctataggctctctataagagatccatgtcagcatattttcctacttggaagagattaaatgaagagagagagcaaagctatctactaacctggagatagtctatagagaaaaacgaggcaatgtattagagagctatagatacccatgtagacatactattgagatggtttactattaatctagtctattgctgagatgtacatgttttatagatagcaccttactttactattgcgggtgctcttagagcaaggttaatggtatagccaactactggctctaatttatctatagccaatttaatagctaatttatacaatagttgtttattatactattagtatatggtctcactgtcatacacacactgcgtcttggagttcgtgttgcagctggctacagatctgtagcccactgctcttctctctcatcttttatctcattaaaatatgtttatagctggctaatagtctgctattgtacctgctcttaggcgtgtgttaatcccttggaaagaacccgtcggtgagaataacgaaacgcctagctcgagagtgaccaaacgattcgcgttctacattcaacccgggcgtcgcatgcgctcctctcgttccgatattaatccagtctccacttgcctctacaaatctacatatagggtactcgtagaaggagttgcttgagccttgccatctcacgctcgcagtagccgtagtgcgaacccaccacaaacaaggcaatcgatcggcagcaatgtcattttcatcgtggaacctcaccgaggccacatcggctattcacgacatcacggtgaacggctactctgccaccaagtccggcggtgaaaacgacttcccgtccaggcgactcaccgtgggtggttacgagtgggagatccgctactacccaaaggtgttcatcacacatggcgattaccgtattgcgttcaggctcgtcttccttggacctgcaggggcgagaggcgtgaatgcgtcgttcagctgccgcctgatggatcaccgctccacttggacggaggcacgttggcgtgatgcaagcgggaaccagcacgactgcagggctgaaactgtgtcacgcaaatttcacctcgccagggagagctctgactgggttaagctcattaaacaggacgatctggagaggagcccggctattttagcttgtgattctgaatgaggtgcgtcatcacggtgctcaaagatcctcagtagtacgtaggcactaggcagcatacccatggtttgatgccgtttgtccgtatggattggatccagagtgccgtcacctccatcctagcagctggtgggtttctggtttgccaagagaagctttactttaacttatacatgcatttcgatatctacttaattatgttgtggttaattagccccgaaatggtcgtatgattataagattatatttaattgatgcctgatgctattagtatgttctcttttctcatggcgtttgcaacgttgtcatgattttttttttttttggaaacgtcggaatgtagcatcggatcaaagaagcagaaggggttggcccattgttcacccagagcaagtttttaggctctcttcaaccctcggctctgctacctgtatattcggtccaccaaacggtgtttacctaatacctactgcctccgttccatattacttgtctttttaagtttttgtttgtcaatgtttgatcattcgtcttattcaaaaaattttggaattattatttattttgtttatcatttgctttattatcaaaagtactttacatatgacttatctttttttatatttgcactaattttttaaataaaacgaattgtcaaacgttataaataaaaaatcgaaaacgtcacctactatgagatggagggagtactcggctactcgtttcctctgaaaacgttgatgataggatcaattcccaattcttctgtcaaatgcttcacccaaggtcagcacgactgcacaggtccttgtgcccgctaatgcttcgaaaaagaaacatctcttaaaaggaaaaagtacagcgaaggtccctaaacttgtcgtcaagttacaaaatcatccatcaaccgcaaaatcagatatcgaccgtcccttaactaatcaaaactggtcataatagctccttcgatagtgttgaccccggttttatcctacgtagcggctgagtcaacgtaggacccatgtggaccccacatgtcaggatgccacgccatctctttcccttcctcctcatactctctctcttctcttcttctttctcctcttctctgggcaaactgttcggcggctggggaggaggccgccggggcgacgcggcaaaggaggagagcggcgctgcgacggctgccggcggcggccgcagtggggaggcggccgttccatggaggccacatcccgcgccagcaacaccaacaaccacccggcagcgacggcgaatgaggggatgctctcctcctcatcggcgtcgacgacgcggctgtccacggggagacagccgttgctcgcccccggccgccgccagcttctcctccgcctcccgcgccgagacggcgacagccgcagcgcacgcatcaggcggtcgcggccatcaccatcccgaggttagtactggtttccttttaggcgaatggctgctgcgcctcgaggagagcggggtggttggggtacaggcagaaaggaaggaacaccagcaataaaatcaaagccagcacctcatcttcttgttgaacttttcagacgagtatgcagcaacaaaccagccgtccagatcaaccccaactcaacctggcgagcagaacacgatcgagagaaaaggacaaacttgtgtgcatatgtactatgtttaccatgtcaacattcacagataattccatgaagcaattctatataaatcctgccattttgagcaaaatgctcaagtgtatcgtctctgctctgagttctgaactttgaacatgcaatcgaaagcagaacaagatggagcgctcttcttccaagccggtcattgcgctcgtgctgctcgtcgtatgcatcgtcagctgtttcgaggttgtcactgcctagtacgacggttcttccagcaacggcgcagcggtgacgggccccatggccgccggtgggaactgctcacttgttgttgctgccgttgtgctcgccattgcaacgtttgtctggaactgaaacagtgagatggaaacgctgcgaccgcctgatgcgtgcgctgcggctgtcgccgttccgggcgcgggaggcggaggagaagctggcggcagcaggggcgagcaatggctgtctccccgtggacggccgcgtcgtcgccgccaacgagaaggttcgccgtcgccgccgggtggttgttggtgttgctgacgcgagatgtggcctccatggaacagccgcagccagccgccgtcgcggcgccgctctcctcctctcccgcctcacccggtgacctcctttccagccgccggccggcttgcccagagaagaggagagtgagagagagagagagagaggaggaatgagatagatgatgtggcatcctgactcgtgggtgccacgtcggtccacactgactcagccgccacgtaagacaaaaccagggttaaaaccaccgaaggatctattgtgaccggttttgattaattaagggacgaccgaaatctggttttgcggttggaggatgattttgtaactcgatgacaagttgagggaccttcggtgtacttttcccctcttaaaacatgcgtgattttttaacggaataagttcatctgaggttccttaacttgtcaacgaatctgattttcgtccctcaaccgaaaaaccagacataacgggtccctcaactatcaaaacaggtacagataaggtcccttggcggtattgagggtggttttggcggacgtggcgcctacgtggctaatttgactcggtctttatctgatataggcactgatgtggcgcttacgtggcaatttaatccagaaaaaataataaaacccatgagacccacgtgtcagttccacacacaaaataataaaaaagtgggcccacctgtcattctcatccctcttcttcctcctctctctccccatctcccttagggtgtgtttgaggggaaggggattgaggagattgagaagatacgcaaaacgaggtgagccattagctcatgattaattaagtattaactattttaaatttcaaaaatggattaatatggttttttaaagcaactttcctatagaaattttttgcaaaaaacgcaccgtttagtagtttgaaaagcgtgcgcgcggaaaacgagactcaatctccccaaacaccctggaacgaacggtgccttaatctctctctcggattgggatcctctctccaggcgcaacggagaggcagtggcgcatggcggccggcgggagaggagggagcggcgcgacagcggaggcacggcccggcggctgtgggcggaagaggaaggggcggcggagcttcttttctccctctcggtctctcccctctccacgccatagatctctccctctcccacttacccgcagccatggcggaggacgcccccagagccgccgccgccgccgagggaagccagcatgcgtcggccgcggagggaggctccgccgtcggcccgccgctcccgcggcaccagtcgccaaggccgcggaggtgctgctcccgtcgctcagcatctggccgctgtcgcagcgcacgccagcgaggagcagacattgatttgattccaagattatttttttttagcaagggtcaagaaccccatttcttaattaaccctttcttttactaaaaatgatcgtaccagtacaggttcagccaaagcggcaagcaatttgattccaagatagtatcagcttagctagcagtggctagctagccatgagtaatagtggcaaggagcagcggcggatggaccggttcatcgtgatccccttctccacctgccgcaatggatccagcgtggacgtcgtcgatggcggcggcaagagcggcaagaagccccaaggttcgttgtttggagtcttggatgcttattcttcacttctgctctatcttgtcgattgttttttgcggggtgatttaggagtttggtattagtgatgttgtgtacgtgtctaggcggcggcggcgagggtggcggcncggcggaccaccaccgccagcacgtggcgcacatcggctgggacggcagcacaaacaccaccaccagcctccgctcatggaaccgcgccgcgccgccgtcctcctcctcctccaccaccaccgcgtccacctcgtcagccttggcggcgccggtgacatcaataaggagtcggcgccggcggggcctcggttgtgcagctcatgtcctaccgtctgccgcagccagggccaactcccaccgccccttcctcttccgcccacagctgccggagccgtgcctccaccgccgcgccgctcccttctctcccgccggccgccgtgcgccgctgcctctccgtcgcacctggagagaggataggggagagagacgaagagagggagatggagggagaggaggaagaagaagaggggtgagaatgacatgtggggcgcacatgggccccaccattttttattaatttatgtgtgaaactgacatgtgggtcccacgggttttattattttttcgggtcgaattgctacgtaagcgccacgtcagatgaagaccgagtcaaattagccacataggcaccacgtcatccaaaactggcctcaaaaccgccgagggacctcatctgcaccggttttgatacttgagggactcgttgtgtctggtttttcggttgagagagaaaaatcggattcgttgacaagttaagggaccttagatgaacttattccttttttaaccatcaaaatggggccaaactgtggttggttcatgggcctcacgccggcttcaaattgggccacagcttcgtctcgcgtcaaagtaccttggaataagttcacttaaggtcccttaacttgtcaacgaatctgatttccatccttcaaccagaaaactagatacaacgggtccctcaactatcaaaaccaaagcgggtccctcagtggttttggtttatgtggcgtctacgtagcaggtttgactagctctccgtcccacgtggcattgacatggcaattatatcttggaaaataataaaaccgtgggcccacttgtcagctacacaaaatatcatttaaaaatagcagggcccacgtgggcccacatgtcagctacacaaaaaaatactggtggggcccacgtgggccctacaagtcattccctgccctctcggctctccctcttcttcctctctgctctccctcgtcctcgcagcggagcaacggcggcagcgggcagagcagaggcacaagcggagcggcgacgacctcgccaaggacgccacgcgtacctccgacgcgagaggagcggtgacgcatgccggccggcgggagggagggagaggagcggcaggggggagctgcacgcagctgccggcgggagagcatcggcggcgcacaccggccgacgggtgggagggagattagcggctgcgcgcgcagcgctgccggagagggcgtccgacgggagcgctgcgagggaggaggcaatgcgcgccggccgacgagagggagggacaggagcaacggtgcgagggggtcggcagccggcgagtgggcagaagaggagcggcagccccccggcctctctgcccttgtcggcattcccctcacagcgagcggcggccgtcgaccgtctccgcccccctcgtcggctgtcggctttttccctctccgtgcgcgcttgccggccgccgaggaaggatggccgggagggagagagagagaaggagacgcggtccggcggtccatcgtctcccgtcgtccatggcatggatagaggagggtgggacccactaacatgtagatcgtactatttttccttttgtcttactgacatgtgggcctcgcagtttttgtttttattttttatatattttgcttccgttgccacatcatctacaccaaggacgaaggcagagttaaactagccatgtatgtgttacatcagccaaaaccatcatcaaaaccgctaaaggacccgttgtatctggtttttcggttgaaggacgaacatcaaatacattcacaagttaagggaccttaagtgaacttatttcaagtaccttccacagtcagtctcaagtctgcgttggtagaagggcgcgttgaaacggaaagatctctcaaaatctctggatttaacagagcgctgcctgggaaaacgcaagcacgattcgcgaaacactctcgagagcggtacaacggttcgcgttcacccaagccgtgcagacatctgtatataacgctccctttgctcaggctcgttcgcctccgctagcttgcctgggatccgcatcaatggcgccctcctcaaacctcacccaggccgcgcgcgccgtccacaagttcaacgtcaatggctactcggccacgaaagccatggccaaacacgagcatgtctcttccaagcgtctcaccgtggccgggtatgcgtgggagatccactacaccccaggccacgatgcgcactggcactactgggtcgccttcaagctcgtcttcctcggcatcggcgagcaggcgcagcgcgccggcggcgacgacgacgacaacgacgctggcgccatcaaggcgtagctcagctgctgcctggtgcacccgtcgaccacgcgctcccatgcttccgaggagaagagcgacagtcgcacgcgttcgggtccgcgaacgagagctcgccgtgggttctgctcgtgaagcggagggagctggaggcgtcgggtttcatcaccggcgactccttcgccgtgcgctgcaccatcacggtgctcagcaagaacaccatcaactcggccgagccgtcccccgaccttcacctgcagctcggtgagctgctgcggagcgggagattcgccgacgtcgagttcatcgtttccggcgtgtccatcgcggcgcacaggtgcgtgctcgccgcgaggtcgccgtccctcgccgccgccgtcctgaaaggtggcacgaggaagaaggatgggtcggtgcgcgttgaggtcaaggacgacatgagagccggcgtcttcagggcgctgctccatttcatctacaccgacacgttgatggagctcgactggagagaggatggttctgatcccctgctgccgaggacgatggtgatgagcttgaatgaagccgcgggtcggtatgggctggagaggctcaagcagatttgcgagaatatgcttggatttgacgatgcttgtagtgcagattgtgctgtcatgtaacgcatgctctgcatgctgccaaccgttgagaactcttttcttatcgttgtttgctacttcgtcacgagtcacgacgagcaacgaaccttagatctgtgactcgcgagttgtgaacttgtgatgggtgtgctaatgcagtgcacaatctgtgcttttatttacatccgacatgtactcgtgtatggagtactggatttgagataatgaaaatggattacatctccagcttctatcataagacacacagtcataagtttaataataaaaaagggtaaagataaaattaaaattaaaatgagaaataaggcgatgagacaaatctccaacttctctttattatggactagcgttaaaccacataatgttctttagctagcaattctaatggaactacgccacctatagtggaataagagactattggctaccgatttcaaaagtgtagcactgtcgacgggtgatacccgtagaccggatatagagggtattggggtacgctggtacaaagatctacgtagtacgacatcgagcaatcaaaagacaagaattatactggtttaggccccttgacaggtaatagccctaatccagttgatgtgggattatatggtggaaaacacaggttacaaaggaaaagatgaaacttgtcagatccggcgagattgtagtcgagttgattcgactagctctcggcgacttggctcctcgcaggctccggcttcttagactgtgtggattctgagattcgatgatctatgcccttctcggggggtcccttttatatgacaggtctggtactctccgagtaggactcgaagataccagacctagcacgatacgtaggtaacccagttcttgtccgagaaggactttttcccgtctattgatttcgtgaaaggtttccttagatcataaaggaaatatccgcgtgcgcgtgggtatgccatgtcgatacgtatcgtatatcgaagggtagggggtatgcctgacccgtaaccctgacagtagcctccgacttttgctcaaaaacgaactcatgcgaccattcgcgacttcgggcgtctagaacgttatcattccgggtgcgagaatcgcggagttgatgtgtagtcgagcatcccgtttgaagcccaacagtcacgagtgaattttgaactgaagtccaaaaactgccgcgcgtaatagacttagaaatttccagcggggatttctctcagttccttggaattcgcaccgttgggggtgcgcttatttaaagggattttgggtgcacgttttgaagtccgccaactccgtcaaacacaccacctgttagcactcctcaccttctccgctgccgtaaagaaccctagcttcgccagctctaggtccatctccggcgatctttcagcagcgatgaatctcggcaagtcggcttccaccagcgcgaccctaaagaagctccaggaggacggcgcccttcctggccgtgaaaaggcggagaggaaagcaggaggtactaatcctcagcccatcttaggtcgcatggttgcgatcgaagattatgttgttgttaacgaccaaatttggtaaattctatcactattggcatcggagatgaagatcagatcgaagtggaatccaagatgaagatcgttgcggagacagagtaaaaattggctgcagtctaaatcagctaaggtcaggatcggcagagttcgagttggacggggctagccgatacagctgattccgataatatgacccggtgaacgtcatcgggtttaagttgatgtgcttcaaggtgattgccatgcatggatagagtcctgggaaggcaattgtatctattaattaggatattctatgtaatttccttagagatatgtttgggcaaaaagtctgccgtaaagacttatggtatcttagagtttgctagagataatagtcgtgtccgttatggacgtatcttgtaattctcgtgtataaatagacccgagccctatataaaaaagagataacacatccaatacaatctcggcgcatcgccacccttttttgctttacttttatttcgacgagttcgtgctctcgggttgagctacatcggtttcgatcttcaacaaagaggtaaaacttgtcatgacgacttatgttctcaggattagtgcttccatctttatgacactctaatcttgtctatataattcgtcgagttatcatatatctcatatagtcttcgataatatctttatctaacctataatcggctaacatctgctaatggaaggcagccgattaggttatacaatgacgttaacttagattatgtgatatatctaccactctataaaacttccagcggcttgattatctagatattgttcttcttttcatacttaatgctgcatcagttgagtttgatctattaagtcgtgcttagaattgcaatctctagcctgctttctggttgccaattagggtaatatcggagtttcagccgatcttatctgatttaactaattttattttatatgcttgattgatacgttaaatctgccctttatgttaagattttattgcatctaagtatattaagcttatgtttggtatattctacttgctttaatatcttagtatagagtggtatcggagtattagccgatacatgctagatttacctgatcagctatgttatgaatgtatataatcctactattaatatatatttcaatctaagtgatttatactgtctcggcaaggcgaccgatctatcccaatcacttgatttaagtatatactgatataaggattatatatcattaatgtctacagttgatcgagtagatttagttctgaattgcttattgatatttgccgatcgatgtacgcatgacatcggcttgaaataaatgatatgtcatcagcacctagccgatcggctatcatttataggattaattgcagcctctttgatctatcgcttgttgattgcaggatcaaataactggcacactaatacatccgaaggcgatcttttgacctgcactggagttaaacggatttcccaggcctcgtgttttatatcaacagttgtctgcaggtttctccctccaccctccgaattccttctgctggttttgaatttctatgggctttctcttctgcatttgaaccccaattccattgctttccttagcgtctttgtgcatctttgcgaggcctacattggggtagagccctttcttgatctgttccgcttttactacgagttgcgctggatggaatccaatagggtatccggttgcgtcgggttccgacttcgtgatggcatgaagtcgcattatgtccccttccaatgtccctcttctcgcaacaaatggcggaacaggtggttttaccttgaaatcaaggattcaaatccggtcctcgttgttcccgaggaacaaccggacaagattccggtctggaccgccaaaccctccttgaccccctctctccaaccgtttatcgacatcatcgatgatctccgagaacagggcttattgggatatgaagtcgttgcagacttcatcggtaggcgaatccagccgctccaggctcgggcccatccggcttatgactattccgggccagacgacgcgacctgggtttctcctcggggtatctttctcgcattcatttagacatgcttgtactcgcgttactcttcaacttatcaaaaattgattcctttttgacaggtctgagcagcgaagccgtggagcagtgtgttggtcaggtgatgatcagcggcccgaccacggcgagcgacatccccgcacccctttgtgaaaagggtgcgacggagcgcgacgaagcaatcaatgtgagttcattcgatagcgtcccgccttctctgctcgaaatcagcttatgatatgatttagcgtaggcccttcctttgactgatgtcgtcggaccgctcgcggatcatcaggtggcggcatctctgaaggagaaggtcgtcaaggaggcgtctgacgctgctaccaccagtgatggcaaagctccgaccaaggcgaggaaattctcgtatgtgctcggacatcgccgcaaggcagcgactccctcggtaatttcacctcgtcgctatgttgtgtagcaaggaaggtttattctcactccacattggttgtcttgcaggcttccgacgcgtctcctccacctccgcgacgttagcgcattgtgacgatcggcgagaagttagtaaacagacttttggattctcgtgtcttctattcaaatggagttttgattcgtggttatttgtagggaggcgcgggcgaaggctgcgcgggccaaatccagaggaacgtccagcgcatcccctgccacggtgtcgacagatgtcgtgcccgtggtcgggagtcgggaggcgacgccaagcggccctgttagcgatcccgctgagggtcgtagtctggcagaggccgtcctcacctaggaagagctccaagtcgaaatggggcgccttctcgaagctggtgctcgcggcaccggccgcgagatctcagaggcgagggtggagacggcggtggcaaacgcgcgtgccgagcggttggtgcgggaactggctgaggcctgtgaggacctcacgaagatgagggagctggtggccgggaacgagcgccaacgcaaagggctcgaggaccgcatgtcggaacttggagacaatctctctgagatccgtggttcgctgcgggtcacctacaccggccttcaccagctcgccgaggagtgcggcgtcaagtccacgatcccggtgaaccccgacgagttcttgttgacttcttctcttgcggagctggcgacggtgataggggaaatcccctccaagcattcggccaggatcgcggaggagacgtccaacggtatctacaccggggcgtgtcacatcctcgcgtgtgtaaggttgtcgcgccctgaactcgatctgcgtgatatcttggatcagggggcggcaagcgacacgcgtaaggaggtgatg

SEQ ID NO: 46385 - DNA, 15460 bp, Oryza sativa
agtcactagcgataattccggtacttgagtttgaaccacgcgtctcacatgacgtcgaggaccaaactcttgatgtggaggtcgagatggggacaaccacctcaagtgagtagcctttttaacccgtgttgggttagtggtttccaggttgtcttagtggtcgttatgtttagcagatctcgaggatgcccttgcaacccaagatcgtcgtatccaatattagaagacaaaatttgaagtggcggaactctcgagaaccatgctagccgtgaagaaagagcaagccatggaaacgctccgaggacgcgaggtgtggtttgcgtcatatttaaagagttgctgtacctcaatggcccgggtatgcggggagcttcgagtagtccgcaacactcctgaggaatcggcgaccgggtacatctcgtggctcaacggggcctgtgcccaactcgatggcatcggcaggcgtatcgatgaggccttgaaacaagagtgtcgtcgagcgagtcgatatgccggaggacatgtgctagcttgcctgcgagatcaccgcccgcgcctggatctcgaattcctccatgaagggtttgctcgttctcggaggactccggcggagatagaccaccttgcgaggtcgatgacgccgttagccgagaaggtattccagtctatggactggcattggccctcttggtaatactcgtggcctgctatagatgtcttaggaaaaagtgtaatgtagtgggagatctatgtaaaaaacaagtaagaattattatgtgaataaagaaatattccttaaacaaatgcatcttactctggatgttatgtgttagagtgtgttcttagttaacgacctcggctgtttgagtcgtacactctccctagcccccagccttgtcgtcggagaaattttcttggatgataaggctcttggacacttgatctgcctaggttgaataagctctgatcctagcccccagccgtgaagttggaaagctcggtttccgattacacggcttggttaatacgcacggcgagaactcttacacgaccagatcttacatggtctttcgtctctgaaggatctgacaaggccttatcggttctgggcatccccagccgaagatcccttaggttcctcggaggccttgtcgagacggcgtaaagggtcataaggatatgtttcaacgttaggtgttatcagagtaagggatcgtcgagtgaaaacactttggtcgtggtatgaaacctagaaataggctttattgatactgtaagggtgcttacaggtacggtgttattgactcatacatagaatttacgtagttggtcaatgttccacgaatttgctaattcgcgaccgtcgccgtctgcgattttgaatgcgcctggccgcaagacttgtgtgatcgtgtagggtccttcccattttggtgagagtttgttttgccctgcttgggtttgaactcgtcagaggacatagtcgccgatcgaaagtatgcgtgctcggatacgcttctcgtgataacagcggagggcttgttgatagctagctgctcgaacagcaactcgctcacgatgctcctcgagaaggtttacatcaatgtctcgctgttcctcgtcggaatgcttctgtactcgtgtactttgatgtcgtaactcgccagagagcatggcttcagacccgtacacgaggaagaagggtgtttccttgttggatgttgtcggtgtggtgcgtacggccaatagtactgatgggagttcttcaacccattttttgtcatgtgacatgagtctgtcgtagacgcgggtttttatcccttgtagtactatgccgtttaccctttcgacttgtccattgctttgagggtgagagaccgaggcaaaacatattttgactcccaaaccgatgcagtaatcctggaagtcggcgctgatgaattgagagccgttgtcggttatgatgtggtgcggtagtccgtatctgcagtatatccctctgatgaacttaatggcgttgtcggccttgatttccccagtgggtagtgcttcgatccatttggtgaatttgtcgatcgccacaaataggaatctatagccgccctgtcctcgtgggaatggcccaagtatatctagcccccagcacgagaacggccaagtcagagggattgtctggagcgcttgtgcaggtagctttgtgtgcttgctgtggaattgacaggcttcacatcgctggaccatgtcgcatgcatctttaagggcggttggccagaaaaacccttgtcgaaaggccttgccgactaatgtccgaccggcggcgtgtgacccgcatatgccttcatgtatgtcgaagaggagttgtctgctgtcgtcggtagagacgcatttgagaagtatcccgtttggcgcttttttgtataaatcgttaccgaccatacagtagatctttgctttacgggttattttctcggcctctgtgtcgtcctcgggcaattcctcgctgctgatgaatttgattaatggggtacgccagtcgtctgtggtttcgatgtcagcaacgtcacgttctgcctcggtgacctccgagctaatgttgggggtgctcgggccagactcaccgttaacttctttcaccgatggcttcgtcaggacgttgagaaaggtgccggggtcgagcggttctcgtctggatgcgcgtcgtgctaggtcgtctggctcgacgttgtccttgcgatagacgtgtcggacctcgatcccgtcgaacctcttctctagcttcctgacctctgcaagatacttggataactcggggttggagcatttgtagtctttgtgcacctggtttgcgactagctcagagtctcctttgacgattagtcgcttggccccaagtgcggctgcagctcgtatcccggcgagtagtccttcgtattctgcagtattattggttgccctgaagttgaggtggattgcgtgcttgaattgatctccggagggagatgtcaagataaatcctgcccctgctccttggctgttgagtgcgccatcaaacgctattgtccatgtctcattgtcgccttggttgtctgacttgttatctggcatggtccaatcggccacgaagtcggcgagtacctgagatttgatggctgttcgcgacacaaagtggatatcaaattggcttagctcgactacccatttcgcgatgcggccgacaacgtctttgtttctcacaacttcgctgaggggaaggaggagacaactgtgactctgtgggcttgaaagtagtggcgtagcttccttgatgtcatgatgactgcgtagagcagtttttgaatctgtgggtatcttgtctttgcatcatggagagcttcgctgacgtaataaactggtcgatgtactttctctctctcgactacaatgacagtgctaacggaatatggcgtagcggcaatataaaggaataattcttcattaggttggggagcaacgagtacaggtgggtttgataggtagcgcttgagtgcaataaatgcctcttcggcttcccgtgtccatacaaatttgtcttgtttcttcaacaaagcgaagaaaggctgtcctcgttctcccatcctagtgacgaatctgcttaatgctgccatgtatccggttagcttttgtacctccttgagtcttgtgggcgacttcatgttctcgattgctttgatcttctcgggatttgcctctattcctctaccagaaacaaggaatccgagtagcttgcccgacggtactccgaatgtgcacttctctgaattgagcatgaggcgatatcgtcggaggttgtcgaacgtttcccgcaggtcgtcaatcaatgagtcacttgtcttggtcttgacaacgatgtcgtcaacgtaagcctcgacattgttgccaagctggttgctaagtgcgccctggaccgtgcgctggaaagtgttcccggcggttattagtccgaaaggcatcttaacgtagcaaaataccccgaacggcgtgatgaacgctgtcttctcctcgtcctcttttgccatgctgatttggtggtagccagagtaagcgtcaaggaagcttaatagctcgcagccggctgttgaatccaccaactgatcaattcgagggagaggaaagtgatccttggggcacgccttgttgaggtctgtgaaatcgacacacattctccattttccgttggccttcctcaccatgactgggttggctagccacgctggatgaagtacttctttgatgaagccagctttgagaagtttgtcgagctcttctcgtatggcttgttttcggtctggtgcaaatctccgcagtctttgctttactagcttggcatcgggtcacaccataagtttgtgctcaatcacctccctggggacccccggcatgtcggacggctgccaagcaaacacgtcggcattatcgcggatgaaggtgatgagcgcgagttcctatttctcatctagtgtagccccgattttgacagtcttgtcggggttagcactggagagcggaacgatcttgatggtgccgtccggcttcggcgccttgtttggcttgctcactttctccggtggctcagacgtggcgggtggggtgggcgtttgttcgaccatgtcgaggctccgcctgtcgcactgcaccgccagctttgcgttcccctaaatagtgattgttcccttcggtcccggcatcttgagcacttgatatgcgtagtgggatgcggccatgaacttcgcaagtgcagttcttccgatgatggcgttgtaagctgtatcgaattcagcgacatcgaaggtgatctgctctgttcggaagttgttggcttggccgaaggtcatgggcaacgtaatcttgcccagaggtctggacgatgattggggagtaattccatggaagggttgatcggttggtgtcaacgcactttgcggaattgccattgcatctagagtgctggcgaagaggagattgatcgagctgccaccgtcgatgagaactcgcgctaccgtgacgttccgaatagtgggttcgaccacaatcggatatcgtcctgggataacagaggtcttggggtggtcttcatccgagaactctatcctctgctcagaccacttcatcttgggtgcagccccctgccatgtcgaacagacttcacgttccgctttcttgtattcccgcttggaggagtacgttgtggagccgccgaagatgtgtgagacgtggaggtcggagtctgggtacgcagaatccgattcgtgagaagatgtctcctcgttcttctcgataacacgtactcgcttgccttttttgaacgccatgtgcttctcgagcgactttttgaaaacaaggcaatcctccagagaatgtctgtccgttttgtgtatggggcatcatgatttctttgtatcgctgccttgtgggtctgggcgcttgggagggttcacgtattctgctgcgaggacttccgcttgagctttccttttcccgtttttgcgatttttcttcttatttgactcagaggcgtctgcggctggtttcttctctcccccagtcttcggcttgtcgttcttgcgtcttagcgcgtcatccacatgggcgcaccgctcaacaatctcgaataatcttcgagtagttgtgatgcgtcttgtcgccaactcctgggtagtgtagcgatctctaccaccggacttgaaggcgcgaattacagaagcgtcgataatttcgggaattgtgtttctgcactcgttaaagcgccaaacgtattccctcaatgattcccccgagttctgtgttagcgtgtgtaagtcgtcgttgatcgcgtggcgcttgtatgttccttggaaattggcgatgaactgttgccacaggtctgcccacgaagagattgagtagggaggaagatgcatcagccatgaacgtgcagaacccttcaacgcagttggtaaatagttcgccaatgcgttgtcatctgctccggcagcataaagcactatcgagtagacttgaaggaattcttcggggtcggtgctcccatcatacttttcaatggccccgggtcggaatctctcaggccatcggacatcacgtagggaacgaccgaaagccctacacccagcgctggggcggtgggttgtcggcggtcgcgtgaccttcgtggatgtctgtctgacgatgaagaggacgcggatgatgacgatgacgatgggtcgcttggctccggcgtacgattacgaggatgatgacctggatcccgagaatcttgttgttgtctctcgttgttatctcggcgccgatctccttcgtcgtcgtcgttgcggcgacggccatgactagtattgtctggcccccgccgttcgcgatcgttgcattctcggtcctcgtttgggcggtttcctcgatcatggcgccatgaagaaacatgacgccgagagcgatttgcgtcgtcccgtgtgcgccgtgcttctcggcgattgttaatttgatctcgaagatcgccagtgccacgaggtggaggggtagcctgtcgaggcaattccctccgctccggatcttcaccattggcgtcgccgattggtggctgatcttggtgtgctgcggtagcagcctctttgaacgcattgctgaggttagtcaccgactcccgtaatcattctgtccaacgctcgaggtcgtcgttcagaacgggatcgtaaggagtttccctcagtatagcttgaatagccctgatgtgctggactagagtagtcgattgattcgccgcttctgcgttggcttgcgctgacgtgccaacgtcatcgataactaatacctcccgcggcgcacttgttgtcgatgacccgtagtcttcgaggggatgtaagaccgatggttcgtgaggatcgagatcgattaccccaacgaatcgatctgaggctggagtcgctccctgttccttgccgttatccctagcggggacgtatgacttaggagacggggttttcatggcgccgaggagaactttgcagctcgagagatcgtgattctttgtcttgtggataggacaatagacatcccgagtcggagaaatacattgaattccacgttctttgcaggcgcgaatttcagcacggacgttgatgaatacccagcaatcttgaagggtatgtttcttggttttgtggataggacaccaagacctgatagcttcggaagtcatctttgtcggcccgtgatttatgtcggtgggacaagacttggccgcatcagaatccttcccgagtttggatgtagtcggtaatccgttctccgtttcaacgggtggatttttcgacatggagccgtcttggtttgtggccactgcgttctcgttttcagtcattggaggaccggttgagattggcatcgtggtgtaaaccgggaagacgatttcaccgacttgagtccataccaacattgttgaagttgagaatgcttggctggagctggtgttgacattgttatcgacgaagcttgatggcatagtagtagaaccttgagtaccaagtccccctacctggcgcgccactgtcgacgggtgatacccgtagaccagatatagagggtattggggtacgctggtacaaggatctacgtagtacgacatcgagcaatcaaaagacaagaattatactggttcaggccccttgacaggtaatagccctaatccagttgatgtgggattatatggtggaaaacacaggttacaaaggaaaagatggaacttgtcagatccggcgagattgtagtcgagtcgattcgactagctctcgacgacttggctcctcataggctccggcttcgtaggctgtgtggattctgagattcgatgatctatgccctccccggggggtcccttttatatcgcaagtctggtactctccgagtaggactcgaacatatcagacctagcacgatacgtaggtaacccagttcttgtccgaaaaggactttttcccgtatattgatttcgtgaaaggtttccttagatcataaaggaaatatccgcatgcgcgtgggtatgccatgtcgatacgtatcgtatatcgaagggtaggggatatgcctgacccgtaaccctgacaagcaccattgtgcatagtatcatgctctttctgtggtaacatcgtaaatcaaaagtggagccagtaggaagacatgaagataagctgtatagggttagatagttatttaccattaaaactttatcattacaacaatgttaaattgaccaacatacaacactagctctaattataatcatctttttgatggacctagaaacccctctaagctaattacaaaaatatttttgtcgttacggtgtggagggatattaatatggagtattagattactagagcaacggcgaataattcgctcgtgtgttcgaaaagtcgtgggttgttcttgacttcttgccagtgctgttgtacatctcaatccatacatacatagctgtgttcgacactctttttcccgacccaaacagtgtacatggaaaatggaccgcacacgtgattaattaagtattaatttgattttttaagcaacttttatataaaaactttttttaaaaaaaagcactgcttagcagtttgaaaaacatacacgtgaaaaacgaggggaggggtttagagtgtaaacgctgcattggtcgatcatgccacaagtggggaatcaatttctatcctgcactgaagccatcggtcaaattatccaaattaattaaagagggaactcggtctgatgaattcgcctgttcatttccggaagcgctacccgaggagccatcgaacgatcgactagctcactttaatgaacgacaccgatatagtataagagtagatacaatagcagactataagtcagctgcaaatatattttaaagagataaataaatagaaagaaaagcagtgagctataaatttatagccagctatagcacggactccaagatgcagtgtgtgtatgacaggtaggactagatattaatagtgtagtatgtaaatattgtatgaataagctcttaaattggctatagatgaattggaggactatgctattaaacttgctctaatacaaaagcactcagctactgaagaaaaacaattccactcgcttcctcacctagccctctctccacgatacgtccagtccagccatacgattcgatcgatcgccatgggaaagctcaccgacgtgacacgctccaacgacatccagctcaagatcgtgggccactccttgacaatggccatggacgacggcgagttcttcagttccaggcggtattgcgtcggcggacacgactgggagatccgcctgcggccgaaggatccctgggttggcaggcgcgaccggccgctcacgctcaagctcgtcctgcgcggcgcgccccgcacaggcagcggcagtgtgaaggcccagctaagctgctgcttggtagatccgacgcagaagctgaggccgtcggagatgaagaccgtgtcgcataagttccacaagcccggtgactactcgccccgtgccgtgttcatggcaagggacgagctggaggcgtcgggctatctcacagacgattcctacgtcgttcagtgcgccatcaccgtgctccgagaacagccggagatagccgcggcggcggcagcggcgggcgacagcgcgaatgcagccgtggcgccgtcgtccgagttgcacgcgtaccttggcgccctcctggagagcaagaccggcgccgacgtcacgttcgtcgtgtccggcgagtcgttcgccgcgcacaaggctatactggcctcgaggtcgccggttttcatggccgagctgttcggggcgatgaaggtgaaggcctcggagcgcgtcgaggtcaaggacatggaggcgccggtcttcaaagccattcttcacttcgtctacactgacaccgttccagagctcgaccaccgtgatggcgaggagacggaggcagcgtcgacggcgacggcgatggcgcagcatctgctcgccggcgccgacaggtacgggctggagaggctcaagctcatctgcgagagcaagctcgccgagcgcatcgacgtcgacacggtgtcgaccacgttggcgttggcggagcagcacgactgctcgcatctgaaggccaagtgcgtcgagttcattgctgccggcacggctgaaaaccttgatgctgtgttggccactgatgggttcaaacatctggaggcgagctgtccctcggtgttgactgaccttgtcaaggttgcccgtggaagaaagaattaaaatgcaggtacgtgcgtatcagagatgtcatagctgaactgttctattgtgaaattttctctaggatttggcaatgcatcatctctgtttgtgctagaagttttgattgattcttcccagtcatggagtagtgcatactttgtacaagcccattatttgtcactactcactagtactagctagtattaccttggtcattcttgtatttttctcacgtgttagtacaatactactactgcactgcagaaatatgcttctgcgtttcaagcctttcaggctatgagaacatgcctgttgccactagtaatcagtacgtttatttttcagaaacatttctttaagcaggagaacctgttttttttttttcagaatcatcactagcttcgctctgttcttaatatttatttatgggccatttggcatctgagcaaaaattttcctattgtgcaggtaataagcagagaagatttcaagttgctcctggatgctggcgatgagctgctgcggacttgctgagagcaaacaaatcttcaatttgcttatatgtttgctctatccttttcttttgtgattttgccattggatctgttgtgtgatgcccatgatcatacggttctcttctgcagtgggcaattcgtagtaattagacgcaaccctgtctaatccctctgctactctgtctgtgtagggcctttcatttcagtttaatctgtaattgaaacgggtatatcccggttcagaaaaacatattggagtagttctcgccttcaaagaatcaaatccctctggggaaaatagattgacatttaggaatggagaggcacaatgcagtgatcagttttcaggctcattgccggtcagttgtggcagggagatctgaaacaatgatagaccttggttctgaaaattttgtgctaaaacttgttttgttgcaaaacctgattttgcacagttgaactgctgactcaggatcaaatttattccatttctcatttctcataaagaaatttgctcttcaatgtacgatggagtttattttcctttgaacctgcataataatataccggtacgtgttaatgacagcagattggacacagcaggtcttgaactcttgatgaacgaaacatccccggcccaaccgaggatcacgcggcccacatcaaggattcggccgacgcgatgtccacgtcatcgctggctgccacgacagtatggattggacaagctcaaattttatttttcaatgttcaatggaggtttttttttcttttttcagaaaacctagacaacggtatcctgttggaacgggatactcttctataagacatacctgttgtggtaccagctacatagtacccgataactgtgatacctgttacccaacacctgtaatacctaggatctgatacctatgatactcgtgcaagagaataattaatatgtctatcctgttgcaacgggatcccgtagcagccctctccttttttgggctcagaacctccacagatacctgtccgtttgtagaatcccataagaattcgtcgacactgcggcggtgcaatatcattgcaaatctccggctcgtctaaaagttcagttcatcaaggggacaaattaaaaggagaaaaaacgaaaaattagttggatgttcattgaaatttttagggattgatggtttagcccttgttgtttaccttgtttccgaaacatttgtatatttctggtttgcttttgcgaactatacctgttattaattgtagatggtgggtactaaaacagactcctgtaacaagttatgtctctttgtaaatctagtgataaaacgtttcgatttgaaatccacgaagggatatatatatagccggtagttaacgctcgatcgacgcctgagcccagagacatggagaacgccgccatcaacctcacgcaggcggcgcggcgcgtgtagctgctcaggatcaacgggtactcggcgaccgcgaacaggcaaaatttggtcacgtcgtgtacgatcgccgtgggcggatacgactggctgatcgaggtcttcccggccgcttactaccacggcaccagctcccgcaactccggcccctacataaagctgcgcttcaccttgtcgagcgacggcgagcgcaccgtgtcggcgacgttcagatgccgccttgtcgatgatcatcagatcaatcaaaccgccgcgtccgcatccagctctttcaaggaggtgatagtgacatccatcttctccaatggccaaccaaaggacatgttcttggtgtcgaggagctatgcgtctgaatacagatacgtccaaccagacgactccttgctgatcgagtgcgcgatcaccgttctgctcgaagcaccagtgaacgcggcggcaagcgttccggcgcctctctccgacctgcagaagcacctcggcgagatgctgacgagcaagaatggcgccgacatcacgttcctcgtctccggcgagcctgtcgcggcgcacaggtgcgtgctcgccgcgaggtcgccggtgttcatggccgagctgttcggcgacatgaaggagaaagactcgcagagcatcgagatcaaggacatggaggcagaggtcttcaggaccctgctccacttcatctacaccgacactttgccggagcaagatgacgacgacgtcgaggctgaaacaatggcgtatggtcttctcgaagccgcggatcggtacggcgtggagaggctgatgctgatctgcgcggagaaggtgcacgctggcattagcgtggacaccgccgcgatggcgttggctctggcggagcgccatggatgtaccaagctcaaggctaggtgcatcgagttcatcttggcttctcaggagaatttccacgcagtcgctgcaacggagggttacaagcttctcatggatagctgcccctctgctctgaatgaccttctagtggctgtttttctgaggtacaaattaactgttctgtaaccggaacatgtacgggatagaacaacgttcctagatagagttgagtattgcgagctcgagatttgaagaagaaaatagtgaattttcccaattacaatactccatcagttttaatttatttattgttctagcatttaactttttttaaaaaaaatatttatctttctcgcatttcaaatcatttttactttggcccgttctaactttataaagatacatatttttttctcgttttccgttggcacgcttttcaaaccgttaaacggtgtattttatgcgaaaaatttctatatatgtgacctttcctcatgttattgattagggtcgcagactcgtaatgcgtactccctttcatattgtttattagggtcgcagactcgcaatgcatactccgtttcatattgaaaaaacattttgactttttttaagtcatactgctatttatgtctcattagttttttctataaatttagtcaaactaaaagaagttgacttttagaaaaaacacgatataaaaaggagggagatagggaatagatcagacaaagcaaacaattgtaggataatttctcaggatatgaaaatcactaggatgcttgatgtagtgagagcatgtctaatgtataatttctcaagagtgtaaaggtgggatccacttgtgtcatagcaactatagatgaaaagtccatcaacgtataaaatccaccattgatcatatagttcacaacatataagatagcttctttgttggtttagcggtaactggtctggtgttaggtttctcttaggttttatataggcactatcgggcttggtgtggtggtggtggtttttttctttcctggttaatgttttacagggtgctagccttgcaatttttgaacctaagaaatcaaccatatgccagcaatttttgacagaaaagtgaagtagagacttctagctaaatattgtggctaagtggcttactcaaagtactttaagttggcaagtcaaatattaaagtaatggagtatatgttagtcaaacttacttaactgaagtgctactacgaattaaacacgtctatatcttactctagtggataatttattttaatggttactagaaaggcatgcccaaagccatcaatctgttataaaaggagtataatttgttataaaaagagtatgttataggtagcttctttgttagtctagtgatgagttttgtgttagttttcttctaggttttgtatagacgctgctcgggtggttatttttcttttcttttctgattaatattttatatgatgttagtctagtaattttttttaactcaatcacttgctgccattattcaacagttttctattgagatctatcccgtaaataaatcatggcaccgtctcatattagttgttaatgaaaaaaattgttcaaaactccagtacaatctgagtcgtccactcgtccataccagaacaaatcctttcatccaaaacccacggcgccgaaagcgtaaaccccgaaaggtccaaaacctttgacgtgcagtgggacccacatttcgtctggctccacatgccactggcacacgtatcaaggagcctgacaggtggcacaactgcaggcaacgacgatataaagaaaagcccagcaccttcccgtgccttcctcgtatccaaactctcctttaccccaatctcgtgagcggcgacgaactttgccaccgatttcgatccttttttttggcaggtaaatcttacctcatctcccctgatcgctccgatttatggattgcaaggccgtcgtgcgaatttttgagattttcggggtcggatttggtgcagcgtgtagtgacgcgagagagaaatggcgagcaagaggagcgtgggcaccctgacggagtcggatctgaaggggaagaaggtgttcctccgcgccgatctgaacgtgccgctggatgacagccagaagatcaccgacgacacccgcatccgcgcgtcggttcccaccatcaagttcttgatggggaagggcgccaaggtcatcctggccagccatctggtgaggattactacgttgctataatgtgtttgagcatgaggttgtgtgatatgtgagattggtggtccgttttggatgatgtgacatgctatataaacagtatcgattt

SEQ ID NO: 46386 - DNA, 1927 bp, Oryza sativa
tgattcttcaaagggtgataggttcacagtgaattttaagtggtaactatgtgcagattcatggttacgataggaggttaaggtgcgaatataaatttaatactgtatttttagactgattacagtgagcgatgatttcacagagtaatgttttgagtgatcttttatttatcttgcgattttactaccagaatgtggcatttgttacttaattgtgttgttattatgtatatctaattttgatacaaatacctattaatggtttccatcaatgcccaacacttgcttgcaagaggcacaattcccttttacaaaatcactgtaatgcaccacggtttctttaaactttggttctcctatgttgtgtaagtcaaatgcaaaatccacctctgtaacattttggttatagaaagagccacatgtttaaagtgcagtagtcctcaaaaatccccatgccatataattgggttatgttaaaatggcaaatgaaactgaaattgtatgttcaaaaaagggcagcagctaaccgtgtttctatgcttgggataatgttctttcgcccccctttttgttttctcttgtcctctgttgtaatgcaatcaattttgtcttttcagggtcgcccaaaaggtgtaaccccgaagtacagcttgaagcctcttgttccgcgcttgtctgagcttcttggtgttgatgtatgctataaaaggataaatcatatttattattctgcaattctgcttactacaaactggtagaccatcttatatttccatgttttgatgatgtccttgtcgtaggttgtgatggccaatgactgcatcggtgaggaagtccagaaattggctgccactttaccagatggtggtgttctgcttctagaaaatgttcggttctacaaggaggaagagaaaaatgaccctgaattcgccaataagctggcatctgttgctgacctttatgtaaatgatgcctttggcacagcacacagagctcatgcttcaacagagggagttacgaagtatttgagaccttctgttgctggtttcctcatgcagaaggtattgcacaagtttccttactttgtgcattgctcaagattttcaccatctgaactgttttgacataactgtttggtgaacataatttcgtttggtgtttacttactgatatactccatttagaacaatgaaactccttcaagttgcaagcagcagatggcttgcagcagtacttgagtgacaagttgcaagacatgttgaaatcaactacattctttttgccaaattgcatattgtcttttaaattgtatccgcaatgaattcaagctgtttttccttgagattttttgaaatatgtaatccttttaaaattttgtagtaactgtcctcaccaatctaggaacttgactatcttgttggagctgttgccaaccccaaaaaaccatttgctgccattgttggtggatccaaggtgtcaacaaagattggggtgattgagagtcttttggcaaaggttgacatcctcatactgggtggtggtatgatctatacattttacaaggctcagggatacgctgttggaaaatctcttgtggaggaagacaagctcgaattggctacctcgcttattgaaaaagccaagtcaaagggagtctccctattgcttccaactgatattgtagtagctgataagtttgctgcggatgcagagagcaaggtttgttcattacctcgtgaatggcactgcataagaatttcatttcactgcatcatacaatcatagttgaatatatgaaaatggtttttcagtagcacaacattgtaaatgtgaacttgctgccatggcaatgttcttttgaagtagtcattcataaatcatggcttaaattcactgcgtcatatgccaaatatctgcgggctgcagg

SEQ ID NO: 46387 - DNA, 1052 bp, Oryza sativa
caggtttttgtgtttgaagctaaatgtgttcttaatcaattcaggcaattgccaagaaattggctgatatcaccgccaaaggtgttacaacgatcattggaggtggcgattctgttgctgctgtcgagaaggccgggttggcggacaagatgagccacatttcaacgggaggtggcgcgagcttggaactgttggaaggcaagaccctcccaggagtccttgctcttaatgacgcataagactggtggcaagcatatgacgcaatttccctagccttttgcggtggtcttgttcggaccttggtgtaagtttgtaagaatgcaaagtcagtcgtctgctacctttgaacttgaaataggcttcgcttcaggtattgctagatgacagtgaataataataagcttttggcgtcctcggcatgagagaaatgcccggcacaaacaaactataatggtgtactatattttgccatattctagttgcagcagtttacactaagctataatatcgctcttgctgttatgaatgagacctgtacatgttgtgtatggagacaaatgccactgtgcatactgttttaagccttctcaggtgaagcttctgggctgccagtttggttttgggcgttggtatgttgctttcagattctatgtatcatccaaagctaactttgtgaatagaacttgatgatgaattcgttgcaattagatgtcatggaacgtgaggatggctagctgtttctcaagaccttttctgccattagttttctgcagtaggcttttccaatgtgcaagatactggaccgaaacctggcacgatctgtgtcgctgttaatcacaaatagaagaatcttatcatatgttgtcagagttaatgcagcatggacgctgcatggcctttcggaggcaaggatcacatttgcacatgtagatgtgttacgctaacctgtgacgatattatggtcgtgtcccccaggctacatgcccatgtgttcaccgacatctcttcacgcttcgactgtactactgctattaagttttggttgataaaaa

SEQ ID NO: 46388 - DNA, 9813 bp, Oryza sativa
atgtacaatagtagtgcacacaacagatggaccctgttgatctggcaaaaccttaggatcatgactatctgagctactgcatccgatgtcctggaaagatgtccttaagtcagctaggtaactttgtcagtgaatcacatagatctgtgtctatatcaattgaagagcaagcaaagcatcaataccttcatttgcttagaagatgttattagctttttcaagctactggacttcttctttccttttcgagaaccaccgctgatcttttcaacatctttctttttggcagcctttggtgcttcatccccaatgagttcaagatttatactttccgttgacaccaccatgagaattcctcgtaatttcatgagtatatggtcagcaacagtaccagctgacattaatttagtgaaaaagattgcatcaccactacggttagaaatattgctcttcaagtacactatctcctgaaccagcatcagcctttgcaattctttcacgaaaatgggattcttcttacaagacagtgtgcttggaacatcaagacaacaaggtcgattccttctgaaaaaagactgccgtgtgctttcataataagtctctgcaacaaatgactctggttcacctaagcagaaactgaatttctcgctagaagcaatatatgttccttcaatgatctcattagcctgcaaacttaagctattagcatattaggtgtgcctaagccatagcaacttaaccaacttaactactaccaacttatgtgattttcttgccaaattataatcagtatgtaaaacaagcctgaacaccaatacaccacatcaaatggctaggtcagcaacaaagttcatatagtaacaataacaattgtttgattcattagttataacaagtctagtaagggcacatttgttgcaaaaaggaagattaattatcaatccacgtgtataatggaacagaataagtccaaaaggtttcaacttgttatgctatatctaggtgagaattgtgggtacatcaagtcatacaggccaaaagtaacctacttgtgttagcttggtagtaactataacataaaagcaatcctataaagacaaacaaaatatctgactcaacaaaacttcaaaatcatctttatcagaaacaaacaccaataagacgtcattatttgatatgatttttagagaccaacctttttggggaaaaaatgatagagttgagcaaaagagttattcttttcttctatgtacgtacagtacataacaacaagaattccgtatatcatttccaacgccagtaaagcataactaatgcttagtttgatcacccattctttagatgatagcaaaaccttgaaatctttccatggaaagattcacagattttcccttctattcaatagcccattaaatcttcttactgacttaaaatcaaacctacattgtaaaagttagcattaacagtttaacacaaaccaaatcatcacttctttctttcccatgattccatgaaaactagggagcacacgtttctacagagttgtggagcgcatattcagcttgttttccaacaactgattttagaatagcataactatgcatcagtatctttgcaaatgttactttgatcacatatttgctttatttccgcaccacctttctcacaatcgttccttttacacacaaaaaatggcaaagctaactacccaaaatacaagcatcgatgctttcgacttccatagaagatacaactgagaaatggaagcactgcagtatcctaaatccatgaatgcaaattatttcaaaatgcagtacaagtaagcatattaccagtgctgtagtgcccttcccaaagaatgctcccatgatccttgctctcaccctcggctccagcctcatccaccaatccacataccctttctccctccagaacgcatttgctgccaatccagctttctccttgacacccttcccaaccctcaccgccttcctccccccacctccacctccaccacctccccccgccgccgcccacgacatccgcagcgcgatctccacccaatttgccacgaactcctcgatcacgtagtaccccttggccttcagccagggcagctcggggaactcctcccccaccattgccaccaggtccacctccccgtcaccgcataggaacctcccacccgagatctcgtccatggccgcgacgaaaccgtcgaggtcgccgaggagttcctccgcgaccgtgatcgcgtcgaggcgcgacgacgacgtgggggaggaagggaagaggaggaggtggtcgaagacgagcccctgcccgcgggatgcctccgcggcgcgggcgaggaggccgcgggagagccgcgagaggacggtgggcgccgccgccccctcctcggccaccgccgcggaagaaggggaaggaggatgcagcacgaagaaggaggagtggccgcgagcgcggaggcggcggagcatggagaggagcgcggcggccgcggcgggggtgaggagggaggtcgcggccgcggcgcggcagggcggggagagggaggcgagccaccggaggatcgcggcgcgcggggaggaggaggagggagggggaggggtcgcggcgtggtagagggagaggtgcgcggtgagggcgtcggcgagctgccgcgcggtgcgcggcgaggcggaggcggaggcggaggccatggtggtcgcgtggtcggaagtggggaggtgtgcggcttcgcctccggtggggttggtcgggacctgggaattgggggaggagggaggagtatggccagtgtgggctgggcctgcgttagaggtggccaaatgggccggtccaaaaggaccgcgcgcggcacggccggacctgtagcaggcacggcccggcacggcctgctacagtaacgggccgtgccggcacggcccgtttagccgtgccgtgcttgggccgctggccgagcacgcgggccggcacggcacggcccggctactgtagcgggccggcacggcacggcccggggcacggcccggcacggcacggcggcggcccgtcaggcgcggcaggcgggcggcggtccaatgggacggcgacacgtggcactaacggctatttgaccgttgaaatttgaaaataaccgttgggaggctaaaaaattcataaaaatttcaaaaaatctcaaatttcgccctataaatagggcatgaaccccagccatttctcctcatcccacactcctcatcttgtgctctcaagtgttttaagtgctctctttgttctcaagtgtgcatttttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggaggcgacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcattgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattctactctaacattgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttccttatacatttcctttcctttttttaaaaaaaaaaacactgtgcatgcactgtgggctggcggcctgccttcacgggccgccgtgccccgaacggcccgtgggccgcgggcgtgccgtgccggcacgggcacggcccggccatccacgggccgtgcttgggccggcggctcggcacgtgggccgacacggcacggcccgtttcatcagccgtgcctaacgggccgtgccgaaacgggccgtgccggacccgtgcccgtgccgtgccgggccgggccgcccgtttggccacctctagcctgcgtccgtagacgggggagagacatgtgaagctgtgtagctggcaggtggggccagtggggacgtgaggcaaaattcttttgcatttttcacctgttgttcgttattcctttttctagacttggattgatggttccaaatattttgcacttattttgtttttttactaggtgaaaccccgcgcattgctgcgggaatttcgtatgataacaaaaaaaaataacgtgtaagatagctagataatatcagattaagtaaattaatgtgatttatgataatttaaattcaaatagtatgtggaatggtgattcaaacgtaaaaggtaaggtggtatgattttatggaagaaaaaaaataggaagatagtttggaccgtagattaatcatctaaaggctacaaacaattgatgtgatatggcttaattagaggaaaaaaaggagaaagataatttggaccgtagattaatcatttaagcactaactaaataaggataaactatataagtatataggatatcataaaacataataaatatatacattgaaacattatgttaattatgttggacgataatttaacatgtttgtatttgaaaagctcttaaattataaaaactataaaaatatagcatgtttgcatgatgtttaaatgtgatgattgttagtggatgatgatgtggcattttgttaattagtggatgatgatgcggcatcttgttagtgaaagatgatgtgtcatctttacatgttaagcttaaggaattagtgggagataactttatagtaagataggattagaaacacggtacaaacatagacgcttattatagcgcacacacacttaccttacccttatgagcacctccggaagactggagcgatatatcttgagattgacgaagtcaccacgcgtaagtgcgagcatccatatcaaatctagaatttgaatccaagtggcctgggttcgtcaaaagaaacctaactagttgagttacgctcacttcgcttttgctttttgtttttttgttccttttctagaagattggtggttccaaattccaaatctagaattggcaccgtgaccgtccactaatctggtaacctagtccttgtgaacttctctcttatattaagatgggtgatcaactaattattagatgccagacttgagtaatttgtggctcaggccacgattttcattgtttgtggttcaggcttgaagagcgatcaaaaccaacgaagttgcaggtttgatagtgttgacaggttttggtacatttttggtagcacgaatgcacgatcaactaaccaatataaatttaacgccaacattaatcacatcaaaactgtgatcacagctcagatatgatccgttggacaaaatttgtcgttgcatgcaaaatatatcaggcaaaatttgtcgttgcatgcaaaatatatcagggacacaagcacaggaaaccaaacatgacagcgctatcattttgtccctgcatagttgatatattaaatgaagttgcattgacaataattgctgatgatgtaggagtactataaatgtgataaattgtcgaatttactaaggtcagattggaacatcaaaaaagtagtaattccatccaagccattaaaaagcacgcacaggattgcctgtgaaaggcacaccctttgtattctaccattgtacgagtccatcaccatgaattttcccggttaagaagtgattgcaagaaacctttttcagctaattacattttataattaaccaagagtaagttacatgtagtatgccaaaaaatccggccggcaaagtaaagttagtgtacaccaagaatcgaaaatatgaacatcttacagcatgttccattcctacaaaactagtgggatttaggcagggagagctgccggcgtggctgggggaacccggttctcgacagggatctccgtgaactcggagagaatcgccctgaactcgtcaccactcaatgtctccttctcaaggagcacctccacgatcttgtccatggcctcccggttgctcctgatctggctcaaagcgatctcgtaggcctcatcggacaaccgcttcacagcggtatcgatgtcctccgcgagcttctccgacatggagttccttgccatcatcctcatgatgacatcgccgctctgagctcctgagtccattagcgaccacggaccaatgtccgacataccgaatgtaaccaccatctgcagaagcattgtgaccccaggtgtaattagcaaaagaaagaaaggggaaggactaagaacagatgtttaatatatatgtaaatgctgtcagtttttctagcatgttattttgcagcaaatttatcctccagactggtttgtaagtcataaaaggtgcagaagcagaacagattacatagtctactgcttcaaagtttctgtagatcaattagcaaagttctagaatagaaatatagcgtacctgcttggctaggccagtaatttgctgcaagtcaccagcagctcctgtggtcacctcaggctccccaaaaatgatctcctcagcagcacgaccgccaaggccaccaacaattctggcgaacagttgttgcctggagatgagcgttgggtcgtccattggaatgaaccatgtgagaccacgagcttgacccctcgggatcaaagtaaccttttggacagggtcgtggccaggcgtcaaagttctacaaagaatacatttccagatatgaatagttgcacggaattttgatatgcaagtaataaacaaaagcacagttagcaaatatgcagattatctcttacccacaaattgcatgcccaacttcatggtaagcaacaagacttttgctcttcccatctgtcatcacagttccttccataccagccactattctgtcaattgaatcatcaatctcctttgaggaaattgctgtccgaccacgtcggcccgctaatatggctgcttcatttagaagatttgccaagtctgctccactaaagccaggtgttctcattgctatgacttcaagagagacatcagtatcgaacttcttgttgctaccgtgcaccttaagaatctctgtccttccgcgtacatcaggaacatcaacacttacctgtgcaacaagttaaaaggtatatccataatgttagcaaggttttggacatatgaggataacaaaattctaactttgagaacactcaaagataactcaagctcgaaaccaaaagcatccaaactgattgcgtgagtaagctacaaccaagaacgagtatttattggacttctagcctaaaaccacgtgagaacttcaataatacagaacaaaggtaaacgctatagctgaaacatttttacttaattgtgtcacaattgaatgagttaaaaactagaatacaacag

SEQ ID NO: 46389 - DNA, 2340 bp, Oryza sativa
ttgcttcatcgacaccagcaacatcatcaaatgtaacaccagtgttgggttccatctgaaacttggccctagattgaccaaaaccaaggggaaagccaggaccgttaggtccaccaaggccaccttgtgctcttcttgacagcaaaaatagaccaccaataaggataagtgggaaagccaagtttccgatcaggttgaacagaagagaaccagagtcctcctggttgctgtgtgcagcaaaatcgatattcttttccctcaacttctggagaagctcctggcttagaccaggaagctgcacacgaactctctgcacacggttgccgagctcaggagaaatagcctctacaatggcaatcgtgccattctcaaacaaatcaaccttcttcactctgtccttgtctagatactcaaggaacctcgagtaagacattctcgacgacgagacaccttgctcttcagcaagagctctcttagcacccaacaaggtgggaagcccgaccccgaggttcccaagcgcgagctttaggaacttccttctggcatcattagtcttgtgctcgagggaggcagtcacagaaactggcctctgtgcaacgccactcgaaggaagtgtcgagaagggaagcggcgtctttgcagcaaggctcatggatgttggagccatcttcgctcactgttaaaagtaatgaaagggagatcttgtcaatcatacaagtgttgtatggcagaaattgcttcatccgatacttcaactaagctaatcacttcatatcaatccaacttagctgtaactaacaagctgtcctaccgtaagtattcaagaacaaaggtacagcatctcttcacaatcacccctacaagtagaagctattgtaatcccttctcgaactacaaacagctacaaccatcatccccaaaccagtatgaaatccgaattcagtagctcaccgtagcttctacttgctgattaacctatcgattggaacgaacacgctaacgatctcagtcccaccatctttaccagtaaaaagctagaccagtactccaaattccgaaaagcatactggctaacaaacagaacatccgcatcgcatcagagaccaaacgccacacacttacacactggattcaagctagaaacagaaccagacgcacgcacccacgcacgcaagcgaaatcgtaaagggaagcactgaatccaaagcaaacgagcacgcacctgagtggatcggagcggggcgtggaggggagagggggggggggtgggccgaactaggaaggggagggaggagggagtggagtgtataaatagcccgacaccgacgaggagggtagcggcagattgatttttcctcctccgctcgcttggcctctctctctctctctccggtgcgcagttgcgtggggatttggggaggaagaggaggagagggggatgggggcgacgtggccgcctccgtgcccacagcgtcgataaggaagagatgagcccacttagacggaagccaaagcccatggagacgaagtgaaatatctctccgtcctggtgaaattggcaaatggctcgtattttttgcgtgccattttcgtagccagtggggttttcctccgatggcttgtagtgtcgtggctgctggactcacggctcacgcaagattggactgcttggaatcctggagatgtgaaggcgacacactggtcagagcatggcaatatgacatactaagttgctgccaacattagttattgggtaaacaaagccagagccgtccatttcccttgcacgacctgccgactgaatttttttcctcgtcgaatttacacatagtgtagaattttcttctatgatgatatactaatgattattctctatctgtaaggaatacgattacacaggcaaaactctgtagccaagatgcagaatggtaaagaattacaagcacatgtcaaactgtcaaccactcgtcggcaggatcagtttgctcaggatgtgggaaaacggtggagggatggatgcacacgatgttacagggcgtgaacaaaccaaggcaacctttgtgtttcactaatctgatgacgagatgcgccggatcttgcagaccagatgggcggtggggaggtcgagctggctgccgccgtcagacttgatgaggtcgcggacctggtctctcggggtggagatgcaggtgtggaaggtggcgaggaagggtgggatcggcatggacagcgccgagaggacgttgctcaggtactctatgtccgccgccagctgctgcgcgcctcggtcggtgatgtaatggatccctcgcagctgctccatgaacagcgcggtggcgc

SEQ ID NO: 46390 - DNA, 2118 bp, Oryza sativa
tacttgtgatacttgggaaattataggtcaaaaaataggttctatgccacatatgagtagcttaaaaaaatgcataatagaaaaggaaagctaaaaaagatctccgaatttcctataaaaccagataatctagcttaatactaccacctaagtttgcaatcaggctgttcaaacaaatcagagaaacatgtgataactctagtgttgtgacactagcaagataatttaaaaatatataacttgcctgttctagtacagtgaagagcttcttagacttgtctggtagatcggtgaggcgaatagctgcaatatcaagtgctgccctccctgtgataggcacttctgcattctcatcaccatttgctgcagttgatttatctaggctagaaccaaaaccagaaatagaaaagttggttccaatcctggcaagagtagcccttaaagaagcttcaaaaactgaggttctgctagttaggcaatcagcaactgtaagaatctgcaaagcaccctggacaatagaccattcttcctcttcagagacatcgaccaatcgttgtgcttcttttttctctagtcctgcttcctttttagaggaatcactatgtgcagtattatccaccccacatacaatcctaagggattttaaagtttcttgtaggtttgatatgtactgcagcataatgtcatctagagccaataccagttcatctgcctctgaaccaccagtaagactaatgcatctctcgacagctgcttcaagaagcactataatttgtgggatggattcctccattctacgaacagtttcactcagctctataccctgtgcacccacaccacgagcaatggccccacggatatctataccagccatctcagcagaaagtaaagcacgctccatttgcccatacctacatagcatgaaacaccactggctgagtactacagcaatagcaacaaaaaaaatctcaccaatgcagttaactgcatgcaacagaatttttcacaagttttttttttaccttgctttaaaagtctcatatggggaataaatagctttcaatgtattcagcagaactaaaagatctgactctgaaaataaatgttggatgttccgagcaaaagtgcccgtcatgttgtgcaggtcgatcagtgctccaagatgcttattctgcaatttggtactttttggcaagtcacctgataaaacatctagtatacctgggtacagaggacataaaatcaatttattgttacgaaagaagtacgcatatgtggcaaacaagtaatatccttttttaattgaacagagaaaaataaaacatgtaattcaatcatgaaattagtatagacatacaaaaatgaaataatacgagaagtttatgcattaccttttgcaacagatctagtttcaggaacagcatctccagttgctaggttgacacgagagacaaaacttgaattcaactcactcatggtttcaacaagtacttttgggactagtgatttgtattcttcagggaaagcagtcaggcaccttcagcattagcattgtagaacatccattaatttttggtggagcaaaaatattgtccgaatgcagctaaaagatgctgccaaaaactggcttctgtttacaagggcaaacattgctgattcagaacaaaagacaacagggtacaatgaacataccacttccattcttgttcaaggtaaagtagtgtctcatcatagaaatttggaagccagctagcaaatgagagactgtttatgctttctccaccatacttctccatctctacccgcttagctctctgttttagatcaaaatcttcccaaagtttctttagaggcttgacatggatcttagtatattgcacctccagtgacttgaatctgccaatacgtatcagtattccacgaagatcttgcacagcatcgaccttccaaccaaaatttgtaggctttagatgaaatagagatgcctgtactactgtttaacaaatataaatgagattagtaagaaaaaccttgcggttagaaagtgcatccaccaaacgaggttgaaccatgtcatctagccgttcttccaatacttcaagctgctttctcacatta

SEQ ID NO: 46391 - DNA, 5046 bp, Oryza sativa
cattagcgaactccgcaacctgaaagcaacttttatataagcaaaacaaatagcttctgcatataaactcagtgtactgtgcatgtttgtgtgagagagtacaatacctcaccaactgccgacaagcaatgtctcatggttgccagggtttctgcagcttttggaagatcaccactagaaaatacatcctcaacactttggctcaactgagctagtccagccgcatcctggcattccgaccaacaagctgttaaatctattaaaagataacctaccactgtgagtgaagcatttacttcagtaacatgcaccatagtccacatacaacttacctgtaatgttgcatacgccgcttccattcgttgtttcacagtatcaattcgtgctagtgcagttattgactctgcagatgaaccctcagcctgattgaagaaatcatcatcatcagtaatacagaatttatgaaatgtagatgggactgaatacctagttagttgatcatacatgcatatgtatgtcatatttcattcattaacacccagtattcagcattggccgttacaaagaaggaatcactcagtacccaaaaaaaaaagttctagtgctagcaaattcattccagtgtattctacaaaatgtcaagctaaatgttatgagaagataacgctacacgtaacaagaagtacatgctacaggagaaaatgttttgcttgtgatttgatgtagcatcctgacctatcacctatatgaactaaatgatataagtgacggtatcccattataatagactataggcatagttttatgggcatcactgaactgctggatttgaatgtcctctacagcatactcaaagtttacatgcacataactgcattgcataagtacacagcattataacatcccgacacatgcaaggattttgccaacagagctccagcttggttttgccaagcccacgcaaattctgacttcagtttcagttaacagagatgatcaaattaacatatcatttgataaaagcgtacagcgataaaattgacatgactaaatacagttctagttgtacgcactgttcaatgcaaagcgtacaaggataaaattgacatgaccaaatacagtacgtgagatccagatccaagtgaaaaaacggggggtactaaaagcggccagaggctgaatcatacgcataaatgaatcaaactaaaacctattgtgccaaattggttcaacatttgctcattcgcaccaactattatcgcaagttcgtaatcctccaaaatgatctgggtttcgcgtgatacacgtacaattgtgcacgagtgaactgtgagatccagatccaactagcaggcgagcgggggcgcacctgggagagcgactggaggacggaggcgagatgggaccggagcgagacggcgtcgtcgcggaggcggagcgcgtcgcggcaggcgagcgggacgcggcggagcgcgtcggcgctgtcccgctcgagcgcggccgcggcgtgctcggcggccgagcggaggcgctcctcggcgtcggcgaggaagcggtcgagcggctccgacgggtggcgcgcgtccagcgccgcgttgatccaccgcttcgggtcgaacccctccgccccgaactccgacgcgtccaccaccaccattttccgcctcccctcccactcgctgcgcctcctcctccgccgccgccgccgccgcggctcgccgtggacttgggcgagggagacgaggaggggtggctttgagttcgctggattgctactagtccttttgctaggtgggagagtcttccgtctccgcggctactcgtagctaacggccgccatgggagggatcacctcggtggagttcggagggggaaacgcctgccaaaatggcgtgttctcttgtgggagacggagtgtattttacagcggtttttcctccaaaatttatgtcttgttgtttccagccatcatgtttttattagtatcaaccaaaatataatttatatgtaaaacttttagatcagttctaattaacttaaaaataagcggctctatttaatgagcattttcggctgttgcttttgtgactgcaccatgatcgacacgaatagtgccgcactcactgtgcgtagctacaactgcaaccattgtagccggccagaagaacgctccctatagccttagttatggctgcaagcagcggcattacacccttaacaacaaaaaaatataagttaatacaaccatagccattagcagtgaacccgctaagaaaattaccgatggtccttatgctcatctaacttatgaagcaaccttctcatgtgttcgatttaacttagtaagggtgtcccacatggtataaatacataacttataactgtaaaaaaaaaatcaccagtattcaatgacctctgttgacccttactaggtactccctccattccatgaaaaaacgaatctagaataggatatgatattttatgtccaaattcatagtcttaagatgtgtcgcatccggtactaggttgttttttatgggatggaggggtacgccgctaacagccatgaattccgaataggaacatgctgaattcgggaaaaaaaaaaacaatcttggaagtggttaatattccgtagaaaataaatgtgatggaatatgattttagggtagagttttacatttctacttttatcagcttaaagaaaatgatgaaaatgacacctagaataatttaaaatgaagtttaaaaatttcaatttttaactgcaacctgtaaaccaaagagcaaatgatgagggtagaaatgaagatgcacttcagtttcagataaaatgaaaatgcatatcaattcagtattcggatacaaacaggtgccaagaaggtcgaaaatgtacattggggatgggttgtacaacagcagctatagaaccatagcgcaatcaataccagctgcaaactcaaacgaacttagatgaacacatatctcgactaggtcatagctttgaagatagtccacaacttcagagctcacatttcacaacagtggggcgccctagagactacacccgagtgccccactggtttattgtattattacctcaaatcagtcaacagtatctttaagcattacatgatcacacatatttacatacatgtatacaaagatgtacacatacaaaaacatttcgagccatgccccaccccgagggaaaaagaattgctgagcacacaaaactggctatctacatgaacatgattgatgagcaaaactagcctagggttagagcattattggaagctatacagatgccacggccacaacacgtgctagcgttggtaaactgccggatcagccgtccacaactccagtacaaagagaacacaagaacgtcttgtggaaacaactgaagcttcgtccgcatacaagcagttctccctcactcacttgttaccctggagtacgaaaagttgcttcagcaagatgggataaaatcagattacaagcacctagaaaacgagagtaactgaagtattacatgaacgggagatggcaactctgtggagatccaagattttccatgccttcagacttaattgggtccccaccagaattacatgatgacagcaagctcagctgcaatcaggtagagtcaaaatgtcaggacattgcactataacaaatcgaagtcaaatgcaagtgttgtgtagaacataaaatatgcccttattgacatagctaatgcatttcatatctgtagaaactatataccacgaaaccatgataataatatcctatttagttattcaggaaaaagaaaagttccgtataaagtttctatggctgttgtagccagcccaatcaggatcaaatcctgcaaagtaagtttgagaggacatggatgcggtcaacttgacactagatatccagaagaacacaggtggatgagagtaagcatgtggtaggcaactaatgcaatctgatcacagtaatcatgaaagtagccagtcaattgtttgttatttaaaacattattagctaccccaaacttcgaacacaaattcagctaacaagaaccctaaccacaataactagccaaaatggcaaaccttaacgctagtacagttcaaactctaaattactcataacatgtttagatagctacaagatgcataatatcagtggagaacaaatacaaaaacagaacaacttacatgtgccgcaaagttggggctagttaagttcatggacagatttctcatcagcagtagtacctgtcaatttgtcagatcaaccagtgttcattgcaagtgaaataaaatagttatgtgaagaaaaactagaagtaacaatggtacggttgtccataaaatagaagaacatgaattgatcgaaaccaatgcagtagaatggtgagacaacctatatatatattgatacaatgaattcctactgtgtttagcataaaatatacgaataacttctttcaaatgtggaaagttgcagcagatgattttttagttaagggtaagagctatgaatggaagagaatgcaaagtcttattttggccttactgaacaaagaaaggcttctaagaacaacaatagtgaagtgaaatgttagtatcactgaaacttttacagctgttctacaactggggccccataaatgcacatctgtctaacatttccgctacttcaaaattaagaatatctgtgttgggaaaaggatacgatataatcatagaacattcagaaactatatctcaaatctcaagaaacataccgtttcaacatcaattggatccatcgcctttaaagtctgcaaatgcccactagtatctggatcaaatatgcttcccagaaagctgtatacttgtgcaaaatctggcatagctgcatgtgtaaccagagaggaacaaaattataagaatatagtggaataaagcactgaagcctacctcaaggaatatttaacaatttaaatatgatataatatttcacaataagtaagtcaaggacttgttgcatgacaaaataaca

SEQ ID NO: 46392 - DNA, 8354 bp, Oryza sativa
  unsure (1)..(8354): unsure at all n locations
tggcgaaactgcacaagctaaataattccgattactacttcccaactagaaatagttgatggcaaaaaatattacaagactgaggctgctgagcagtacaaaccatttttagaggccttctgtggatatggatgagctgccttccgctttggcctgggtggaggcagatgttcacctgtaccatttttctgaaccttcaaaaagtatttttgtgcatggctccttatctgtcaaaagaacagctttttagattttgcagagagaaaccaaaatggtgtaggagcatttcattttaattggcacaaaaaaaacatcttttaaacttgtaggatactaatatgcattttgaacttccagaatatggtcatactcccaaccgttcagcatagggtagttgtgcctgctaatgagcacttactatatttcaagtttgcaaatgtaatttaacttcgcgctcgagaagtgtaatccaagttgatttgacttgaaactatatttgaactaggtgcatagattacagttgcacagaaatgcctgtttctttttaaaaaaagaaggaaagtgaaattccaaggcttcaagcatagcgcttcaattttcatatcaggcataagattctataagtcaataaaatgacaacaattaacagacagaatacaatggtgtgtttcaaataatatgtggcgtgcataaatttcaaatgatgtgtgacactgccaaccagatacatatagaacgcctcaaatcaaacatcaacacgccactccaaaggctagcagagaagaatgaaaacgttaacttgaaaggtagctatgaaccatacctgtatcacagtttttgagccaacgtatgcttcaatctttttccaatcacgatcgaacctaaatcaaacaaaagaaaaggaagcacatttaagaggtgtgtacacaacattgaccaccctaattacaattaatcaacaagaaaattttagcgatcaaataaattatacagaaaagtcaccctaacagccatgtgtatgatatgtagctagttaagttcgaaaagtttagcagtaaccagcaacattaagagatataagtcttataaaataaacaggcccacgttaattcaaattacaagttcaataagattaccactactgttgtatgttcccacactgtcaatatctgtcaatcctctaataataatgttagatctcaaaggttaatagtgataacaaaccagcacatccacattttagaactattttttctctgaattattccaagatgcaccctttaccgtgtccaatcctaccatgcagaaacaaccaacaagagacattaacagaaacctttctactgaaaacatctcgatccaacctatccccactactgtcatgttttcctttggttagcctatagagatcagcctagtgcaaaggaaaactggtctgaatgaatacccacactgtccagcgtttcaaataactggttacataatagtaatactaagatgcaagactgctggaagcctatggcacaaacttggtatgctcgagaaagctaacagttcaggtaacctattagaattcctgacaagtatgatattggaagttcaaagcttgcaacaactctggccaatctgcttcacataaaggactgtttcaggatgaaaactgttatctgtcgcctgctaacaaaaatcatcaagtgatcccttgcatttggatctatcgagcaaaacaaccacactatatgcttattaacaggtgggtattctaacatttgatatcattgcatattgctctttcccttatttataaccttttcaatttctgtacaggttgtaccacctatatccctttatttcttttttggtttagccctacatggcattttgtagcacattttaacttccattaatacaatgtttatcaggtagagcgacctctatcatcccacataaaaaaggaagcaatgaaatgcttgttttaaactaccatcagatgctaattgagttcaggaaaaataaatattgtaaccctaacatgcaggaaattctataaccactggtacatttagataataccaacagcactcttcccaacattaaacccagcaacttggttcacaaatccaaggatcagaatatcataaacctccctactcctacagctacaacgagattgtacttcctccgtccaaaaataaaccaacttttgtaaatgaatatagacatagcctatgtccatattcacatacaaaagttggttcattttcggacggagggagtagacatgaaagaagcacgcctgtcaagctactggcccctactgaacgcatggattctagcaccgtaattcagttaaaagatcaatcgaaaatcaaaacatcatagtctacccaaaatgtgagacctagaaggtagtgcctcccaaccacgactgctcagctcaacagattcgaccacccaattcgacccagcaggctaaacctatcctcaattgaatacctcctccaaaaaaagccgtctttcaaactacccagggttagcattcgcaggaggagcagatgcacaatcgcatccaaactccacaacgacacagacgccaccatacaagattaaaaaaaaaaagcagcacgaaagccgccaaactatccccaaccacggggggcgcgccgcgcgcgcgcagagataagagggagagcgagagacgggggcagaattgggggcactcacagctgcagcgcctcgaggaacttgtcgtgctcgggctccgtccagctctccctcgacttggtgatggtgtacggcttcctcaccttcctcgcctcctcccccaccgccgccgccggtgcaggcacggccatcggcggctgcagcggcgcagccaccacctgcttctccttctccttccctcctcctccccctcccccatccccacctcccccgccgcccgcgacggcggcggcggcggagacgacggaggcatcgatcggattgggcgtcgcgctcatcgaaaccatcagccggggtctctctcgcgcgcgcaggattcgccgcggccgcgagctagggtttgggtgcttgtgctgctggtgtgcgtgcgtgtcgatgcgggggacgaagcgaagagaaaataagaatgcgaaacgcgacgctgtgctgtgcgcgatgtggatgtttctttatacttcggggcgcttcgttgctggccacaagaggggggtgaggctgacgtggagggcccacgtgtcagtagagagaggggtggagttggttgggtttgggttgggttttgtgcaggtctggcacgtcccacgtagtgtcacacggaatgatttgtttgtgctgctgcggtggaacgtgtcctgtgtggtacagtgcaggttggttgactactctgtgtagcgttttttctcttccctcggaggcaggcctgggttgttcatgggccggccaaaacaaggccataattgggcctaaattttgggcccaaaactaaacaacatgcaagattggttgaagtctgagaagtttgtgagaaatgcggcgccatcgtttttgcttatcatgggaataagccaaatggcatatttgtaaacggaaaataatttgtgaatatttttttatatgtgtattcttagtgatctaaaagcaaaggctggaaaataaacttcgacaaaacaactccaaatttaagttgaaaattttatttttggctaataagtataagcataagcgaaaagataatgccgatgatttttctacgtgaccctcttttgtattgcttcaagtttgtgagattcttactatgaatgaatttatatatgaaataaaagttatttttatctatgatataaacaaaatgtctcgtctctaacaaaacaaatgtctcaattactttgatctaccatcggctcaacttttaaggatttctagcgttaacgttctctttgtttaaacttataatccaaagcaaaaaaataggtttttcgtttggcttttcaaagttataacttataagtcactcttacactattaagccacaaactaaattggagaagttttttttaatgtaaagtagatgtataacttcacccttaaacttaaaactttatccaccgacttatagatcattgaaaaaaagacttaaaagcctaaaaaaaaggccataagaaaatccaactaaaaataagcgagttaaagttatgtcaaacaaaacacgctatctctgtgtggagtagcactagtacagatagcttacaagttagtaatctgtaattcaccattattttctcttcaaactgtcaacaaaacacgcagcctctgttcaattcagaactactccgtataagctggtacaaaactgggtctcgattgcctgcgagtagtaactttttcctatttccagaagtttggcatatagtagaaagttgctgtcggtcacccgcaccgtcctctactcctctcaacgtcagatactaagattaggccccgtttacttcgcgaaatgaaaatttttgggtgtcacatcggatgtttgaccggatatcgaaagggattttcggacatgaataaaaaaactaatttcataactcacatggaaaccgtgagaagaatcttttgagcctaattaatccgtcattagcacatgtgggttactatagcacttatggctaatcatggaataattaggctcaaaagattcgtctcgcaatttttcccctaactgtgcaattagtttttgtttttatctatatatataatgcttcatgcatttgtttaaagattcaatgtgatttttttgggaaaaactttctagaaactacacagggcctcaggcatgtgcaccatcagaaacttttcttggttgttgcatgaacagtactactttgaacacagcggaatggcagaaagtttcagtggcactcctgttgttgctagacagtgccagaaagtttcaggcaaaattaagcctgaagcttcttctccccacacaaaatcaatgcggttgatagcacagctcgatcggtctgaaagcgttcatgtccactgatgactcagcgatttctgaatcacctgaaatcctgaatataccttatggtcagactgcacgtagcaacattttgctgtgagctcactgctgaaattgctgatgtaccgagtacgacagtagtagaagggaaggggcatggagacagaccggtagatgcaagtgggtgatgagcattgaagatcttcagaacagtgaaaggacaaaatacaccaaaatcgccgcccaaactcaaattatcttatttctgaattttttaaccgcaaaaaaaaaagaatctaattagtacagtactaagcagattttttttaaaaaaaagagagaaaaaggtgatggtgcttgtgcggtgagtgagataagcactgggaagaaaaatactgtgcctgcctgacgataactcaactccaaggaggcagtgatatttttggattttttaaatatattcatcagtttggtggtcgacccacggaaataggtcatagaaaaacagcaaaaaggcatctttttgaggggtttggttacaatttcttctcccaatttaaaaaccaaaagaaaagggaagaggaaagggaatgaaagatggcctttctctctccttcgctctcatcagctcgagccccgacagcaagtgtgagctactgaactcgagaccctcctgtcgcgcggcgcggcgcggcgagagtggccttttgatccgacgaagctagtaagttccctcgctcatccgatcatctcgtccgatctgtgagctgggttgctgattgatcgtagttgggctccatgagcatcagggtttggccgacctgagtgatgaggctttgcttgttttcctgggtcttgggtggcttcttgcttttgattgttttgattggattgattttttctttctagattgatatctcaatctgatagatatctcttgggttcaattttcactgatgagtaaagatccccaggtggtcgtgttctgagttaggactgggtaggaaaaaaaaagcccctttagatggattcatccaagatccgattagttgatcggctaaatctgtttttggaatcagttggttacncaggtgaggttattggcaaaaaaaaagacggttactttggtccccaaatggtagggcatgtaaaagtttagcttatctgcgactaatctgctatgtggtgtgttcctttgtttctttattgtctggtcgatcagttcgattccttggaaagcactcattctgagtaccgttctaccaagtaccaacggatcacctcgattcgattaaaagcagtttatatttttcggattctaatatggagtaaaagaggttataggagttggaactttttagaggcagatcaattacactgaaagatacacactgatgattgtgttggagggaccctcctttggtttgcagttgtgaaaacacactgctgcttgcttcttatccagtccattatcggtagtcactttcataagccatttgctgattggaattggaatccgtgtccagaagatcctagtttttaggcattaattgtgatgagatgtaaggaattcaaacgtgatcgaaatatatccttacaggggttgttaagatctgtatacatttgctgtccaaaaattttaaaacataacggcatgtttccatcttagaacatgtgttgcagctcttaatatcaatcaggcaagaagtgcaatgtttttatcatcttgttggttgctacaagttgttttgaattttttcttatcatgcgaatgcatgttgctggactcctacaataattttctgctacttgttttctttgaagccttttatcagtctaagaccctgccaatgtccatttggagataggatgtcggaacagcaggatagtactagtaaaagctctagctcaagcatcagcagcagtacacaggagagcgaggaggaggtatctataacaataggtagcctcctcgcccaagcaaagaacaacagtgggcatagtcttggaaggcgcctctctcaattgggttcaatcccggtaatatacagtcatccatatttttctttgttccccccttggcatttgttcccttgaactcatcttgagctgtaccatgattaaatataggaattctctctcaattgtacataaatattccaatacagtactcaatataataactaatacgataattattacagtttttaactgcagattgttaaataaaaaaataaagttcttaatttacaatagtgtgccttcggctatgttttatgacaagttactaatgccctcatgtatggcagcacactcctcgagttaatggaaaaatccctaatcttgataatgcaactttggatcatgaaagattgtcggaaaggtaaaaaaaaaacagacctctctctctctctctagaacagtatggccattgcgctttcttatatttctcatttgtcctgatccttcttgacaggttgggaaattatggtttggccgagtttcaaatagagggtgatggaaattgtcaggtttgttttaccattgaacctaaatcatcatttcatttatagatacggtgccgcatcatctacactatttcagagtaacattttgaagcagctgttttttttttgtatttactgttttaaggctgctgccattatcttatactgaatagtgaataatagattggcctacattcttttgaagattaagtggcctgtgttgtttgatctttatagctgatactatgaggtgtttagtagaactacaccttcaccagtctgtacttaaacctgttcccttttcacttgatgccatattgttacagttccgagctttggcagaccagatatttcgcaaccccgattatcacaaacatgtgagaaagttagtcatgaaacaggtggatttcttgcctcaatcatgcactgtcatgaatatgcaactgtgctgaaacactatccctgtttttcagctaaaggaattcagaaaacagtatgaaagctatgtacctatggaatataaagtctacttgaagaaaatgaaaaggttataatccaccatccagagagtttttccattacttttggcctacttactcatacttcataaccatcaccttgcagatctggggaatggggggatcatctgactttacaagcagctgcagacagggtaatgttagctgttgtggtgttatgatggttgaatagtttgtgggaatacatctttttttaactgcaggtccccctttagacttttttttatgcagatatttctgattgtttttgaacgactgatctttctgattgttgaacttgttcat

SEQ ID NO: 46393 - DNA, 1137 bp, Oryza sativa
ttccttgtacgcaactgacggtgagtgtctttcttagactatatgaacatcgaattttcgcttatgattcttacatcattaaattctaacattccctaccatgatattttgcattgttagttctgaatgtgctcctgttatgtacaatgcagatctcctaacccgcaaaaccaagaagaagcattggttgttctagggcgtctcacctcgagcttccttgagcttctgctgctgcagttcttttcccttcaagttagcagcatctgtggtgcttactagttttactaccatggcaacccagccggcactgcaattccctaacctgaaagaagagcttatgtacagtttaactttcagtagtatgtttcgcaaggtacaaacctagaactgtgcaactttcagatccatgagtcccatgttctacccggcgagatgtagttttgtttttgcatagtatattgtgatctatccaggtgcttgctttgtaaaatcatcatgtgagctggctagattttttaccatatataagcttcagttgaattctcgaattccaaagatcgttttgctaaactgaagtctgaatttctcagtggtaaaaacaagcacagattcaacaccattggcaagcgttttgtgggatctctaaggtagtgtttggttggtgggatgggatgggatgggatgggacaaacccacttttagaggtgtttggttgaggggcgagtgggatgggttggtccctagagaggaatattcctcccagatccgggacaaatccatccggcaaaatcggccggacgagctcgtcccacttggatggagcacacggcgtctcctcggtgaccgccggcgctcgtccgcgcccgtgcccgccgcctcctccgtgaccgccggcgctccgccacgactgcctgccaccacctctgcgaccgccggcgctcctccacgaccccctgccttaacaccggtcgccgccgcgagcgagatgctcggcgccatcccgccgctcatcgtgatgctcgacgagagcggttgcggcagctgcggtgatgtcgacgcggcgggctcgagtggcggcgaagcttggaggtagggagggcggccgcggcggatccagagaagggggactcggcagcg

SEQ ID NO: 46394 - DNA, 5188 bp, Oryza sativa
  unsure (1)..(5188): unsure at all n locations
catcccatcccacttagtcccgaaaccaaacatatgctaagaaaatttttatcataagacacattttttttcgttgacattaatcagatcaaaattaaattactagttttctggcatttacgatagaacgctgcgaaatcacgtcactgccaacgggacaaatggggcgtgcgtgtccttgaatgttgcaatttgcaaatcaattttgacgcacttgataagcatatgtgtgagacgtgcacgcagcacgccgtaggtggcgcatgtggcatacgtgtttgcatgtccttttacatgtttaagaaacagtttcaacgtcattaatctacggaagcgtcctgtaggtggtcagaaataaaccgaaaaactataaggaataataattgaacattttttttcgtttatttagttttctttcttaagtgctcccttcgtttataattaatactataaaacacttaactttttttaacgaataagatgttaaatatttttaacgtagtttctttttaagtattgacttttaataatttttaataaattatttttattttctagtaaaccgttttgatttattacagaatatgagcaatcgatgatgatgacctaaattttagtcaagcctaaaatttaattaaagaaaaaaaattaaagtgtatagtactccacgctgtgttcggagtctagtgatgggagcgcgtgattaattaagtattagctatttttttaagcaaatttgattttttaagcaaatttgattagctattttaaaaaaatagattaatttgattttttaagcaactttcgtatagaaactttttgcaaaaaacgtatcgtttagtagtttgaaaagcgtgcgtgtggaaaacgagggagatgggctgggaacatagggatgcaaacacagcctatgaaatggaggagagagtactcaagggaaaaaaaaactagataaactcaggttgtagacttgtcgtacttcaccttggccgttcccaacttccatcttttacttccatccccttccctctgcactgcagcaacgcctgcgtggtttttctttgttttttccaacagaaattaatccggcttatatttttctcctgtgaataaaaaaaaaaccagaatctcgaagaaccgaagaaaaccaaaccgaaccgaagagtgcgtgagccattacgtcgtctacctcgcgccgctcacctctcgccgtcgtcgaagccacacgcgcgccacaatttcttttaatcctcggtgagacgagagcacgagacccatccccatcgatcccacatccacggcgctgacttctccagctccactccacgtctcccagcacgaggggaggagaagaatcaaatcaaatcaatcagtcgcaatcgaggggaatcccacaattctggacaatccgagaccctcccgctccgctggattccccgcctccccttcttggattgggctcagctgggatgattggattgccggtcgcggtttgagctgaggagattcttgcagtcgagggggggagggatggaggtgagcaaggaggagttcttgaggcagttcggtggcgactatggctacccgggcgcgcccaagggcgtcgacgagatgcgcgccgccgagttcaagcggcttgaaggtgcgcctaatctcgaccttgtcgattccctttttgccaaattctgggaggaaaaatggaattctattagtgttttgtgagaacaaaaggatggataggaacttgtggcgttcggtcagatgaccgcgtttcttgctgtaactcactgttgtatcgataaatctattaggtttgttgttgcggagagtgaagaatctagcatcctaccgaattttgctacataagcttcaacaattgtgcttgttttgatgtttggaactgcagtagtgtgagctgcaaactatgtaataagaattggctatagcttctatgaagcaaatccgggttgatttccattatatataaaaaaacaaatgtgcttgtatttgtagcaggtttctagatttttaattttctttctttcttgatcttgaggagcagggatggcttacctggaccatgccggtgcgacgctgtattcagaggcgcagatggcggatgtcttgaaagaccttgcatccaatgtatatgggaacccacgtatccttagactttgagacagtgttctggacacttcattgttgttaccttggtagaacattgcactgcagattcttggggatgtgttctttgacatgcttattagatagtcagagtgattcaagcatggctgcgagtgacctcgttactgctgcacgccatcaggtattgtgtgctagttttccagaacagttacttcgggagaatagtgaatttaggctgcctcatggcaatagtatttaagctctatcagtctatgccaatgctcagcattggcacattgcatgatgagtcatcctgcatccattttttttccattttacgccctagttattgctactttcttatctactactacgtacaatgatttgtgccccaggaagttgcatgaattgttttgattccaaggtactacaacagggtgcctgcacagctacatctttactatatccagttatgcgcatggtacaagttttgccatctgctaatttctttgtagtgatgttgacctgtttttcacaggttttaaaatacttcaatgcatctcccagagaatacaagtgcatatttacctctggggcaacagcagctctgaaacttgttggtgaatgttttccatggagtagagaaagctgttacatgtacacgatggagaatcacaatagtgtgcttgggataagagagtatcctaccacaaaacgtttctcagatcattataactctattatctgactagtcaaagcatacagaactatgcacatacatgcaaaactagtgggatatacagctggtttatgtacatagcttgatatcttgataccttcatcagtatgctcggtaatgtgttctgcattcaaacatgaggcaatgaatttctcctgggcagtttctcaaaattccatttattcctgtcagtctatgtgtaggatcatgaaattcacattggcacatagtatcttgtaaattttgtcttcccttagcaaatttctagatatgctctgagtaaaggagctactgtgttggccgttgatgttgaggagggtgctgatctggcaaaagacaatggaagttatagtttgtataagatttcaagacgcacaaaccaaagaagaagcaaagatgtgctttcacacaattgtcagaacggaagtctttcagatatttcaggtcagtcccttatgatttttatttttgtcctttacaattgctgaataacatattcttgatcaggttcaattattgatcaatattgtagaatttacacagagaatttgattgtcttatttccaatctgttaatgatgttttcagttttctctagctttcttttattctttatgagggagttaactgggaacacatttatcattcctggatttttccttaagaagtttgtttatttggtttattggtttgacatggtcatattgtatgaccatgcaatgtggaatgaacatggataactagaaatattgatagcaaaacttttggtttgctctcatttggaagattaattccagtgcgatgcttaatatttatgctcactccccattcatttcttctgtagggaacaattggaatatatttgcattcccgtcagaatgcaatttttcaggacaaaagttcagtctgagcttggttaagctcatcaaggaaggaaaaatcccattgcagcagcagtaagatgcattgaatttgtcttgcaggatcattgccttgttttccttggactctagtgtctttagcatgcttattaaatgcattaatataggggtaaatggatggttctgatagatgctgcaaaaggatgtgccactgaaccaccgaatttaactgtgtatcctgctgattttgttgtatgttccttctacaaggtaatccacatgcacctgttgtgttttgaaatgcttggtcctacagaagtcaccaattgatatcgatatctttggcaaacctgcagatatttggctatccaactggccttggtgctctaattgtaaaaaatggtatgcaactagcaattatcacttaacttagcatgatagttttttttttctttttacacatattataatctaagctacattggataggataagataaattaactaacaacagcaatctgtaaatcgttgccatcattattctttgcaagggaatgataacctttctaatgaccttttctatattttccattttatggcagaggctgctaatctgttgaacaagacatattttagtggaggtttgtggtcacagctcgttatacttggttttgagtaatctattttctatatcctggtttttaacttacctccggaattgttattaaattccaggaaccgtagctgcttcaattgctgacatcgactttgttcaaaaaagaaagaatatcgaacaggttctagaggatggaacaatctcgttcttgaacatagcttctctccgacatgggtttaagatcattgaaatgctcactacctctgcaattgaacggtacgtaagacagtttgggtcctagcaccctatccatgatgtatagtttacaccctgatgttcttttgtaggcatactacatcccttgctacttatgtgagaaacaaaatgctggacctgaagcacagtaatgagataaatgtttgcacaatatatggacaacagtattccaaggttccataactaagttatatctcattatatttctatcttcttattaagaattactgctgctttatttacttttcttccattggtttggattatttgtcatccatataagaacaagccattatgaataagatattctgaagtgcccacttgaattctgctagctctctgcacttatctattcttttctatgtattatgttttaggtggaaggtctgaaaatgggccctacaatcacattcaatctgaaaagagaatatggctcttggtttggataccgtgaggtggagnnnnnnnnnnnnnnnnnnnnnnnnnnnnnnnnnnnnnnnnnnnnnnnnnnnnnnnnnnnnnnnnnnnnnnn

SEQ ID NO: 46395 - DNA, 1047 bp, Oryza sativa
agcggccaatgggcaatgcttgcatttttttttcttttcagaaaatcacattctctgtagaatattgtcacagtgtcgaggacagcagttgcgctccctagatgtagttgaaaggatttatggctcctgtcgtgatgttgcctgagacacttaacagtacagatgtagaactgcagaagcaagttcagatgaactaacaatgtccctggagcattgtttttttgtgaaaatgtatatatagcagtgtagtaaatgtgtccgaggaggaaatgggggacaaaattgctcagagttccaattgagaatgtatcaacagttgtgagattagatagcaatatctcgtagtgtatcttatcctcaagtgcacacaaataagatgaccatgttcaagagataatgacaagtatatggctaatagtttaatcgttacaggaacaaagaacactgacctcctttctccatagtccatagaagttcgggcaaaggttgcatcatatagcccgtcagcttatagtgatgacctgctgagaaatcacagtcaaaaaagaactacagatcaacagctcgatggatcagaaacaaattgcatgacaaaacaagataacatcgatcagcaacctaccttaagacaattacgaacctgtgatcgaagactggagccccgatgagatggttttgctggtagtgagagagtgaagctgcaacatgatctgatcgatgaaattaaagacatggatgccttcaaaccgatcaaatccatacatagctcagaacaacgaatgcagatcgagatcagaactgcagtagcagctcctggctgaattcaatatattcagcagtgcaactcatggaccagatcatgctggcagcttcagcctctcacaccagcaagaactaatatcttctgaccaaagaaaaatgcgtgctcaaacgatacttctggcattgtgtcaatccatccatctatatgtatatcatcagtggcaatttcggtagggcagtgagacaaaatcttgcgagcgccatgcatggatggaggtcgactca

SEQ ID NO: 46396 - DNA, 2204 bp, Oryza sativa
  unsure (1)..(2204): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgttggagaagctagcatagcccacaggttcccttgattcctggagctggttcattcagagccagctgctccctaatcatcatcacttacattattctctttagcaaaaaacaaaaacaaacaaatgatactccatatatactactagtactagtagccatagtactgttgtagtagctacaaagagaggctcatgggttatccttgtgtttgaagccaaagaaagaaacttaatcagagacgaacaagccacaccaactttacactggtccccaagcccacatgggccaacgggaaaccacttcccactctcccactcccactccactgccccactcacctctactcctataaaatctcaccgtccacatgtacccgagacctcgaaccatccatccatctatccacccaaccactctctcgctcgctagctcatcgctcaccggccggttgagatggcggcggagggcaatgcgtcgtcgtcgtcgacggcgacgggaagggggtgcgggctggcgctggggaggttggtgaggaagctgaggaggcagagcaggatgatgctgtccacggcgacgtcgtcgcggccgccggcggcggcgaggtgccagtacgacccgctcagctacgcgcgcaacttcgaccggagtggcctcggcgacgacggcggcgacgtctccgcgcagctctaccaccgctacaccttcgcctcccgcttcgttctctcctcttcgtccacggccgctcgccggcagccgcaataggggccgagaccgatgctagctgaggcacgcatggccggtctgcgcgtgccagtgctgcgcgtagctaagctagctagcttagctctagccattagaggtagatgcactcttgttcttcatcctgcagtgttgttaattaattagtgtgttcatatgaggagggagtggtggttgtaagggatttcttccatggctctctccattggccgagatgatggtttcgatctctcgtgctgatttcttggaaatccatgcacattattcctgatataaatcgtcccattaattcctttttttcatgaaattctgaaattggctgattaaatcgccgagatcaagaaaaattggatgctcgccaactttgtagtagatgttgtgttgattgcatcattcaggctacaatagttgttacggcgtcgttgcgttgtcgctgcattctacagtagtcggtcactactactactcactagtgtcaccgctgcgccacagcgattattcgcacgggacccctgtgcccacgggtgacggtgccgaccaccggcgaggacgcgagatcgatcggtgctactagtaaataaaatttcacattttcactgctcctgcattgattcgaggagcggaagggctcgaagaaaaaagagaggaaaaatagagaagaacggttgctctgtgcagcaaatttccaacgacggaaagcaaagaacttttttttagaatcacagtataaacgtgtgcacacttaaccgtatgaatgtattaacatatatacactaattgacattatactcctactactagatttttcacgtacctgatcttgaggcccaatcgtttgccaaattgaaaacccaagtccaattataggccaggccctcttgaaggtgcagacttcagaggagactgcctgtttggggttaggctctactaatggcccattgtacttatcggcctatagcttttggcccagttctccatcgcataggctgaatatttctgcccaaagtatcacggtgatccaacaatgtaaaaaatcaagaaacaccacgagcgtaagtctcttcgctcgagaatttcgttacagccttacatacaggtagaccttcttcgacagtcaccaacatgaacacagacatgggttttttttcattgctccttccatgattactcgcttaattagtacgtcaacagaaataatttttttta

SEQ ID NO: 46397 - DNA, 1053 bp, Oryza sativa
attcagatacctaggaatccccatacactatcgaaaacctcagaaattctgattggaaatgtgtggaggataggtttcaaagaaaacttagcacatggaagggaaaaaataactcctatggtgggagattggttcttcttaactcggttctttcgagccttcccatgttcatgttatccttttttgaaatacctctagctgtacttcaaatactggattactaccgatcgagctttttctggagcagtgatagccagaaaaagaaatataggttagcaaaatgggattatatatgccggccaaaagatcaaggtggactgggtgtcctaaatcttgatatcatgaatagatgtttgttgagcaaatagctattcaagcttcttaatggtgatggcctatggcaaaaccttttgcgcaacaagtacttaaaaggtaaacccctctctcacatgtcacacaaaccaggaacatcccaattttggactggcctaatgaaagtaaaagatcaattttttcagtatggatcttttaaacctggtaatgggatagaaataagattttgggaagacacatggttaggcttgcaaccactcaaatatcaatatccttctctgtacaatgtggttcgaaagagacattctactttggcagaggttatgagcacaacaccgttgaatgttttattccgacgatcaattgtaggaccaaagttagttgagtggaatgatttgatttctcgactagctaacataaccctgtcaaatgaaaatgattgctttatttggtcgctacataaaaatggccatttttcggtcaaatccatgtataatgcgatcatcaattccaatgtaagaatccacaagaggatcttatgggaggtaaaggtactactaaaaatcaaagtatttatgtggttgcttcacaaaaaaagtaatcttaacaaaagataacctcataaagagaaaatggaggggaaacaagcaatgttgtttttgtaatacacaagagaccatccaacatcttttctttgactgtcatgttgcacgttttgct

SEQ ID NO: 46398 - DNA, 13929 bp, Oryza sativa
cgcaataggtgcatcgacctgattacagagccaaaataaaatgggaggtgaggatatacaatggagatagatcggtgtaaaaagtctgataagagaaaagtatagatgccatccaaaattagatgtatatgattgctacattatcattgtattcattttaaggcaaaaacagaaagtggatgttactgattttaagagccatagcacacgattggtccactaccatagtctgttaaaattaattgcattttgggccacatatttctaccaaaaattcactttgaaccactcttgaagtgcttttttaactttagattaggtatttttatcaaatgttattactttgaattgggtggcccacatgtcaataagactaaccacctctattgtctatgtgtctcttacatgcgggccacctggtcgaaacatttgacaacaatatttagttcaaagtgaaaaaaaacattataaaggtggtctaaagtaaaactttagtaagaatatgtagcccaaagtacaatttacttctaatttaatttatgttgacaaaattacatatatttaccaactaccatagctgcacttcttcaacatagtacacaatacattaagataatatcgtaaagggctcagtgactcaccgaaacatgtatagtaatcttttgagtttttttactagtgaagcccggtaccaaatgtggaccgctggataggtatgatcggatggctgacatcaattggtaccttcaggtaccatttactccctacgtggtacctgccaaaggggaatgaggtggaggggtaaaattgtatttgcacattggaaaggaatttcgtcgatttgattcgtgttttggataaggctttgcagaggaaaatctacggcagtggcggcgagccggcgacgcttcaggaattacggtgcgctccaccagtcttctgaggccacaacggtgctccaggagttgttgtcagcggcgacaacggcagcattccaggagttatcggcagtgacggcggtgctccagggatcatctgcaactgcggtggcagcgctccgataattgtcttcggcgacgacggcatcactccacgggtcattgctagcgacgacgatggttgatttggttgaacagtttttgagcaagaaagatacatacaggaataaattgagaagcaggaagttccccgcaaaaaaaaagagaagcatgaagttgatttgcctaaatggcttcaggttgatttgtcagacaaacacaaaatcaatactcatgcgaaaagctccaacacaacctccattccggaacaattatagggtgcagactacagcggcggtggcgacaaagtccggcgcgtcaggatacatgttgcggcagcgtcggccatcggccccactgtcgttgccgcagagcaaggacacgctggggctggggggaggacaggcagcagcgacggcggtgacagagacgtgcgcgacggagcgagctgaggaacgatgtcatgcgtcaaggagagcagaatgcgacggcagcggcgactcggatatgcctgtgaagatgaggagatttcgtcgtcgcacgctagctggctgctttacttcatttccaatcgtaccccagtttattgaacggccggatttcgtttggtacctgtggtaccagtacctggaggtaccaacttctggaccagaacaaagctcgttcctgcagcagcaatcacaagttcacaatccagtggatgaaaaagaaaagttagtcaaataagcaatcgaaaatttgagcaggagttcaaatttgttcccaatttgattacccaaggatgttgtctgcaataggtgcctagcaattcttcaaacttggcaagaagaaacttctctcgcttcacaaaggctgatctcaccgttgatatttctgacagggcttgtgtattcagtgggttttcagatgatgatctctttcttttcagtcctcggattggctgatgtccgtggatcatcgtgttcagcttctcccaatcaacgtcagagatcacgcagccggaggaaccgaaatctcgcgcgggtttcagccattggcgcaggcagtcgaggttctcgccggagagggagacgaggaatgacccgatcatggcgctctgggggtgatcggaagcctcgccggcggcggcgtaggggtttctcttcttctctctgctgctgttctgaagaatttcggtgaggtcgcattgcctggaccagaggtgttcgatcgcctcatgctccgagatcggcttgccggcggcggcggcggcggcgcggacggcggcgacaaggccgtccagtgaacggcattccacacggagcatggcgtcggtgtcaaagatgtctcccggtaggtcagcctcgtcgtcgggcggaggaggagcggcggcgtcgtaccagacggtgttgaggatgatgttggaggcggggtcgagagggccgtagcagtgcccggcggcgaggagggagcggatgaagcggccgcgccgccgcgtcgtcgtccaaccgtcgccggcggggagcacggcgagcgcccggatgtagaagccatggatggcgtcgaggaggcacatcttcagcgacagaatgtgctcgcatggggagaggtcgtagttcagcgctgcgccggcagcctcgtcgccgtcgtccgccgcgcgcgtcacacccgccaagcgtctggacagcttcgcctccatggtttcgcaatcgaacgtcaggtcggagatgtacccgagttgaggagagtcgatgcggcttgcgtctgcagcgatcgtgattagggcaacacggccatcttccccgatggtggttcgaagcgtcaccgtgccatcttggccgccgccgaggccgtacggacggcgcaagaagtctatgttgacctgcggccattgatgacctagcaagttcttgatgtccatgacgtcgccggcggtgagcagctcgctcccttgcagttaggccatgataggggagagctgaccggcggggaactgcgccgtcatgaggcgcgccagctcgtcgagcgcggggtgcgccgccttcagcgccgcgaccctgagcgcggccttgatcttgccgccgtcggggagcaagcgtgggcgctggcaccgacgacggcggtcgtggaggacgagcctgacggcgagggggaggtcgatcgtgggcggcgaggtggaggtagcgcctagcctgttcgtcggagatgtaccggaagtaggacgacatgaaggcgacgaggccggcgtaggagcgggcggcgaggataccccacagcgacttgccttcctcgcgagggagggcgaggtgcggcgccgcggccgccctgccggaggcgtggtgggcgatggcgttgaggatgatgttgccgacggggtcggcgaggccgaggcagtggccgccctcgaagatgcagccgacgagctccgtgatctcgtcgatcggcagccgccgcgccgcctcgtcgtacaacctcttgatcgacgtgatgatctttgcgctctcgtcggggtgaggccgcttcccctcctcgccatggtagcaggcgaagctgcccgtgcccgaccatggcggcgccaccaggtgatgatgggacgaggaggaagacgacgacatggagcccccacgagttggggattttctttcctccaagatttgctggtccaattagtttttttattattatttttgccctcgatccgacggttgctataaatcggtttaatgtggagaaaaaaaaagaccacttccttatatacttatctgtaccataatatcggatattatgaaccctcgactattaaaactagtcaacactgtcgtgtaaacgtcacgtaagcgaaaccgtcctccaaaaccaccgagaaagtcaaattacactcattttgatagttgagaggtcaatatatctggtcggtttaagaatacgaatcagattcgatgagtagttaagggagttaaagtgaacttattaaaaaaaaatctcggatgtttggttcaggggagggctgcctcctgcctgcattgggtttggctctaactagtgggccgttttagttatatagggctacaacttttggcccacttgtccaaccaagcccactaaaaattctgagttggcctactatgggctacgaccaggtcaagcaccctgtcactcacacaaaaagtcaattgtcaccagatgattgatgaaaaagtagagtaacgacatcctgtcgaccaggttgatacaagtgttccattgaaaagtcaacccgtcgatccagttgtcctgggacgaattgatggaatttaggccgccagcaagcaaagaccgagctgagcagctccagccgggtgttatcagggtcaaaacaatccaaatattttcaaaaatttcagttcgtttgacttggtttctggccgcgacgtctgctttctctcgcgtagcaagtggtcaacagaacagtaggttcctcgtttgactatcctatgtaatccaatattccctccaatgcattgctacactcattcggtcattcactatactttgtgtacggatttttatgtgaccagttgttccatcacggcaagggtacatgccagccgaacaccttagctaagtttggaatatcgtggcacactcccgcccatgcaaacctagtacaaataaagccccaacttcacacaacaaatttgcatactgaagaagataaaaaaaaaagttcgatagattcatcgctcatactagcaagcatggcaatgccagttggagttgcaccggtgttgttactgttgcttttgccattggcggcggcgacggcggcggcggagagtgacgacagggacgcgctgatggcgttcaaggccggcgtgacgtcggacccgaccggcgtgctccggtcgtggaacgagacggtgcacttctgccggtggccgggggtgaactgcacggcggggcgcgtcacgtcgctggacgtgtccatgggccgcctcgccggcgagctctcgccggccgtcgccaacctcacgcggctcgtggtgctcaacctcacctccaacgccttctccgggagcatccccggcggcctcggccggctccggcggatgcggtacctcagcctctgcgacaacgcgttcgccggcgagatacccgacgcgctccgcaactgcaccgccctcgccgtcgcgtacctcaacaacaacaacctcgtcggcggcgtcccacggtggctcggcgcgctgcccaacctcgccgtgctccggctcagccacaactcgctctccggccgcatcccgccgtcgctggcgaacctgacgaagatctttcggctcgagctcgaccagaaccttctggaaggttccatccccgacggcttgtcgcgcctcccggcgctcggcatgttagccttgtcgcagaacagcctcgccggagagatcccggtggggttcttcaacgtgacgtctctgcgtggcctcgcgctcgccgacaacgcgttccgcggtgagctcccgggcgacgcgggcgcgcgcacgccgaacctccagtacctcttcctcgggggcaacctcctctccggcccgatctcggcgtcgctgtctaacgccacggcgctggtggctctcagcctcgcgaacaacagcttcgccgggcaggtgcccggcgagatcggcacgctctgcccgctgtcgctggagctgtcgaacaaccagctcacggcgaccgacgacgccggcggcggctgggagttcatggacaacctgaccaactgcagcgccttggccgagatactcctcgacggcaacaagttcgccggcgtgatgccgccctccgtcgtccgcctctcgccgcagctcgaggcgctgaaccttgccggcaaccgcatatccggcgtaataccgccggagatcgagagcctcgtcgggctgcaaacgttgtgcctccagtccaatctcttctccggcgagatcccggaagcgatcggcaagctcaagaaccttcgagagctgctgctagagcagaacgaactggccgggccggtgccatccgccattggcgacctcacgcagctgctcaagctcgacctgagcggcaactcgctgaacggatcgattcctcccagccttggcaatctgcatcagctgacactgcttaacctctccggcaacgagctcaccggccatgtcccgagtgagctgttcaccctctcgtcgctgtcgctgctgatggacttgtcggacaaccagctggacggcccgatccctcccgacgtcggccagctcacgaagctcgcgttcatggcgttgtcggggaaccgcttctccggcgaggtgccgaccgagctggagagctgccagagcttggagttccttgatttggcccgcaacgtgttcgtcggaagcatcccgccatctctgagtgggctgaaagggctcaggaggctgaacctgacgggcaacaggttgtccgggagcattccgccggagctcggcgggatgccgggactgcaagagctgtacctctcgcggaacgacctgtccggcggcataccggcgagcctcgagaccatgagctcgctgatggagctcgacgtgtcctacaaccgtctcgccggccaggttccagtccacggcgtgttcgcgaacacgaccgggctgaggattgccgggaacaccgcgctctgcggcggcgcggcgcggctacggttgccgccatgtccggcgccgggcaactccacacgacgagctcatctcttcctcaagatcgctctgcctgtcgtcgcggcggccctttgcttcgccgtgatgttcgccttgctccggtggcgccgcaagatcaggagttcgagaaccggaaacgccgccgctcgcagcgtgctcaacggcaactactacccgagggtcacgtacgccgagctcgcgaaagccaccgacgacttcgccgacgccaacctcgtcggcgccgggaagtacgggtcggtgtacagggggaccctgtcactgaagacgaagggggagttcgcgcgcgaggacgccgtggtggccgtgaaggtgctcgacctccggcaagtcggagcttccaagacgttcatggcggaatgcgaggcgctgcgcagcgtcaagcaccggaacctgatcaacatcgtcacctgctgctccagcatcgacatggagggcaacgagttcagagctctggtgttcgacttcatgcccaactacagcctcgataggtggctgcatcgtgcgaagcatacggagaccgggaaatggtgcggcggtgccggcggcctgggcgtgatccagaggctcgacgtcgccgtcgacatcgccgacgcgctcaactacctccacaacagctgcaaccctccgatcatccactgcgatctcaagccgagcaacgttctcctcggcgaggacatgacggcctgcatcggcgacttcggcctcgccaagctccttcttgatccggccagccatggcgccgcggcggcgaacaccgagagcaccatcggcatacgcggcacgattgggtacgtcgcgccggagtacggcacgacggggatggtcacggcctccggcgacgtgtacagcttcgggataaccctcctcgagatcttctccgggaaggcgccgacggacggcgagctccgcgacggcctgacgctgccggagttcgtcgccggcgcgttcccggacaacatcgaggagatcctcgacgtggccctgctgctgcaggccgaggagctcgacggagcagcgtcgtcgacgacgtcggaggaggagagcgaggcgcgcgtcacggtgcgcgattgcttggcatccgccattagggtcgggctcagctgctcccggcgagctccctacgagaggatggccatgagcgtcgccgccgacgagatgcgcctcatcagagacgcttgccttcgtgcttgtggtaaataagtaggacagtatactgattatttgtagaactttgacagccgaattagtcgatggataattattactacgtcatcggcatcgaattctatcactattcgaggcttcgagcaagctgttgtggagtaaaaaaaatgaaaatgtaaaatccatggaattcaggagctctgatctcttgatttatctagtgtactgtactgacagaaaatggatgtactctgcatattcagatttcagaatagattgttctgtttatgtccagattccagaatataatgggcctgggaaattgatcagtaactgggcctaaataggcctttagactgaactagtcctgcctcttgtttatttggagtagtctttgtttcgcagtagttttttcttttcttttacctcttgtttttttttctttcttcccctccggcataggcctggccgattgtattgtataactaaaactctttttcttctaatatattgacgtgtaattctttcgcgcgtttgagaaaagaactagtggctattgctgattcatcctcttgctatcgccgttgctgaacaaagtgtgagagcataagaggaaaaaggagacgttgcgttgtcacttgccattgccagcgtgaaaccgttgaagatgcctcataaatgcgacggattaacagtttattagcacagcactggataaattggatatacgtgcatacgatggcgtccatggtttgcttgcttttgctgtggataagttggtcactactccactcactagctgcaaaaaagcaagggaaaaaaaaaaggtaattgcaatgtgctgcgtacgtgcgcaccctggatggtgatgtgcttgtttaccgtaggaggagcatttgcgaattcgttcttatcctagagaaattaatcgagccatttcacgctgtcaaggtatatatgatcgggtttcagagtttcagtgtgatttgccatttgccaacaaagcaacacctcaatgtaaatagcagtagcataaaaaaatggttcttttggattgtaaaaattttgcagattttaagtagctttataaaattgtataaaaaatatttatttttaaagaggtcggaaatgtcaaacactgagagagatcggtagcgcttgctgctgccgccgctgcggctgcgagagctaaaaatcagctacagcagcagctgaaaacggccacagtcgtgacggctgcagcagccagcagttccgatcaggcccaccgttttttgtcaagtgctgtaacagtgtactttgtgctgtaacagaaaattggctggttgtcaggtgctggttaaaaaggccaattttctgtcaagttctggtttgtgatttgtgatgctttggctattagttaccctacacaagtactccctacgcaacaaagaatggttaaggcatgagcccctactgtttgtgtaccaagtgacaataattggagctttcgatacaaacaatacttaaccaactaccttgtacggttcccatctgccgccattttccaactaactcgagctactacaactaataatcatcagtaacacgagctaattaaaagcatcttccagcacggcaggaggagcacacatccctcatcctctgacaccgacatgtggccccacaccacaggcacttgacctgtgtcggatccggacccgccaacccgccaggtgttccctccaatgggaggcgagctctccctcccaagagaatttaagaacagagagaggaagtggagagactacttcccccacctccgcctctctctcgatccatctcccccctctctcctctcctctctctctccgttcccaatctgcggaggcggaggcggagctagggcgcggcgtcgccggcgaggagttccgcaggcgcggtgtggacggggctcctctgcttccgcacacggcgggcggcgacggcgagcagggttggaggggcggcgcggcgacctcctcgttcctgccttgcctgcctccatctgggtatgaatcggacatcagtttttgtgtttccgaaatttcaaaaaatatatgcatgtcgggttggggggttcagctcgccacgttgggcaaagccgtccgtggtggtgtataagttattgctttccacatttgttaggaaaaaagtatgcgtgatttaatccgatggtagtttgactactaaaaatagtggtcgtctgatagctgtgtctccttggtcaaattgggggtcaaattgttgggatcattgtcgttaataagtgattgatcggtccaacagttaatccgtttgtgcttttgtttgcttgtacggaatctgaatcatgcattcacaagtttttgttatggaaaacagtagggggaaaaatcctatatgaagtatctgtttgttgaacagtaggaaatacgaccgtataattgtattgaagatcttgtgattttgaactgcccaagtatgccaacagtagagttggtagttttgcatatacaccgagtactaattttgcaaggctagtgttttctcccctgttctgagattatatccatgatcccatggcttatcttcatccattctgtgaagagcaattgcttcttgtctagaaacctttctacatttgctatcttggtatggacaaacttttgttgtaggaaccttaggttatgtctttactcggtaattgaaagttcacacaataatccagcattttgatcaaattaattagatcgttccaacatacttgaatttagtggccaaacataattgtttatatcggttatctcatggccacgttgttaaaaaccataacaatctccatgtacctctttttccatcaaagttcgttgagagtttatacataaatcagaaaatagtaaatatgagattgtaatgggaaggaattgtagctagcgatacacatttatccctataggtgatttctgccctagtgtattttgtaggttaagagagtcgatggattgtctacactagatttgtacaaagttttcttcagctgtaattcaattcaagtctataagaacagaacatgaattaaattttattgagaataatgccaaaattggcattgttagcaaaatcctctaactggaagtaatcaaataaaagtttctaatctcaagccctactaccccctaactcagtagggacccaacccaacattgcaacctccagctggactaattttccttgaagacaggctgataacttaagctaggctgaagagtacaagggccttgacacattcactagcccagtttaatgatattttttgggccttgacatattcactagcccagtttaatgatattttttgggccttgactgacataattttgagcatacctagcaggccaaatccttgtggggcttggtcaggttgggccacttgtgttatatctggtccatcgctacattcgtaacctagcataatttattagttagtttcagttgtcgcttgtcagaaaaaattgctcaggtcacaagtcccctgtgaaccaaaatgtttgagtcacgaaattgtcgatggcaaatttttatcctctgaaaaggtctagaaagtaacaaaaaaaggaagtggacccatatctttaattactgccatatcaataccaaatcatgcttatccgataactgcgactttcccatcatcgagttatatatatacccttttgttgattgagacttgtataaattgaaaaggagaaattcaggtgcataaggaatctacgttgcatgcataagacggtaagtactagcttgtttgccaactttctacttaaatccagttgtgcaatagcctggctttagataagtttaatgatttggtctagcgaaacttgtttcagatgatcagatatatttcttgtagtgtttatatctgtgcgtgtgcgaaataaatgcatagatcgaggggggtgagcagttcaatgtacaatcaggaacatccttcagatatgaatttggcctgtttgattaaaattttctgtttcctacatacatttgactttgattgcctatctaacaaatatcacaaataccaaggtttttaaaattgttagctagtactcaagcagtcacagacctactactgattatatatttgtatgccctaactcgcctgattgtgtagcataactggaaatctagaactatactgtaatagttgccttatttatgacctactagatctgttcttcctttgtagtacactgaggaatatatacctcctacatgtattagatgttattagcagcgtgtactgaaatagcccccacgtgatctattagatgtgttaacactttggaatccttagtcttgacagccttgtgctacaagtattgtgcctgaaggagatacgggtatgtatgtggattgtgattagtcctattgaatctatgcatagaagagagaccatcaatactatttaaaaagaggaattggttctggttctatgcatgatcagatttttcattaatgggtttagaatagaccatctacacatgtgctgtttataggattttttttgtgtaaaatattgcattctttcactgttgcatatgcatatattagttatcggttgatcttgcattattatatgtatacaattatttagattagataatgattacttgtttaaactcaaaatttgtgtatatttatttcgatccatcacaactcatgggatgtgatgctagtttatcataatttaaaatgtgcatgattatccttgattcagatatctatatccattgccatcaacttcttatttgttttgatgcgtgctcatattgatcatgcttttagatagcaatatcatacaagtatggtactgccattattcaaatgtttttgagcctcagcctttcccaccccttgtcactgtcttggggcaatatttaactattgaagaattaactatgctttgcagggcacctgtggggcctgtttgcaataagaaaccccgtggctactaatgactactaatacaactcacagtcttaatcgtgtgtgttatcatacagggaggctttcagacaaacattgaaaattcttgctgaccatattattttctttttcataaataaacactatcaagggtcaccttttgtgggcttgcttatttgcactgaagatgaatttggaaaggtactaaagtactagtggcttagaatttggctatgcaaggttagcaggagaaccggtattgctaatttgtgctaaggatgaaattggtaggtgctgaagtactaaatgatgggagtttggctaggtaaagcttgaaagagaaagtcttcctaggatatgatagataaatcaaggaatttgttgctcactgtgcccaaaatcttaatacaatgatacacaaagcttatgtgtattcgcgaaaaatgtgcccaaaatctaaccaaccaactgctaaccttgctaggcaaggtaggctaaggaaccaaacatggttgctaattgctattgctttctgatcaaacattctgttcgatgattttctcctgtagactttattacaagatccttttagttacacttttgtgatgcatcatgcatgcttacagttacttatatctgcaattttttagtatgtctactaatggctgatttcttcaattatgaattccctgctctgctgctggtacataaaactgatgctagcatcttatgtcggatgactatttttcagaacaagtttagacattgaacttaaaagtaaaactatagcagatcgattcatctgcacaatttattagtttgtaacatgggaggctaggactattacctaatcgagaatgcaactgacaatgtttgttattcttattttgcagtgttggaaatatcataagttttgggacaagcaagagaggacatggagccatcatcacaacctcagccggcaattggtgttgttgctggtggatcacaagtgtaccctgcataccggcctgcagcaacagtgcctacagctcctg

SEQ ID NO: 46399 - DNA, 1662 bp, Oryza sativa
tggcatctgccataacacatacccgatgagtttttaatgaaataaaaagacgggtgggggatacatccccagcgtactcttgatttgctagtaaacagacaactcatagccaaggtaatgtagaaaactacagtttataaagcctacaatggtttggtaaaactggtcttgtggcattcacatgcagccctatattaatctaaccattttgtttgattttttccaccatttgaatgatttatcgttagtgcgctgtgatatttgcaattttgcattgtgttttagtagcttatagctccgtgcttgtttgttaatctaatgcaatcgggtcaaagaaaaaaaaatgaaacggtactgtccatggtgagggctgattagtatggtcttggagtgtagtcaagccgttttatacagctgtggtctcttcgtaaataacagaaagtagtgtacaagtaaaatagaaaaaaaattcggaataaacattacaaataacagaaagtagtgtacaaatgcatgatgccatgatgtctcctaacccattacgctggcttattagggcgtgtacaagggtatctttctctgtcagggaaaaaaaaaactagcgcgaaatgtgttgatactatgaatttaaacataacatctcgtattggattttttcttttaacggaggcagtataggtgcattgggcgtggggagcgtactcagttactcttaccgttggcacgatgcaaccaagccaagtaactacctctgaaaaaaaaaaagaaaaacaagttaatagattgagtatcttttgcgaggaatgtatgtataagcagttagttaattagcacaagtaaactgaaagaaattcagaaataaacccacctgtaatttgtagtcgttaacctaaacttttaggtacatcaatatattaccagcttatgttgagagaatattttctccaattatccatcacatctactccctctgtttcaaaaaaaactcaacctagtattagatagaacgttttctactgtccagatttgttgtactagaagacatcaaatccaatactacattgagtttatggccctatttagttcacaccaaacttcccccaactcctaactttccatcacatcacatcacatcacatctaaaactttcctacacatataaacttctaatttttttttccaaactaccaattttctccaaacttctccctaatttcagaaactaaacacagcctatgtgagacagaaggagtacatagcaaaatcttcatagcattaatgatgtcaaaagctccacggtgaccagagctcgtcaagaaacatgacgccagtcactactcgccagccattaatctcagttcgctttcgccggctggccgcaaacggcaaatattcctcgtccaagccggaggccccgagaagaagaccttgccgagataggcaagcccggaagccacgtcgagcctgcagctttgctcgcatgctgatctcccagcttggtcttggccgtttcctgtcgatccagcagtcaaggatatgcagtaataccgagtccaaaaacaatccttgtccgtttgtttattttccttcttattttcatcggatcaagaactgtagttcgttacctacgctatgatgcccatgcatgtgcagggctgcagg

SEQ ID NO: 46400 - DNA, 7631 bp, Oryza sativa
cgatggggcaagggaagatcgagatgaagaggatcgaggacgcgacgaggcggcaggtgacgttcagcaagcgcagggctgggtttctcaagaaggcgaacgagctcgccgtgctgtgcgatgcgcaggtcggcgtcgtcgtcttctccgacaagggcaagctcttcgacttctgcagcccgcggtcatgtgcgccgccgccgcccggccctagcttctatctctgtttcttgttaatttgtttatgacgaaatgccaatgaaaaatctgctttaaaagaaacaagaaagagagagagagtgtgtgtgtgtgtgctgatctctaatcttgatttctatatatctgcatgccttagctgagttttcagttctttgtggtgattggtggtgtgtgcgatgattcagaaatttagcattgcatttatttgttgcagttgatatttcactcagcattccagataaatgtttgggggtactgttcgattaacatcccgatcaaatgggtagtgttcttcatgattggtagtggatttgggaaattgggatcgctttccttgcattcaacattatcactagaaatctttcgatggttcatgttctagagcttgcttttctttctgatttaatcttttctggcatcctgaaattttgatttcaggatctattcctataggacttgtgcttgctgcatagtgcattcttcaattaagcagtgcccatgaccacatcgattagtactactagaagctaatactccttttacatgtataagttcacttcattggtccaatgtactagtaataccatattgtttctggatgtaacatatttgattatgctttgttaagcttgatggagctgtttcaccgttatgagatcaccaccagaaacactcggcttcaggagacaaaccgtgatgatgaggtaagcgaactgaatctaacacatgttatttttttcttttttacatttgaaaggcaattgcatgtcccacaccaaattcctaatcactcaaagcttcatttctacaactaatctacatgtgtgatgctgccttgcagcaaatggtcatggagatcacaaggctaaggaatgagatcgaccagctcgaagccagtttaaggaggcaaactggagaagacctgtcatctgtgtccacagtggatgagctcagccagctgcagctgcagcttgaatcatctctcagcaaagttcatgcgaggaaggtactagcacttgcttaaatatggcagaagattagtgcagatcagcatcaaatccttatggaatatacaagtcctccacgatttttttttctttgctcacaaattcacaattagagtttatatgacagaatgtgttaactgcatgaggtgcttgtgtgcaggatgagctcatgagccagcagctggaggatatgcgtcgcatggtacactactcccttattgtagtcgcagttgtggtttttgctgatgagtggtgagctgaattaatatatggattttctgtatgaaatgcagcatcagaccgtgcatgagcagaacaatttcttgtgccgcatggtaactaaaatactcctactagtatgccactgcattggctttaatttctttttgagttcttcctaaaatgttttcatgattcgagtgaatatcctcttgtttcttacgtgtcatctatcctataattcaccaactcgttttactcatcttttactcttacactcttacattcatcattcaacggttcagatcatccgcgtaaaatccgaacggttcagatcgatcccacctccacctccctcaatcagcggacgacccgcaccgccccccccccctccctatcgctctcccaccacacctgcacctccgccctccgccggaattccgctcctgcacctccgccatcagtgctccgctccgtatcagccgccgcgccgtcctctgcatcgcatgtctgccaccgatccccgccgccggctcgccctccacgatcctccgcctccccgctgcacgaggtcctcccgtcgccaggtcgtcgccgccgttctgctccaccgatccccgccgcacgaggtgctcccgtcgctaggtagccaccgcgccgtcctctgcatcgcctgtctccaccaatcccctctgcatcgcaggggtgagctgcagctatggagttccttgccggtgggggagcagcaggtgaatcccgtgagaggtgagtagttgaacaaaactcatcatgcagttcatcagcaggtgaccagtccggaacttggcatcgtggaggttcatccggattcatcatgcattctgaaacaaaacccatcatccagcgcttgccgcttttcctcagagtacaatgaacgcggggtgctcggcgaaatgtcccgtccggctcctcacctgcaatgcatgtgttctggagagtgtttatggattctggatcttagaccccctcaacgacttggatcgtcagtaaagcttcatcttgaaggtgcacatctgccgttgtttcgtcaaaatactatgcatgatctttaggtgataaaatattgattgaattgtctactgctatcgctcagaatccatactccatcaatcttacatatacacatatttgttgcgtcaaacacaagcttgctttccatacatccctgaacaattcagcctcacaactgctcttgacatatctcattcagaattttttttctcaaattagttggactgatagaaaaatattgcttttcaagattgtaaaataaccaactgactgggaagttgatgtcatatgttggaagcaatctgctaaaatgttaaagaagtgcatctaacttttgtacccagtgaattgcaaatctctatctcgtttttttatttacagtttctttggttttaaagtaaaataggttgacatgggaactttactagcagaggaatgggcttatattcttggaaaaaatacatttctccatgcagaatgtgatcacaataatgatacttgctgccatgatttctatcactcatgcacgcattgcccttgatgattgtatgcagttgggatatattggttagttcaccctctatctctctctcaaaccattatttatcttcattcactattcacttacaatttccctcgtattagtgatatgcattagtgagtttatgaaaaaaagatcaaatatttaaaaacagagttagctcctttggaacgaagacaaaatgctactttgataacttgacttctcaacaccactcttatctgcacacaatttttttaatgaccagtttgaactttcatctctttacagtcatcaagcaagaaaattcttggcgattctggtttatatgacttcctggaagcagtaggaacaacaagagttactgaaccagaaattgaacttgccttcttcatgcatcagatgaaccataaagggaacaacactactaccctctccaaaattgagctgctcaggacttcgtagaaatttacagcttcaggacatgtgatttatccattctcttttactgtttattctaaaatgcaaaaaaaaaagaaattttgttgtagcttagattaaggcagcctcagctttgtggtttgccaagccatgtactgatatatgaatgtgatactttaattaatgttgaaacgcatgattatgtatttgaactgaattgactgaatgtgtcctggaatcggtttagaacttaatatatcaatcagacttttgttctttgcttactggtttttctgtgacatggagaaaagacgttgaagacataatacatcgtcgactgaatgggtcgaccttatggcttgttttgcaaattttgaaccttgtcctggatgtagtttatttggcttgtttatccctttcgagtatataataactgaggaacttctaataagcttcttaactaaactcgctcatatgtaagtcttaattaatgtcttgaatctatacttgatagcccaaacaatatattgtatatctttttgttgtttcgccgtagcgttagcacgggcatgtaactagtataaaatagttatcaaatttttttaaaagaactgataagatagatcaatatgaaaatatttcactccataaacatacaagtttaaattcaacttttataaattacaacaaaaatgacaaatataaccgtgaatgcgggttaactatttccaatttaatttattctttttttaacatgtggacgttgaatttaggagtattataatactcaatttgttcggctttagatgagtgagaactggcacagcgagaactggcagagccctggttccggggaggcgtcggcaatggaggcgctgacgatgctgccgccggcggcggcggcgacgacggcggcggaggcgttcaattgcttcttcccggaggaggagaagggggtggcggcgtcgagcacgttgctgcagctgtggccgcagccgcacgacggcgaccagcctgacctgcggctctggtaggtaatcaaggagtactttggttaatattccaccaagcacaattagccctgatcagttatctaatctgttgcacattattcttctccttgcagattgaggatcgctgacttgtcaattgaaacagcctacatggtggctggtggacgtggatttcatggacgtccttgcagtaatctagcactaagacagcattagcatagtgaacttacaatagctcgagatgagatagtcgtcgttatgtttagataaaacaatggaacatagcgaattagtgatagggataaaagaatggcactactcgttcgattcaggttaggattattataatctagattattaggagtaagctgaaataaacaagtagattattagactcgtttgattcagcttaaaattattataatctggattattaggagtaagctgaaacaaacaagtaggttattaggatagattattataatctgtaagccagattactataatctaataatctcctctagaggagctttttccagattattaggtggctaaagacccactatctatagatgccttcaataatttagataaacaaacatctcgtagcttattttatgctagcttattataattcagtttagagtaatctgatttaataatctagattataataattttaagctgaaacaaaggaccgtaatatcgtacaatgtattaaccacttggagtgtattttaatgttgatgattacgtgataaattaacctcgtaatatattttagtgttgatgattacgtgataaattaacctcgtaatattttttttagcattattcaaacttttggctgagtttagatctaaagtttggttccaaacttcagtacttttctatcacatcaacctgtcatacacatacaatttttcagtcatatcatcttcaatttcaaccaaaaaccaaactttgcgctgaattaacacagcctttgtgttcctacctgtgggaccacattgtcagtcgctgaattttcaaacctggccaactcgctagaacggacacgtgaacggacacgtctcggttgccacgtggcacagaaaggctctttttcttgggcccgcaaccgccttcaccgtccttggcttattggctaccaccaggcgaggcctccttctcgcggaagcttcccccaaccacttgtccccctctctctccctctctgcgcgccgccgccttcgccatggcggcctcctcgcctcctctctttccctaaccctagagccaacgcggtgggcggaacgtcctccagatcgcgatcgcgatcgcgatcgccccgcagcggcgtctccacccccctcgtccgccggtttctccgtgccgcctcttccgaggtgggaggtatggtatacgctccttcggcgactcgacgaaaccctaaatcctagccttttgtctgtctggttcttcctgaattttgttggtgggggaattttgtttgcgattcaggcgtggtggtgctgctgcggcggttcctgcgtttaccgtttgattgattggtggtgggggacgggttagggtttgggtcggagggatcgcgaccgctacggccttgatcctctcccatttcgttgatcccccgctctccccttggtgatcccaaggtgaatttagttgcgattcctttaattacacccgaatcgcgttcgggctcgtggttgcacgattgcatatgtgacatggtgatggtgttctttgtttttgtgcgatctggttcggctgtgctggtggttaggttgtgagttcattgcgaagttgcgattagggctattgacgtctattagggttttcaacttggtatcttgtttaggcccctttcttcggaatttaacctgggataagagttcgtccagttgggcaggttatggtgctattctttatgcataaattcgttacacatggatctatatctatcactggactctggtacgaacgttcaccgcataaattttgactcgtgtaatgctaaattgctaacttctaaggctcgtgtagctcattcaaacagtagttttctgttttgtttttctgtaaataatggtgcgctggtacatcgaatgtagatttgataaataatgttaaccttcagtggtttaaattaaacactaagtgcttaggttaaattcataggttcagttcatggaaagtttctttccatcagcagcaattttctgtttaggttgattttgaagaaaccctctctgatttagtgtgattcctttacaagattggcctctgagagtccgtttgatgatttccatcaattatattagtgtatgctacattggtgctagggataagtaaaaaaataatttcagttaatatcagaattattgagctgtataaacctgggagttaaattagtgcaataggtctctatcattcttcttgaggtttaattctataagtttttggttggttccagacgcggttccagacgcgtatcaaactggttgattcactggtgtgtttttttcgttttcgtgtcgttttatgttactgtcagaaggatggctattcccatatatcacacatatttggagagttcagctgttggaaggttggaattgttttttttttctcatctggtgtatttctcaaaactgaccggtggttctgaatatttcaatgcctgatcaggatcaatttttgcatttctcgagttcttaacagaaaaggattttgctatacacactgaaaccagtgacattatttcattgtgagatgcagattacacttttcccatatatatatagtggttggcaaagggctcctggagtcctggttcttaaagatcgataacagctttcaccacaaagttctctgcaaattgcataagatcaaatacatgattcgttagtgcatccttgccatctgttttgatacttctatatgcaagtgatctggtgttctttggtgaattcatgtgtaaccactgctccttgaggcagttgaagggggtattggactagatccatcctacacataaccctcatgtgcaagggttctgcttggatatgtagtttttctacacaccattgacaactgataagtatatcagtaaccatgttcctcctgcaatctaatatcgttctgtgttctgtcatt

SEQ ID NO: 46401 - DNA, 1219 bp, Oryza sativa
catacttgtttctggtcatttattgcactggatttgtcaagttaactagtgacgctgacatcaataatttttttgaagttttgatgaatttgttcattccctatccaacataatagatatttgtgagacccaacatatgtgaaaacgttactgttgtactgcaatttttttggatctacagcatatattcatccatttacttggtgatgtctggaatactgttctcaaacagaattatagatgctttcatcaaatttgctgtaccgaggtaattagtgtagtcgttatttttaagggttatatttttaatgggcgtgggacttccagattatgcttccacttggtataaccgatggcataaatcaatatatatgttctgccgtattttgccaacttcatatcgcccggatatatatgttctgcagtattttaccaatttcatatctcccgaacacttctgctgtgtgctataacggcgtgtatattcgaacttaacgtctcccattgttttgttatatgggtgaatggtagcaaagttcgcactgtcatgttgttgagcttgtgatttgtggagagctgctggtaaggagccatgttgcattgcgtacgtgggatgggttggtgtagctcctttccagcagtagtgaacaaacgaatcgccaatcgtgattgaggcgcagccgcatagcatattgcttgaaaactacgaaatggtataaacaggcgagctatcaaggattcaagttacaaaatgattaagcgaacagtacgtcaatcttagattgtacggcctaactcgcccgtaaaatcccagattctgggctcagatgcttgctaaaatgcaaaacggcgcgttaaacagaaacttctcttgtagaagttcgcaaatttctttaggagaaaaatccaaattccctcataagtcactttgtgttgtcatcctcacctctacaactcaattaggtaaaaagacatcccacaacacaatctctcttctaacatcctcagtatagatttcattgatttctcttgctcaatttcttgtgattttcttttcgtttgcccaatttcttgtgacccacatcagaactacggcgactttctgctcctgaaacacgttacagccacgttgttttactgttcgaaatttgaatcacatatgatagagcgagctttgtggtgaaaacggatcggataatatactgttcgaaatttgaat

SEQ ID NO: 46402 - DNA, 1951 bp, Oryza sativa
attcctgcagcccgaatacatatgatagatagagctttgtgctgcatctaggggtgaaaacggatcggataatatccggtccggtccaaatccgtctgaaatgaggatatagaatgtgcttttagaattctggtggatacaaatgtggatgcggatagtatgaggcggatgcggattatgcgacatttttgtcggattatccgataagccgtttgccggataatccgaaattatcaacatatataaccactatatctattgcatataatataagtcggtacatccaatgcccaaattcatcaattaacatagattttttagtctaacgcttttatcgttgcatgtcacactcatgtagctatattttttatattatgaacatcatgtatttatgttgtttagcaattaatcgtataattattacgatgggttatttattgactatattgtattattattccttggatttatcgatgttgcattcattgctatacacgtaacatccgataaatttaatctgtttccgaaccaattccgcattgactccacaccattttcgacgcccgaaacaatccgctccgcatccgctcggaatctgcttaaaaatatggtttaagatatggtatgagcactatccgtccaaatccactccgttttcacccctaactgcatccttccgctatggtatcataccaacatgttgatgaacgattggagaaattagtggaaattagacagaagggggaagttagaagagaatttgagttgtgggcgattttttttttacctaatcgagttgtagaggggagagtgaaaataaaagatttgtagggggtatttggattttccccaaaataaaacgataggcccatcaaaccctaaaaaggttaagcacggatggtctatcaaagcaaaaaaacaaagcagtccagtcaaggctgaaattgttaaaagggttcattaagacccaaaagattgaaagggcctactgaggcccaaaatgttaaaagtgcgtggagctaaatttcatgaaattttgtcatgattttgatatccacaaattccacactccacggtcttggagctaagctagcaaaattttggatcaaagaaaatattttatacttttttttaaaggttaatacttataggttttactagaaggctaactctcaaatttatagcatgtaggctaaatttcatgaattttttgtcctaatgttaataatcacaaatttcaacgcaacattcttgatgctaataatagcaaaattttgggccggaggaaaaaaattgtgcatttttcctaaggttaatactcgagaagcctacaactcacgaatttatagtgcgaggggctaaatttcatcaaaattgtcatccatatgttccttgtgctagtactagtgaaattttggaccgaggaaaaaaaattcatgtgtttattccaaaaggttaatactcacaaattttgccacaaggctataactcatgaatttatagtgtgaaagctaaattacatcattttttctcctaatgttaataatcacaaatttcacacacgactatacatatgataatactagcgaaattttgggtcagcgaaaaaaatcatgtattttttttctaaagattaacactcacggagtcatgggttttggctaaaggctataactcacgaatttataaccttagggcaaaaattaatgaaattttctgtcataattttaatatgcataaattttacatagaacgatcctggtgctaatattagcaaaattttgggcaagagggaaaaaaacttgttttttttcaaaggttaatactcgcgggttttgcgagaagcctataactcatgaatttatagcatggatgctaaatttcatgaaatttttcttcttgatgttaataataaaaaaattcatgcgtaacgttgatgctattactagtg

SEQ ID NO: 46403 - DNA, 18582 bp, Oryza sativa
gataatactactatatgatccagggctaattcaaacagagagaaaaatattagcacagcaattgaaaagtccaaccttctattttaattaacagaaagtgtaacgggtgatcttaacaagagtgagccacatctcccaaataatatatttgcttagtgaagtaggagtactagctactggtttgatgttgtttattagcagcaactcctgtactttggtatgttgatggtaccatgagcaaaaacaaaaggatgaatcctaccaaagagctggaagattggagtatataaagttaaacaaacaaataacttgttgcaccaggagaaagtaagaaaataatgcatgcaactaaagagctggagagagtgggacagcatgtaaagcacaaaatgtagcatcggagtgaatttctattcacaactttgcagttgcatgttataatttgtaccgaaaccttaagaggaatctatcaaaacacaaaatgttgcagtattaagctagctaggagaatccaaacactaaacagtgcatgttaacagttaacacgtcataatcagccaccagtcacaacactgcccacacgaatacaacatcatcatcatcacatatgcacatcgtgggcagcccacaagtcgccagcaagacctgaaatgacctgaaatgaatacaaagaatcataccaaatcatctaaatcgatatcaactttcgtataatcgaaggaaattatgctcgctaataacaggacgtactcataacgaatactatgtttgtttgtgtacatcttccaccgtgccatcaagaaaacgaatactacaatctcatgatgtttgtctattgtcacggtagtcaaggcctcaaatcagaatgtagttatcgcaatgattccactctctaacactgattaattgatttgaaagggatgaattaaagtggttgcatcgtgtcatgctagtagaggaatgcatgttctttcccccccccatcaagtttttctaagatttagcagcgtatttttggcctgtgcgcaccgtgttgcacagagcgcttcaaatatgttgttttttccccatctgtacgtggtaactgtgcaaaaaatggaatgagcagatactattaacttcggtatgcacaaagaggttgagaccatttaattagtatggtttggtgcaccagaaaagggagtaatggaggcagaggcagccatcgcccataaatacgctgcctgcctccatgtgaaagctctgaccaaatgaattgaattgatgctatttcatggagtattcatagaccattggatcagattcagaattcatttcagacacaaaacaatcaagaaccttcttttaatccctgtgcacaaagccacatacactcctatccccctctactcagatccctctcactcataaatccagcatttaatcctgtgtacaaacgacctgtaccgtgcagtccatgcacatcaacaagtccactcattcttaaacccaagcatcaaagaaaaaaaaaagaaactaaggttaattaacaattttgcaaatcaagattagacaactagctgtacaaacaaacaagcagctcttacagtaatggtcggctgacgagcagtagtaacctatatgtcaacgaagtggtttggagttgggagtataaaatcttatagagacttttcatggatggacaaaatgcgagtaagaaaggagaagaaaaatctaaaaaggatggtaattgggattaggtggtgataagcggtgaagagaagatgaaaaaggtgaaaaagaaaacgtgaaaagatcaccggaagcgtccgccgtcggcgagcttcctggagcggcaccgagtaatggaggcggcggaggagaggttgtggagcggcgatggccgtagctcgcaggagaaggtgcctgggtcgggcggatgggcgtggcggtggcggcgcccggggctgggccgcacgagagggctgaggcagacggcgaagcccgatggcatggtgctggtttggcgccgccggcatggggtcctccgcatcggtgaaggagatggctgccatgggggatcagtcggcgagctgctctcctcgtcgctgccgtcgcagtcccgctccggcgagagcccacggttgctgaccacgcggcaggagcgcctaggcgggggcgacgaggcggctgcggctgcggctggcgctggcggctgcttcttgcggcggcgcggcatgaacccggcgagccaagaacggtttctgctctccctgttgtcgcctcccttgtccttctcctccgatctgtgatggtggtggtggtggccgaagagcgtggcgatgacggagaacttccccgcgcgccgcttctcgtacccgatgtccccctcctcgagcccgccgctgctgccgtaggcggggccgacctgcggcgtccggaagaagaggaggctgggatgatgcttaagcgcgccgccgcccgaggaatccgacttcctgcgggacacgtacggcgacaccgacctcgggaacgccggcgccgccgcggccggtggcgcagccggaggaggaggcgacgacgacgccccgttctgcgcggcggcgagcgcgagcaggcggtcgttgaggcacgtggcgcagacgccgccgcccgcctggtacgggtgcttcttgcacctcatccccatctcatcgactcatctcgccgccgtcgccgccgccgccgccgcgcgctccggccacgaggaaggagcaatctacaacggcgcacgcgcacctgccttccttcttccccttcccttcccttgaaatttgggcgagttttttaaaacggagattggtgcgcgttttggcgaggggatttttttttcctcttttttttcggtccgcgacgctgcgtccgcgggcttaaataagcttcggcgaaacgaagggcttaccaagtgcaggggggacggagtaaatggtggccttgactacgcttttgggcgaattttggtttgattgcggttgcttttctattcgtgtttgtgagacttgcgagtagagtagaatagtagtagatgcagatgtatagtagtagtactagttgagatagatttggcacgggaccatgcttggatttggttgcggtggtgcggcggctgagcacacatgcacaccgttgagagcgagacatacatgttcgtttttatcggctaatctttgaaaagtgtattttgggtttggcctatctacacgagtcatcttaaagggattccttatcttaattaatccagggagatgctctactgttattgaacaaatgctgccactccactagctagcatcccacaaattgttgcttggccattcggcctacttttcaggttcttcctctctgaagcctataaacccaagccgtggacttcccagacctctcgattctcagccttgcttacggcccttttttccttgtcatgatctggtgtaggtgatttggtttatggttcaaccaaaagcgaagaattgtctcgttaaaccatacgctccagtgtgtcgctgaggtctagacacgtcggtatttatacaccatataatttacagttaattgcacagtgggccacttatgtttaccaaggttgcaacttggactagggagaagaaaatattttcactttgatttagataagtttgcaaaatgattcactttgtaccacttccctctccagctctctcatcactttcttctctacaatctaggaaacttggtgagctcgtgaaggcagcagcacgcggctcaaattcttaatgcatcagatcagcatgagcatgattcaactactaccaatacaggatctgctagctaggtgctcgcttcttgcgttgattatgggaactgggagcctgggagatccttgagcttcacgtcaggtagagggcacggcccggaggagatgctccttggcgatgagcagtaggcgctcgtcgtagcctccgcaaattggggacattccccggtgcagttcaccaaagcatcaactatgcttgctccaatgcttcacgatacgcagtgcatggcagaatgtgtaggtcgagcagagcgcgtacggcaccagcagaaatcgagctcgagcagcaatatatggacggcaacgtactagtggaggcatgcgttcttgaacattttgtgtgtgtatatccttctcatctccttcctccgttgagcctgctctcatctctgcttcctcgtcgaccacaagtagctggccgtgattagggaggagaggagaggaagaacactatttgatattgatgtgtgggccactggttaaaaatgcaaagttcagtaataaaacccggtcaaaagtgaaaagatctgctgatagctggtccaatttacaacttgggtaataaaacctgccctaaagtgcaattcactctataatttatcctcaagtgattacgttgctgactgtgatctctcaggtaaaaaaaaaaaggcccgaccaaaatccattcggagggcgtgaaatcgatagcaaattagcaagtactcgtactatacgtacttaataacgccttgcacgaaccgcatgcaccacacgtataaaccagctcgtcactttctcgggtaatatataatcgcgttccagaagacgtttgcgctcatcctgagccgtactatccattcatccactctcagctttggcacggatgcagtgcaccaaaagttatggaaaagagcaactttcaccgcacttaattagcacagtagaagcttcccgtttacactgatgcttagtcattagtcactcgagaaaggacccggtaaaacagaaagatctcaagacgtacgagcgcgactttgccggtgtcgatcggttttaatttggtcgctgatcgatcacgccgagatggcctctcgccgcgccatgacggagtgggacggagatggactgttcgttcgtctagagaaagagcacagggcgtagctactggtcggttgattgatcgcgcgatcgatggagaccgactcgagagaccgggccggcgcgcgagcgaggaggcaagcgaagcgcgcgcggatgcagccatcgatcggcgaccgcgcgcgcgcgcgtacgcgtcacgtcgcgctcgtggagaagctggcgctgctggcgatggcgctgtccgggtttcttgtgctcgcgccgcgcgggttcgtggaatcacggtgggattgcggcgtcacgagggaaaatatagtgaaaaacgcgcggttgattttgtcgcgggggggaactgtgcaagtgggtagaaagatcagaacggcgacaattctatcgtcttctggagggagaagtgtaaggatacgtccgtttctaacctgttcatggaagtggtcattgtcgagatggattgggattagtccatcctgcttaataataatgtaaaagaagctaacctacttgccattcagcaagcaaccaagtatcacacgcctcggatatattgctagtggtttcattagggtctatatgtttgattttattttttctgatctaaagcatttggctgcgtttgtccaactcacgtcgcaaaggaagctgacgagatagtggaagcgtcatcatcattgcacttaaactactcgtgtctggtttacttgtacactcacgatgaaaattaaggaaagataccgtcaggttcatcgttttcatctcatcgatatatatatatatatatgagatttcggcaatgctgtcgtacgtgtcgtgccgacgccacgcgtcgcagtcgcatctaattcacacagggctgattaacgattgaccaggtagcttcttgctgatcaaataccagaagcgacaggaagggcaacattatcttcttctgcttaatactcttagcttaaacgtcacgactcagcccgatcatctgtagcactatttctgctagtaattaacttttgctttctagtactattaaccatcatgatccgcgcccctttcgcggggtcaagcctgaaagctccacgtacgcgccgccaccgtgtgctagcttttttctctcccactcttccatatgcacctatatatccatttcccccttcacaagggcgccgtgaaaccgatgaatatacgaggacttgtcgtgccatcctgccaaatcgacgtccgccgcgggctcgcgccgcgcgcgggacggacgggacatcgcctcgcgcccgttcgccgcgttgcgcttgcgctttgctcgtgaaacggccgtgcggcagggtgggggcgcgcaggtgcaaagcggcccgtgggcggtgggctctctcgcatcggcaaaaaacgggtggcggctacgtcccttgtcccaggtggcccaactgaacggggagctagttttggacgagaaattgttcgagaggcttgggctcgcgataagatgggccgagacaccagtgctgcaagccggccacagccaggggccaatagcccactactgcggggaccgctaatgcgcgggtccacacccctctcccctatacgtctctctcctcccccttcctcctccccttatccaaattcatttgcacttaataaataccagcttctgccatagtggaacggaggcgcgtcgccatatatatacctcttgtaagccgccgtgcggcgttgtaacctcaccccagatatagtgaagatattttgctggctagcgtccgtggtttttctctcctactttgggagggttttccacgttaaaatctcgtgtcttctgtgattaatctattattctttatcttttgtttgcctatcatttcctaacaccttcttctcttccctactatagtacaccacaaaattattttgaaaaaacaaaagttagaaaaatttatgtaaagaaatattatatataaatatttgaatttaaatttaaatttgaatcaggtatgtaaacttttgacttataaactttggatctataaactttaggtgtataaactttagatgtatagaaatactatatattagaaaacatttgaattcaaattcaaaattaaatcagatataattcaaatttaaatttgaaacgggtatataaactttaggtttataaactttagatgtatagaaatactatatataaaaaatatttgaattcaaattcaaatttgaatcggatatataaacttttgacttataaatttttgctctctacactttagatgtgtaaacttgaggtgtataaactttatatgcataaatttactaaaatagaaaagtaatgtggtgaaaaaaaaagaaaccaggtgaagaaagatggaactgatcgcaaccagttggtcctgtcgatcgatcgcgaatcagcctttccgcactactactagcaatttgcagtttgatggcgctcggcaggcacacgcacaacaggaggactgaacaagtggtggctctctctacttctctagatgaaacgaaaagtttccagctcagtttgtagtgcccatcgtgtcgattggagttcctgccactgtgaagctttttattcgatcgcaactaggacgagtgtcaagctctgattgattgcagcaactaggagtataggacgagtgtcgatatttgattcgattgcaactaggaagtgccagtaacgtgccagcctctgaaccacacgaagctcagttgaatcagtcccaactccagtttcccatgacttggctctagatggttaccgaaaggtcgccagacaaaacttgattattacacactgatgctgtaagtacgtaccttgagagcaaaaaaaagttgcaactactcctgattcctgaaggatacgtaagtggtgacaacttgtgctcaaaccatgggtcaaatggatccaaaactgcttcgttaatagcacttggttgaagaaacatgcttatatactccatggtccccttcaataatggtaaaatgaggtccccacatcctcggatatgtatcaccatcgtcgataaagaattgaggctcaagatcatatgcctatgataatggcacattccatcaatcccgaaagcaaggagggcccctgttcattagtatgctacaaactgactgactagccaaataaatacaaattatcttttcagtcttaaaaatgtgcaatgggcaatgggacattgtagttgatctaagaacattttgataagagttatggatgtatgtactagtcattggttattggttagttcttacacaagtgatatggtataccctctaatattcaggaattcaagatttcaagtcccagtgccgacgtatactttcaacatcatcttctaaggaagaaaaaaagtatgacgagtactaatttaagtcaataatagcttccttagtcaatagagtagttgttaagtccgatgaagttatattgctggataatcaggtgacagtactagcagatcatgcaataatataatccaaagtgaaaaccattcgtatgtaccacctcatctcggttcttttaataacaacttccacatttagaacgtatataagggcataagaactgatcagcagcaaacagaacccaccatatcacaaccacgacttccctttcgagtaagcatactacctgcttatcatttatatgtcaggctcatttgaaaacatttcatttccttgatatagtttgttttaaattttgatgcatttcagttaatcttggaaagtatgcttttcttctatgttatgaaacacacaccgtcttgtggagtttgtgtgactacttgttttctgaaagaatatgctcagactggcatctagcagcatacatgtgttttctgactattttatgttcaaccatatgatacaaatgggaaaaggttcaaggctcaaatgataaaagctttaattactccatcctttgtattgtgagcatctctttaaatacgtagtgcattggatgcatagaatatactctacagataactctcaggaactagttattcttactgtctactctctccgtcctataatataagggattttaagattttgcttgcaacgtttgaccactcgtcttattcaaatttttttaaaattattatttattttatctgtgacttactttattatctacagtactttaagtgtgactttttgttttttatatttgcaaaaaaaatttaaataagacgagtggtcaaacgttgcaaataaaaactcaaaatcccttatattatgggacggagggagtaattatttgaatttgtgccgctcacagatttgaaccctcaaaagataattcaagccgtcagcaaatggggcaaacggtaaaatttggaagagttcctttcaaggttggcttctcacattcacagtcccgcccaaaggtgagcctttttgttcttttcaatgtcacgataaactcattcaaacagaaatacaattacagagacatcataatcaaaattcctggaatagttactgcttttaattagttcattggtcgatgataagagagatttaaagaaatataagcacgtaaggtagataatttactaatttaatgtaaatgattgatcatgcttcacagcaggaccgatggcaaggaaaatcgagcgagcaaagaagcatcgaatcatacaacaaaattccagaatttccaaattgtcacaagctagaggaaccagaggacaatcaacaaacagcactgcttctatctggatcccagaacctgtcttcccccgatatttttcagctgctatctgtggatgtatgtataccaacacaacttaattactctactatgcatttaacttttcaagaatcatttaacttaaagtacaggccatagtcatcctaactatttgtttgggatcattcatgctgatttagaccgattcagaaactgaataaatttttgacatatatttcatccattagatataatatacactccataataccagtgtactttaattaacagaacattatgcactaaagtactaatgatgtgcattatactgtacacatttcagtttgtatcatacctttaaaaatacatattgctgaaacatgtgcgtttcatttatttcaaaagtaactagctgggtggcctgcgcaattgcgcggctagcacccaaacaaaatcatatatttttcagtatgattttacttaagatttattaaatagctatacttgtatttctaattatatagtttttaaaagtcacaccagctgctaccctttacttctgtcatatccttcttttgtttcctcggtctaccactatttctattcattctccttgaaacctctaaaaattggatcttatagttttttgagtttattatctcgttgggtttcgtttttataatttctagaagtcccgtcaaacgctgccattatactcatctacgacccgtccattgtcttttctctttattgtcattgggattttacaaatcgaacataataatcgttcgggttcatttttttactttctataagtcccgccaaaccgtcagtggctttgccattgtactcctttatggttcgcccgctgcctcccttctttattgtcattgagattttaaaatgtatcatgattatcattgttttatttttactttttagaagttccgaaactttaaaaattggaccttgtagtttttagagtttattgtcttgttgggtttcattttttataatttttagaagtcccgtcaaacgatgccactatacacctctacagcccatcccccgcctattctttattttcattgggattctaaaatcgaatataactatcgttggaatttattttttattttctaaaagtcccgccaaccgtcggcggctctgcaactatactcctatacaccccgcgcacgctgcttctcctttttattctcattgagattttaaaaatcgaatgtgtttatcaatgttttttttttactttctagaagtcccggcaaccgtcttgcccgtccctccttttaatcatcattaggattctatttgatgttttactaacagtttttatatatcgtatcaactgccaccactattcctaattaaaatctttttttctttttctaatttatttttttaattaataccgtatagtgtttttttaatatttttattttttatcttttgaatttcagttgaactctcttttattttttattctgaattttaattaatctcatattggtttcttatatggattcttctttcactattgcttatttttaattccgaatttcagttgattttaagttgtattcctactttaacttttcttttctttttgctaatttcaatttttttatttttattccgaatattaactaatctcatattgggttcttatatgtactcttctctcaatattctttatttttaattccgaatttcagctatttttaaattgtattcttacttggactctccttttattttataatttcggattttattttatttttattttgaatttgtattaatctcgtattgggttgttatatggaaacttctttcaatatagcttatttttaattccgaatttcagctatttttagattgtatttctacttaaactctccttttctttttttctttttctccgattaatgtgggaatttctagccccccacagcgaacgtggtgtctccttttaaagctgttttaataataaaatagatatatcaaaatagcactattaatgcactatcacactaataataaaaagaaggaccgaacagagtctgactggaatagaattaattcattagatgtgatgtacatccttcatccatacgatctgtccatgggaaaagttgcacaaagtgagctatccatgtgggtttctgtagagtacaactgcatgcttcgggaatggtgcattcgatcagggcaaggatgcccaagggaaacatgaggagaacagcgtacacaatgtcaatcaagagatcaaacaaaccatggatggaatcagggtaaaacaaatacagtgcttacatgtagattatatgaatacagaattgatctaactggaaattctttccctactgcatgattttaatttcaagactctgctctccagtgaaaaggttcctcacacaacatatcagaaaatcaagactaggcacaaaacctgcgtaagaaaatggaatactctacaacattaaaccaagtttttcatgtgtagatgactgtggggggcgtggcagaattcttgaaaagtaaattagcaaacatggtacagaggggatgtggaaggaagagagaggacataagactccaaacagctcagatgcatgcagctctctcagttgcaagactagctacagcagttgcacgaatggttggtaattgccaatctgagtctaccaatgcaaacaacactatcatgactgccatagggaaagatgaacatagaaaaatgcatgttgcaattgcatctgccgcagcactggtggcagcctcatgctctgaggctgcaaagttaactggagctagcagagaacagatttcgacagtcattcacatgggcatggaaactaggtcgctaggggatttgctcatgctgactaccagcgcggcgacctgtaagaccaagaatagaaccagctcatatttctctatatattgtatactaagttacttgcatgaaacttggttcttttgctgcaggcttaaaaggagctaatgcctttaagatgcggaacagggcaataagcaattatgcctttgagaatctcatgagtaaccagaaagatgtccgacttcctattcgaacacctgatggtataatgcccaattaactcatcaatgacatgccacattcaattagattacttcattttccagggatacaagatgaatgcgaaaaaaaaaacactttcatttgtgtattcatgcagggaagatccatatcaggatggtttctgtgcactgcaagcatgacaagataatattgaacttaggaaaggagcatagtttgagaaccagtaaagaatgtgagcctcattttactatcctctttcttaagtgcaggaccattcaccataggcagtgcaaatctgaggtcttacctttgcttttaatatgtagctgtgctaaattgatttatccaattgtttaatcacccactttcttccagacataatttttgatgaacatggtgggacaacagacttcagctacccaacagatgaacatagctaccatgcaataaacctcgcaacatctggtggaaacatacagttattatttgaagaacatgaacaatacagcgcttggaagtcattcatcagatacctgataatcaacaagagatcaaggctatcctactgatacatgatgtacgaaaattcgacaatcagtagggactcatgctctacattccttacaaacccacacatttcttacgtgaacaataccaatgatcaacatcatgttatgggaagcaccatttgtgtggtggtggaacacatgactccatccacaaatatgattgtgtgtatccttagttggtgcagatcccggaagttatacttcctttgtccaaataaataaataataataatgtaatagaacttagtaatagttattccaccaaaatgcagtttattactaagatgtttggttgaatgatgagatccatcccctgaattatcatctcaacgtatttatgtatattttaagatcacagctagctggcaaaattcaactcagtaaacctgaactgagatgatcagacgggttccaaggccctacccctgccattctcacatattccattagcattaacatcacagcagtctttttacacatttgacaggacaattttggtgtgtttccaacttcagaactaaaaaaggcatgaattatttttgaaaggaagagtttctgtatttatttgaaacataagtatatttttgaaataagtatgtctgatttctatactttttagtggaagcaatagataaaacaattgcattcgctgtaaaccaccaacccatgagcaaaatcgtaagaaaaacaagcaattctacaagcagaataacatcacaagaccgacattaagaaggcaatagcacaaaaaaaaatcctacttacattttaatcaacgttgtaagctgaacttgcctaaacaaatataatgccgtgctccttaatggtgtcgatgacgatgccaagcttcccctcgatcctctcgttcttcttgggctcgtaggacatggcgaagacgtcggcgtccatggacctctcggcgatgaggcggccgatggtcctgcaggcgttgtcgtcgacgagggagggcagcgtggtcctgaggtccttggcgttggtgctggcgacggagatgaccttgctggtgcccctgtgcacgaccttggcgtggacgaagcgcttggagaagaagacgttgagcaggaacggccgcatgtacatgtccgtgcgctgcttccacgacttgcggttgggcctctcctccgcctccttccgcgaccgccgcgtccacgccgcgcgcaccaccagggacgcgcggttgctgggcacgggcggcggcgagagcgcgaggtgggcgatggaggcggaccacgagagcggcggcgacggccggagagagggcggaggtgcgcggcgcggggggagagtggcggcggtggggtacgcggcggcggcggccatgggagcgtgggggtttagacgaggtcgccttatcctgtacttacaccaattcttttaagagtaaatggcatatagggccacttctttttaccaatgtggtaagagtaaaagactaggaagtaggaacagccgagcagcccaacactttaaatttgaacccaaaaagattacatataagttttactttgggcaatttgcttcttccctatctttccctctcttccttgctctctgtcttcttgagcttgttgggttggtgtgaaagctcaaacagacagtaacatagagcctatggagtaccgccctccgtcgcactgctcgcatctcgtcaatttgctcctacaccacatagtccccaagctagagcagctctgcgcttgcgtcgattggaggcggccatctctacggtttatggtcgacgatgagcaggcctaggtccatccttcgttcattataggttaatagcattaggagggacatagcttgctcacgagctcattagtggtgatgagtgtggaagcgtaagcgtggatctgacgaagtgagtttcagtacgtttgaggacatggagaggagctcatcaagtggctaatgtatcaattagttccaatttgcaataaattgtaagtccatccggttcaaagtgaaaatatgagatgagatgagatctagttcattatacaactttggtaaagaaatcatgtccaaattacaattaactctttttttaattgcagaaaaagcatcataactatggcgaagcgatggcagttgagatattcaaatttgtcaagagtgtcagagtgacaacatgcagttttacaaattttcattaaaaaaatatagatcaaaggtacatgttatgaaatgcttttaccaaatttatcattatcctgccgcggattataatagcgtacattgtaaatgcagagtcatatgtgtagcgttatcccttatattaactgacgtaatgggtgcttttatcgtggagtattttacatccttataacaagtttaatagtatagcgaactattagctctaaatcatttatagtcaatctaatagcaggtacaatagcaagctataagccagctataaacatttttaaagagataaagaaagagagaaaagagcagcggactacagatctgtagccagctgcagcacagactccaagacgtaatatgtgtatgacagatgggaccaggtattaatagtatagtaagcaactattgtatgaattggctattacattgactatagatgatttggagctagtactgggctatactattaaacttgctctactatcattcatacaatagttacctataagcatataatacaccaatatatggtctcacccctcatacacataatgtattgaagtctgtgctgcagctgactataaatctgtagctcgctttccttctctctataagcatataatacaccaatatatggtctcacccctcatacacacacaatgtattgaagtctgtgctgcagttgactataaatctgtagctcgctttccttctctttctcttctctcctccagctagacacacaacatattgaagtctgtgctgcagctggctcttctcttctctcctccagctagagacacacaacgtattgaagtccgtgctgcagctggctataaatttgtagcccgctttccttctctctcttttcttctctcctcccgcttttcttctctccactctcttttcttctctcatccccgctttccttctctctcttttcttctctcctcccgctgttcttctctcctccatctagctataaatctttcttctctcctcccactattcttctatcctccactctccactctcttttcttctctcctccccgctttccttctctctcttttcttctctcctcccgctgttcttctctcctccatctggctataaatctttcttctctcctcccactattcttctctcctccagctggctataaatctaaatctttcttctctcctcccactattcttctctcctccagctggctataaatctgctgttcttctctcctccaattggctataaatctatagctctgtagcccgctcttcttcgcttttcttctctcttttcttctctcttctagaaatctgtagctcgctttacttcttctctctcttttctccacatgtgcttacaggtgacttgtagcctgttattgtactcgttcttactccacatgtgcgtgcttacagctaacttgtagcccgttattgtactcgctcttactgatacactccagttcaccccacccagttgcccacaatacaaaagaacaccgatgcacaaaatccataacacgactcaccaaaacattttatacagcgcgtagcatgcatgtacagatgtacctatatgtggtcttacctctcttggataccatggagtcaagacttcaggattacacaaacaaaataatttttcctccagtgaaattagaatatcgaatttcacgagggatttaaccgcgaatgtcatttctaaactcctgattttgatgaccaagtggggacaaccaccacgaaggtaaacatctgaaaaaaattcagtgccaaacaggcaactggtagccaaaaaggctggattgaacgggccaatgagcaacacacgagaaataatgatttgggtggtgccgagggccttcctcttttcccttctctgttggcatctgctaaacaaaatttccaagttacaaagtcttccctcaacataaatgagggaatacaattctacatctaaagagcctacgctaccaatatacatacatgtatagaaagtacccaatgcctccattagtgctaaccaaaccctccaagcttgtaaggtcattgtgaccacatcaagcaaatagcttcgctcccaccaatcgccatcaagcttgcatcaattctgtgtggcgagcgactcaatctgtgtatccttgggctcctaccgttgacaatctaatgtcctctttaaaagaaagggcatgacatccagagcaatatgttcatttgttctcatccgatgtctgtgaaatctgtaagaggatccaactcctcaatgccagaaaggacatcagagtcatactggtacggaacaaactctgtttcagcctcttgaggaagattatcaaagtaggtgaattcagaatcactgatgccaaggtcagatagggactgggtaatgtggaactctgctgagttatgcagaagttgccccggaatcctatgaaaattatttgtaaccggcacttcctgtggttcagtggtcctttgaattttggatttgggaggccttccagattctgatgatgctttgtgctttcctatggacttaggaccagatttatgccgaccggcatcgtatgtgtggaaagcagatgaggcccagtgagaaccttccccttcaaaacaagtttctgataccatcctgtgtaaatgaatgcaatgacacgttaggaagatcagaagcaaaaataaataaataaaaaatgcaaagcagaactgtatcatcatgaagaggatttttccggtgctaataaccactagctccaataaatacacaaaatatctgtgtcaacaattacctgaatctgttctcagcatgtctataagaaagtgtggacagtagtgagtgctccactggctccacagcatgttttaatggttccggttctagtatggacacgttaacaacagatggaaagtccgcctcataatcatctcgatctgtcaagaaatccaattccaattccaaaaagttacggcgggactcatgattgcttgttggaactaccattcttggacattgaacctgagcatctgcgagggctgtccttactagattaaagtttggtctgaagtttgtcatggaccagttctcgctgagtctgccaggtttctggagtgtg

SEQ ID NO: 46404 - DNA, 985 bp, Oryza sativa
atattgatcatgtggcatgtttcgaattgagtcatttcagacttattttagtgagtgagaaatgagaacagcgagaaccatggtaaaaatgtaaaatttgtaaaaatttaaggttgtcagcatattgagaactatcccactaactactcccttcgtccctaaataagtgtagttttagctagtcaaagacatattaaggggtcaaaagactactaagcccttcattaatatggagagaaagtgagtaggatgagggagtactattggttcgatgactaaaatgagaagaaaaggatgtaggtggtattaaaaaggtctaatgctagtggaccactctaaaactacactcttttagggacgaattcttatgctaaaaactagacttatttagggatggagggagtagatgacatgagtaaactgacctcagatactttcaagatagccttcccagtcccagaaggaaccttctcactgtttgaattgtctgttgctgataagatgtgcttgcagactaattcccggaatctctcacagcaatgcacagggtgacggtatcttcctctataaaatgcaccacctggtacagaatgaagagaatcactagccagttcccaaagagggccgtactcatttacagttgcacaaagaacagcatcttcctcagttgtccacgagtctgaagcacaatcgcgagaccataggctcttcttcttcaatctctcaggcttgattaccatgacacgctttactggcatgcatgggacagaaattcggccatcactcttaattcttgcccccgatttgggatcagaatcattaagttcatctttcaacttaagctgcttgccttcaagaaaatgcttaggtgataaggcctcggaactgaaactcgatttaggggctttcttgagcttcttcaggcttctgctattgctgttctcttcctcattggttgacattatcctcttatgcttgttagaat

SEQ ID NO: 46405 - DNA, 1318 bp, Oryza sativa
ggctgcttcggtccatcggttctttcggttaatccaaagtaacgaccgaactcaccgaattaagttcggtctttctggttgtacacccgaattagtgaccaatgaccgagctttcggtctttttgggttcgtttttttgggtcggtcttccgtcctcggtttttatgcccaccgctaccagctgtccactgcctagtaacaaaataatgaaatctttcaaatattggaaagtacgaacagacaattgttgttggacaagttttctgaatggtattggggtggggaagaaaggattttattggcaacttactgccgatcccttagttttgttgcatactccaactaatgtttgcaaataagttaataaataggattggaccttgctacccgtattaaatggaatattttaacttctctagtctctcctgtagcttcaagagaaaaggaaaatgcagagtggggggacgttgcattatgacttgatttctcttgagactacattcccaataaaatggatggaaatatagttatatgggggtgaattagccaaactggcaatttttgtcaagtacaaagctttttagggaaatgaagtttgttaaagttgacgtggattagaattttcaaacaaattcctgtgattcctgttatagttttctttggattctgactgccaagtaaaaaagcttttctcccctcctatttgttatctgagcaacatgtggtaacactactaatgtagccacctgttatgtacctaccattttcaggacgacgaagattatgttgctaatgatgaaggaaaggtaccatgaacatcttcatctgtttttcccactgccttcatatttcccatatattctgcatcctatgactgtgtggcggtccttcaaaactagaaacatccattcatggattagttatcatttgcatcgatttagtctatctcactctttttgcggttttttcttatacagctataaactcatcttttttgacaggatgatgaagctactttgtctgaagaggaagagttggcgaagaaagaagactgtgatcctctagatgaggtgaatataagcattgaacatcattattattcaaaatttcacactgtgaagtttagccactctagttcctgatttgttgccagtagaataaacttgtcaataaaatacaatcgatttattatctgtgctatcacaactacttaaggttaatattttaatacgaaatatcttggtataacaactagatagtaattttgtggattccgatttaaactataccactttttgtgatacaataaacttgctct

SEQ ID NO: 46406 - DNA, 752 bp, Oryza sativa
  unsure (1)..(752): unsure at all n locations
nnnnnnnnnnnnnnnnnnnnnnnnnnnnnnnnnnnnnnnnnnnnnnnnncaatcggcctcacacagtgctggatcagtagccttgccgtgcatgcaaccaggctagctttcacggttccatgagcaattgagcacgcaaaattagcccacgatgctgccatgcttaggatctcaattaccaggtcgcaagaaaaaaatcattctgagtaggcggtttcatgttgtcctggaagtacaaaaacaaaaacagaagagcaaaacgtgtttttcattctccaggagagcaacgatcgatcgagccacggtgtagacaatgtcccaaattaaaagagagttgcgtgacgtcctacgatttttccctggctcccaacaaacgcttgatccgtcattcaatcaattgcgtaatcacgctcgctcgggacctgaagtttgttgcgcgttggcgacgaggcacttgaccagcagcaggccacagcccacaggggcaagtccatgtccatccttcgccgcaaagcagagcaaaaggggagcagcagcagcagccagacagccagccagccaacagacaccgggaccggagagatcgaccgatcgatcgaccaggtcaggcgtggtgtgccccggccgacaagaggctctggctcggttcaccgctcggcaaacgcaagcccgggggcacgggccgccaccggcgcagtcagccaaaacgcacgcagaaacgcgatccaaccaccgcccgatcgaggcgcgca

SEQ ID NO: 46407 - DNA, 771 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgagga

SEQ ID NO: 46408 - DNA, 76999 bp, Oryza sativa
  unsure (1)..(76999): unsure at all n locations
ctcacatggcagtcctaccgatggccacaccactgtagacaccacctcgcggttctaccaatggctgccccaccgtagagcccctgcctcacacatcaagaaaccactatgcatggattccactcagctatctactccgctaggtctatacccatacgagaagtgcggttgtacgggggtagtttcatgcttaacttcatggctcggtccttaattgaccggggacgatactagccttttccggataccacccaaatcctccgtccgccccagtcgaaaacagttgtttaattttatttctcctttcacaaatcatgtcatcaacatcatggcaatgtggcgcttatgtctccacatgccgcatctcaataccttcccaaaggtaattgcccaagcatatagcatttgataaatatgagaatgcatgattctagagtagcatttctaagcatttgtcatagttgactagggactcatacgtaatcatggttacaagggaataagggtaaacaataatcaaggcatggcataatcacaagtaggatgttcatcattgcatgcaattttatttgtaaacaaaataattttcgcaattgggatcaacatgttcaaggaatagtgatgacttgcctgctcaggataattcttattattgatataatcttgatcaaccttcacctcctggaagttgtagacgttgcctcacgactaaccgatacacaaggtctataatacgcgagaaaaaccaatattcaaacaacaagcaaatatgcacaagcaaaagataattgttggggtcgatcctagggttgctcatactattcgtgtttgctaatggatttcaatcatgctagggctaaggcttcttaatctttctattgtcatcgtggtcgatttaggagttaaccaacatagcatttatgggatacatatatatttggctaatcggcgatttattctatcaaatggctatggaaggattatggctatatatgcatctatctaaatagcacggttacataccagaggttctgttgttagatggatttgggatcaagcaattaatcgcagggaaccatttgtattattattttattgatggaggctttgctttaattatgaaaatattttacttgtcacgataaattagaaaaggttaataattatccatgctttgtatgttagagttgtttaggttaatcatattatagttacagattatcccttaatgaacaatcctaacttacagttgaactataattatatgaggtcaagatttataactagtatttatccaccatacatgtttgtcatatactccttggtttaatatatgctaaaggtaggttattgttattatgtatgattttaaatggattgtacaatatatgtgatttaagtgggttggcaagtgattttactctttgagtaattattggatgctaaccgactcaaccttatttgggtggttctatcataacaattctgtacctattcctcataaataaattaaagactcatctatctgtattcatgtttgatttacctaattataaggctaactttattatttaaataatctataagtcatggggtttaattatacaaccatttaatagtactagtatcttcctatacattaatttgagacatcatttaaaattagtttgtgtggttgttacattgacaaagcatgttaaagacaaatattcttacatctaccttactgtaaagtactaattttatttgttagcacatttttaagttgactattatgcattatcttagtattaattatttaataattataaatgtattttatcaaatagtgaattatataccattggaaagcttatgaatttagataaatttaggttcaagtttcactcaaatccgagttaaaatgagagagttacgctagtttaaagattcaaatttgaataaatctgagaaattgtaaaaaggtactgttcctaatccattatttttattcctaaactttatccaaaactccaagtgactgacatgcggggcttaggattgtatttgctttcctactggattatttttctaaagcaaatcctatgaaccattgacaagtgcgcccgactgctctctctctctcgttctttctttatcgtcttctacctccagccatcggccgagcagagcacggcgcggctaggcccgggcgagggtgacccgacagcgaccagggaagggagcggcaaggctctggcgtccacctgccggcggtcacggcgcacacctgccggcggtcatggcgcaggacggcgcgggggcgagcggcgctgcaaggccgccatggccgggcacgggtagctaggtgctaaggcgataaggagggtttccgaccgaattggtgagggcgtcagcatctatggcgtgtgagggttccattttgctggctagatggagaggaggggctccgggatggcctgtccacagcgagctcaccggcggcaaaacggtggccggaccggcatggctacggttgctaattggcgaaattaaagggggctctagtttctacggaactagagaggacataggagcgaggacttaccgagagatggaggaacgacgaagctcggcggcgttggtggagcggagaagaagctgccggcatgcacacaaggtgtttgagaaaatgcatacaagggagaagaagaggcagagaggggtggacgagctcgtgggggctcttggggccttgtgatggcagccaacatggtgtgtggggaggaagggagatgggagggggtatttatagggtgtgggaagggtggcttaatagtcgacgcgacggacggcgcacggggctcgaggacgacatgatggcacacggggctcgagagcgacgtgatggcgcacggcagcgcggggctcaaggcggcgacggtgacacgcggtgacgcgatggcgcggcagcggcgcacggggcgcgaggcactgatgcgacggcgactgcgacgcgactggtgcgaggctcggcgcgacgcgggtgacggcgacggtgacacgagcggcgcggcgcagccgacggcgggttggagacggcgcggcgacggcgacgcgacatgatgcggcggcgcggcagcggtggcagagcgaggcgacggcgacggcgccggtgcgggcggggctcgaggccggctagggcggcgcaacagtggggagaaagagagctaggatggctagaaaccaaatcgaacacctaggggctaatgaacagtgctagccaactatttttgaatttagagggtactttgcaattaggaaaaatatattgttgccactaattttgtcacaatgtaaaaatacaccaatcctaagttattccattgaaatttgtattcaaatttaatattgaacttatttttatttttattatatatttttctaagtattcctattttcctacttttagggctttggttgatttataaattgggaaaagttataaattaaatttgtattactcctaagcatttgggtgaccatattaagtgtccaaatgtgaattttcccaaaatttaatattgtccgatatttaagatttattaaagattctataatttcctaatgagaccgttattaacgcagtaacacattagctcaatttatttatatgttagtttattttatggaggggtttaatctattaaatttcaacccccgaatgcaatttggaacttttgtgcataaatacttgtagggttaaacataaataatatactctcttaaattatatctattgcttaaatgtagttcttttctttactttctttgtaatcatttacggtttggaaagcaatagcagttataacaaccagcatgatgcaaaagttttaaaaagttcaaaattttagtgatttttattattgagaattttcaggatgttacaatttgagagataggggattgaaaagattgggaagatacgcaaaacgaggtgagccattagcgcatgattaattgagtataaactattttaaatttcaaaaatggattaatatgattttttaaagcaactttcctatagaaaatttttacaaaaaacacaccgtttagtaatttgggaagcgtgcgcacggaaaacgaggtgttttctcaccctatctcacacaaacgaacacagccttaaccttgagaatgagcgtttcctacccattcaattctttaaggaagtcctaaacaagcaaaataaaactacacctaagaacctgaagctgcagagaacaaggaagaagtagtgaatttgaggaagattgatcaattcacactacagagaatggcatacacgctggcaaagagaagaggccaatgttggaaaacgaaacatttgatgtaattattcagattaaactatattaaagcttgaagtttatgattcctttattttttagacatttgcagaagtttaatatcgtagaatgggctccttcctaggcaacaagggacaaaagatattcaacgtgagcaacgaagcaaaggaaattgcccctaaagttcttgtttgaatttgtaaagttctgtcaaaaatttattcccaatttctagatgggtttcaagacctgaaatgttcatcttaaggttgaaaacaagacagaaatgttggcacatggaatttttatcttcccgaatatgtaaattattgaggaactggtccagctaggcagctagcagacagtctccgaaagttaacaatccaactttgtgatttgttattcttaaggtataacatttccagctagatgaaggacgagaatcagggtaggaacaacagatatacaccaatgtcacatggattaacagtacagggaatgacgaggagacaaggaggccacatgagtaacatgaagcagtacttcagtgatgcgagcaatgaccatagctccataagccctagagcaatcaatcatgcatcgcccaaaattcagggcttagcttaactcgtgcgattaactttttgcctattaattaactcatgctacttttgccacagtacccattgttgtccttgtccaagctatggagacacaatgagcactgggtcgcaggaaccagacagagacaaataattgaggcatataagcatattcatttcaaaatttgtagtgtacgtaattattgcaaaaccggtctgtactggtctaaattttaaagaacaaatcacttcaattcatatatggtctcgttagatgtatagtgtgcgtttattaagaataatggtgggcgtgtttgtactgctatagttacatttaaaagtttttttcctcaaaaaaaacctgggacagtcttttagcaattccgaaaaataattacatgctaggctagctttactttactacattcggtcaccgtgtatcaagtattattcgcactgcttactactcacactgtcacgatgagttgtacatatactagtactgaactcgtagagtagatacatggtatatatattagtactagtattaaacttgtaggagtagaaacatggaagcgtgcacatgccagtacaagtagcgactactccaacagacaagatcatacgagtactataatcttctgcaagaatctgcccagcttttcagcttttattgcttttttttagtgaagatcgtcaggagaactgcctgttctttttttttttaatacaggagagttaaattttttatatactgaacgcaagcaggcagttcttccaaagcaagaaggattagataagcttaagtgcttaaccatcctttttgtggttctgcacttgtagcttcagtccgccgttctttccgtccatcatatactcccgctgtcctatatgtagattcatatttatagttctttttttaccgagagaggagttattttcatatatactacctccgtcttaaaatataaagagttttaggctcagacacaggtattaaaaaagatggtagaattaaatggaagaaagttgtgattgattgagaagagaaagttggtatagaatttgaatgatagaagattgtgataggttaagaagagaatgtaggtgaagaaattgttatatatattctggaacaaattttgaatacgaagttgttatattttagtacgaagggagtagaattggaaatttttttgacagggagtacaaggatacccgaggtcagattctgtcaattttaggtagtttctgatttttgagtagtaaaggaaaaatcagcctatcccaaacacgatgtctccctaatttccgtaggaccgagacctttgggttatagtatttttaaaggaaaaataatggatatgaattcataggaaatttcttagtgaaatcatttggatcataggatttagggtttgtcaaatttatgtggaataccaagtgtgattcaaatctttagattttaaacgtgaactccaacctcatggctttcatttcctttgatatatcgatgcaatatccttttctctctttaccctcactctaatctactcctttcgtctaaaaaaaataaatttatagagcttaaactttgttcaaaataaatctaactcatacgtagtaccttattacttaatattggttcacgaatcaagaaaatttatccttcaataccccgttatctaccaactcaccaaactaattttctattaattagaggcattagagtaatttactctcgttacaaaatgtgcatttggattctaggaactaagtattttagagacagatggggtaactaacctatatcacaaaatttctatattttttctagagtaaaatacatgaccggttcttaaacttaaacaaagatatcacttagatctataaacttgaaaaattacacattaagatccataatcttgttttaataaatcatagccggtccatagcgcgtttgaccagagttggctgcctacatggcgctccacgtaggcagcattttgcatccagcctcctccgcatctcgacgaggctataattttgtacttaccccctactgctaatgtagtcatcgaaatccccccgaatcccttcgtctctttgcattcccctgacgactagggttgcaatgatgaggatgctgttcggaggcggcaggaaacgatgaggtaacgacggtagggacaccgattaatcttctcccttaaagttgaggtccatcgcaaccgtcgtgtcgacgaggaaggtgcgttgtccgtcgcctatcgagcatcgtttgtcgcacaacccaaattaacacctcaatcatctcgtaccgccgatgactgccgacatcatcctcgtgatacttaggcctctcccatggaagcacgcggcgggggggggggaatgcaaagggatttagaatattttgggggatttcgatgactattgtagcaatagggggtaattacaaaattaccaccacgttaagatgtggagcgccacataggcgttcggctatagtcaaacacactttggaccacttatggatcattaaaacaagatagtggatctcaatgtgcaatttttcaagtttacgagtctagatgataatatgacatcttcgcgtgtaatttactcttttttctatgagccatcggaatacatgctttgaataattcttacaaatttttttccatgggatttgaaatgccgtgacattccaatcttgtgcttttattttcttgcatttttaggattttgtactccaaacgagatgagcagttctttttataaagttttaccaggatcatatgaaaaccaggtcccattagtttttttagaaaactaacatcacaattacgagtacatttcttacaaaaataagaaaaaaacaattctaaacccactctaagtactcccttcgtctcataaaaaacgaacttagaattgggtgtgacatattctagtacaacggatctaaatagaggtatgtccaaattaatgtgtcacatccagtactccctccgtactcgtaaaggaggtcgttttggacagcggcacggtctccaaaacacaattttgacttcttgtttctataaaattatttattgaaaattggtatatgtatacttttatgaaagtatttttcaagacaaatctattcatataatttttacatttttaaactcaacaacttaagagatattcataatttatattcataagatttgacttaaacattatcctaaacgacttcctttacgagtatagagggagtactagattaatttttatgggatagagggaatactagtagtactatattaaacacatagttgtactcccttcatcctattttaagtgcagccataattttccgtgctcaactttgatcgtccgtcttatttaaaaagttttttaaaaaatttaaaaacataagtcaaatataaagtaatattcatgttctatcatgtcataacaataaaaaatactaattataatttttaaaataaaacaaacgattaaaattagccacggaaactcatagttgctcgtaagtgagacggagggagtttggttcactccctcactttaacaaactttgccacactttttaagacatatgtttgtttcacttccaaacttgtggcatgccacagttttctaatttaaaggcccacgtgtcatacaaccattttctagtcaaaccatgtctaaggtgtgtccatcaatttataagccatatatttggctaggtttggcaagaaggtttggcaatgtttgggagggaacaaacaacccctaaatttcacacgaatcgatgcatttaaattgacaaaatcccgacgtttcaaccaggcaaactggcaaagtactcgtagaaagtttggtgagactgacctgtcccaaaaagtttacggctgcctgcatgagtgcatggcacacctacactcgcaagtttgttcgtgtctatgctgcccgagatttgtacccatcactgctctgtgacgcggttttcgagatcgttgctcgtcacatggattcccctgacaaattggaccacatggtccaatcttagaacacaatagtagtacagtataagagcaggtataggctataagccagctataaacatattttaaagtgataaaataggagagaagatcagcgggctacaaatctgtagccagctacagcacggattacaagacgtgatgtgtatataacatgtgggaccaggtattaatagtatagtaagcaactattgtacaaatcgactattaaattagctataaataaattggagcttgtagttggatgtactattaaacttgctctaatacttgtactgcgtatagaagcgaagagaaagaaactctatcttacagtcagttctctgtattgctcctcctgctacccatgtccttggatcgatacacggttactctgtacacactgtatatagcgcgctacgctgtacgcactcgatctgacgttgcaaacggtccacggctacatgtatccagaaccggctacttcgagatcagttgtagtagtagtagtagtaagtaacatcagcccttggactaggcatcggtacgtttttcgtgagcgacgaacgtgtggacaagcacaagcgtccgaaacgcgcgggccggcgcgcgggcagcgcaacgacagatcctcccggccggcacggcgggcgtcactgtgcgcgcgcaggagggcgcggcctcgctcggtcgttcacgggcttctcgttcccggcggccaacaacaaggcgctctgttgcctgcctgccgtgtgtgcggtttgcgcttgcgcgcgcgaggcatgcaggcaggcaggcaggccgggctcacccaccatcacccctccctccctcgctgacacgcgccgccggccgggctgcgcgctctcggcgcaggcgcatgcagcgtgggcatgtgcagttgcgcaccgtgccgcccggccggccgttttttttggagggacgtcgcagcgggcgggcggggaggcagacgcgcgcgcccatgcatgcatcgcatggcgcggatggccccccctccggcctgtgcgagacaagggatggaatcaatgcgctttggtgccacgcgaacggacgcatatgcgcgcgcgcgggcgggggcgctgcggcagccagcaagtagtaggttcaccggcgcgcgccccggcccggtttctaggccgagacagatgagctgcatgcatggcgagctagtagtggaccggtggatggttagaccgacgtataccaaccgcgctgtcctcgttcgtggtggaaccgtacgtgcgtggaagctgactcgataacgtaggcgtacgcggtgcgcatgcgacgagctagccgacggcccatccacacccacccttccgccttctggtttttggtcgtctacgtccgtttcggtgatgttgataggaacgtatacgtacgccacatctcggtacaatcgctcgtgtccgtgctccgaaacagagggttccggtcacgtggtggtccttgctctcctgcgtacgaaagcaccagcatcgcattggattaaagcacgcatacgagtatggggggtttcaacttgtaagtcgttgtaacctcctagacagatcttacatactatataccatacacagaactgtttgaagcatggagagctcagtacaagtcagtatgaccgagcagaggtgggtctgtagatctaatagcgtgagtaccttcatgtcagatggtcttcattaataatgtatgcaccgcacttggggccctaacgcgtacgctaacagtactataacccttgttctgggacagtgaaatgcgttgattggcgtggcaagtggcatatcatcagtaggaacagaagaaagaaaggattagcccgttggatggaacagtcacgcgaatgcattgcatgcatgcatacgatcgatgatccattggccatcacgcgcgcatgcgattcgcacgcgttcgttcgatcggccgatcacgacgtactatacaagctcgagatcaatcaatggtgtgtgtatagtacgtgtccattacattcgctggctggcacaagagcggagacatgcatgcatcgtgcagatcgacgcaatgatgcattgctcgattgcacgcagcagcagccgtacgtaggcagacgctagccactgtacactgccctacgctggggggcgccctgccaaggagcatgcgtgactagtatatatgcagatctatctatccacactggctggcagatcgatatatcagcgaattcgtgatcgtcatggctagcttggatggtcagcaaaagctggtgaagtcactcctcaacgctctgccagtcgccaagcatggggctagatgcttaattaggcgcttagcatgcactgttggtgttgggtttcagtacttgagacaaattagtgtaagagtatcagtgtccctgagtacgttagcggcattacatagtcacagtactatttagggcatattattagggactacaatgctccacgtcattttcatatatatttaagacatagaggggtccaatatccattaattccatgcatgcatcgattacatgtcattctgtggaacctccttgatacacaggttaagataaattaagttcgcactttgcaggaggggctagctagttaagtactccatccgtcgtattttaaacgcagacataagttttcgtgtgcactacaagaaaatataatgtccttggcggtcaaaaatagcctgaaaaccattaaggttaattattccgttggccgaccgccatgtaaataccgctaagtctaaagagtcagggatattcagatttcttggcagctaactataaggaaatgtattcttggcggtctgaccccaagcaaactaattttgatcgttcgtcttgtttgaattttttttaaaaaaaaattaaaaaacataagttatgcataaaagtactttatcatctaataacactaaaattactaatcataaaaagttcgaatgatggatgatcaaatttggacacgaaaagtcatggctacgtttaaaatgggacggagggagtactgcctggatcttagacagatgacattttaggacatgcatagcatcaattaatgatgcgtcctatatgactatattactattttttttgaaacatttatcactattcactccctccggcataaaatttaacaacttattataagatgagtctcatcctagtactacgaatataaataagaggctttgatatacttttagcgatatgaaaatattttcttttatatattcttccgttgttatatcatggaatattttctcattgctcaaaataattttaaacattgcgtacccattaaaaagatatttaactatttaccaatgttagatgtgatgtttaacagtttacctggacccacttgtcataaactataaatgataaattattcacgccacgtcttaaaaatggtaaatagttaaatgttccattaaaaaaatcacatgtccatgacggtcatatattatatatcatgtattaatcaaacatggaaacagaggttttgtgctctcaggcacacattatcattcatgcttaagaacgattatctgatgtaattgattcattttcctttttttttctctagaagcgatcgatttcatctctgtagttggcccctttcatttggggtctccgccattgcttgatgcattctcattttcttgagatgtatccattctcaatttttgaatactagtatcacgaaaagtaatatgcgtaagtaaccccaaggacgtacgaggtctctgcatgccctgtaaaaacagtaaaaacactatagtggtctatcagtcgcatagtcgtggggtaatgcgtggcaggggctgtggatgtgtccaagcaaagcaacaaaacgtgacaggtcacagccaaccgcagaaccaaccgaaacagctcatgcatccatgccccaattacccgaccagttgagtactcccatgcaatcgcgtacccagcgctactctagccgacgacgcgcccaggtcggggaccgcacgggagcttaacccattccgcggctggtgagccttgctactacattgtaatttggtacaaaagctgtggcatcctgtacgtgttaattggtgcgtgtgcagctcgatccggccctggaccccctggtgcatcaaaagaaggaaactgggcagtgcacggagtgtacgcttgcgcgtctctcatctcgtgcatatgtgacgctgcccctgcagctatcgagctagctaggctagtactaacagcacgtagtgccaatcgatcgatcggtcgggcagagaatctggtacgtggttgagctgatccacgaccacgatcgatctggtggctgttttcggtcgcggtcgatagacctgcacgtaccgacggcgtacggtacgtgaaacgaaatgtcatgtcctatcgtggttcgccacatgcggctgttcattccgcacgcaccatcaacacatgttactgctagcctgctaggtggtcgtaacagctactctcttcgtacccaaaaaaaaaaagtaaaccctcggttttttatgtccaacgtttaaccatttatcttatttaaaaaaaatatgaaaaagattaaaaagacaagtcacgcatagagtattaatcatgttttatcatctgacaacaatgaaaatactaattataaaaaaatttcatataagacggacagtcaaacgagacacggaaatccagagtttgtctttttttagccggagggagtagatgaggtagcactgcatgctgctgcaccgcgaggcgcgcaaatggtctggtctgcgtctgcgcgcttgctttggtatccttgctggaatgaaccctagtcgctaatgctcccgcggggtttgatgctttgaggaacaggaacgagaaatatgggacgacatcttcgaaagcatgggacaacaggggtatactacttatttaggatatgctagttagggacgtggctcgatgaccatatacattcttggggacgatggatcggaacgagaggacattggagaagaaggcaaggtataacatagcgtcgagaccagagaactcgagtgacgctcgcacaagaagaggtggtgcgagcaaatctagtgccaagctcctccctttctctcgttgtgttgttagctagggcagatggacttgtctggcccgttaacataatcccccttcacttatttccccaagcagctcccaatcttttgttctcctgctcggttgctatcagtcagtgcctcttgcacgaccaggcaacatagaacctccatctccatcccttcctcttctcttcaccacctcttcctttatcctgctagtaacatgtctgctggctgaggcaatgtgatggtcgttgtcgatgttctgtagtcgacagatagatttgtgagggacctggtgtttggcaaaaggggttttggggctatgatcactaaatcaaatacaaaaatattttaggttgggtcatcggaagataataaaccccactcctgcttggttgtattatggatgaatgaacaataattgcacaaatgctctagtcaactcgcaaggtgagcaataacatgatggttagggaatgacgttgtcaactcgctgccaaacagtaacggtttaatatctggttcacctaaaaatcaactcgctagacatgcatttagagaaccagttggttttcaggtgaaccagacattaaaccactactgatgggaccacctatacatttggcgataaattttctcctaaaaatttgacagatgtaattgtaatacaatcgtagtgtaattacactgtaacttatatgtaattacactgtaacttgcatgtaactacagtgtaacttgtacgtaagtttcatgtaattttaaatcattatatctattacaagatttgttttgctgaggaagaaaaaaaatcacggcacacacatatgtataaggatttgttcccacaacctccattttaccgaaataacatattacagagagatttttgaaagttacatacaagttacactatagttacagtgtaattacatgcaagttacagcgtaattacactacgattgtactgtaattacatctgtcaaatttttgggagaaaatttgtcgacaaatatatagcaaaatcgctactgattggctagcgagttgacaatgtcatgttagaataaatgggctaggcccgatttattctattaaatctcaaaggcccataataaatgttaaggataataataccaccttgggaattaaaagaggagtatctcaacttaaatagggagttattggaggctccctattgaccggttgaggtggggatcggaaagccacacgcgcggcgcgccgggccgaggccgtggggttcttccacaccttcagcctcacaatccagcggagggacattcacaggtataaccttctgcgtttactgttatttcaatttttgatatctttgttagtcgcaattctattgcgttctttgtatgatgatgatgcttattctatcttaagcatgctcctgttatgttagattttatcactagatcatcccacattgttcatgcattattattgtcttaatattttggattaaaatatgccgatatatgactatatttccaacacgtcattccctaaccatcatactattcctcaccttgtgaatagaaaggaataataacataaatgtatacgtgaactacgaccgcccaagccaagactagtgaactgagaggtcggtcgggtcacccaccgattctagtttttttactatgacgattggccttgtgctaggtgcaacaccctgctcatcccatacatcaatcacgaccctcgatcagggaacaaaattcacaggacatgaacgttagctcatctggtgatccaggttacttaggaacaaacagatgcttcgttcccgggacaggaacattagctcgtcctgtgatccaggttacttaggaacatatgacagtctagggacaagtcaatgacttactgagcttataaagtgtaaaggttcatttgaaacgaatagaaaacaaaaattaaaaaaaacaaaaaaaatagaaaaaaaaggtttttgacaaggaaaacaaatgcaaaatagataattgcaaacacacaagatggttgtttggttaggacgtgagataaacgcaggaatcggatgaaaaagatattagaattcttgctaacttttcttcaaaatacgtataggattgttcattccgtacgaatctccaaggaaaagatatgatttaatcctttgcttcaaaagacttcattggatttttttcttatacgattaaaatcttctaaaattctatgtttttcatacaaatcaaaatcttctaatttcctatgtttttgctaacaatcaaatggaccctaaatgtggtaaccctaggcccaggatgtagtgatatcccatattcccatttcgtgcaccaagatgatggatttccattgcaacctggctattgaggatgaccatcaggtatgcagcccatgaaacgagaaactgaacaaatgctgcctgtcagacttcataagttcgggccattgtcagaacaacccacgaaaatggcccagcggaaaagcaccatccttgattgtcacacacaatggaattgttcgatattgacaagagcttctacgtggtacaagggcatctacatccaaagccacccttagagtgtcttcactaactgaggatcctttctagggaactcatctctcactgaaggatacctccaatgggttcttcaaaatctgagaccacttgataaagatactccagcccacaaagtgaaaaattatgaaagtacccttctatagcccagctaaagggctcatcagcccaccgacgctgccgtccttgtctcttcctctcctcttctcgtctcctccatagatggcgaacggtgcacggtggcgaaaggcgagcagcgcgcggggtggacgaccgcgaggggagcgcggggtggcctctctctcccatcggcctctctctcccgtcgtcggctgccgtgaggtcgtcgctgtcgcggatcttcgtggggccgccgatggtgcgcagggtggccaacagctcctccaccacggcgagcggcacgcggaggttggatcttgagtgccgcgccgccaccgctctccctccgcccgttggcatcgcggggtcgtcgccggccctggatctggtgagcccgtcgccgtcgtggggccgtcgccaccgcggggtcatcgcagattcgccggctcctccaccacctcgcctcctctagctcctcctcactgccgtgtgcctcttgcctacttccaacgacgagggcgaggggtggaacggtaaaatataggggtgggagcggtgtccactggacacacgccaggccaccgcgcacccaacacgtgcccccacgccgtctcaacgaaaagtgaccgaggggcgtgtccccccgctagtagtcgcgtgcctagcagaggagacggctcaggcgcgaaaggtaactgggtcggacggccatgagcaagggcacgaccctaagccacccattgcttatgctctaacatgagctcgatttcctagtacaatggactgagtccaagagcagagaactattaagcctttcacaatgctcctacgtggagcgttaccttgttgacgtggaggagaaaaggaggtgggtctcgtgcccttgcaaggtttgcgcctcctagctagggtccgggttcctcatgcctgaaaaagaaagtgcgagcggtcccctctctgttgctactcccaaatgttccccattcgtccccgccaacccacgctgccatgccaagatctgagcaggcttggagctcgccgggtgccaagtgctgacgaggaagaggagaagccaaaggacgggaaaaagcggcggggacaggttgggtcgcggcgatggcgatggctagggaggaatgggcggagaggaatgaacgaggagaggactagggcgaggaggtagacccactctggcgagcttactcgattcgtcgccagggaaacttgattcagcggcaaccggtgagctcgtcggctccacctcaagggagaatcgcctctcgatccgcgccgccgacctcgtcgccatctcccgctcctatgccgccgacctcgtcaccgtctcccgctctgcgtcaccgaccccgtcgccgcccccttgctccgctctgcttcgctgagttcgtccccgtgctccgctcccgcgccgtggagacgagaccgaggacactgtcgtcttgtccccagcctccacggcattgtggatctatcgtcgccccccccccccctccgccgaggttaccacgccccgatggtaaacacagttaccgcgcggtaaccatggcaaaccatacgaaaccgtgtaaaatttatcaaaatttcaaattaatttttaaatttatttgaatttaaggaggttatcgtggtttttcttttaccattaaccgcgcggttactgacggttttgcaaaccctggctaggagtagaggggccctgtgagctctcgcgctgccgtcgccctccgcgccctcgtcgacggccagaagtggaggggccggtgagctctcgcgccgcagccgccctccgcgccctcgtcatcggcctgtcggccgaaagtagaggggctagtgatctctcgcgccgccgcccccctctgcgccctcatcgccgaccggaagtggagggaccgatgagctctcacggcgcccccgtcaccctcgttgccagcagggagagaaggggccccagcgagttctcgtgacgccgccgtcgccctccaagccactggctgggaagaggtcggggagccgccggcttccgttggcgctgttgtggtggattggggaacggagagattgagggcgggggagaaattttatactagtttgtacattttagggtgtttagtggtaaattttgtatgttatgttgtttgaaaacatgtgaggactagaatagaagatgacaagggtttacatgaaaaactaagaacaccctaaagcatctttgcaccgtgggagaggaggtgtggccttagcctgaggttcctcattttgggtagcttgcactgtgagtgcctttattagagcaacaagtaacaggaataagtaccagtgaacgctcatttttttcctccctaaaacaagactcaaacatctgcttccaactgtgaaatgatgctcagaaatacttgaaagccttgggccatatctgaaaatagacagtactcgttctttgcgtggtatgtcttgagtaagcctacaggaacagaagaagcatcagataaacatttacagcacactgtctacatttccacttgtttaccgcgatagtatatcaatataataggatgccaagtggaactcaacaaaaaatgaacggtatacataatttaatctatactactctcaaccatgtgaatactgttaacagacttttccattaattgttcattgatgacatgacctaaagaaatcaggaaacagttttttggtaaggtacttaccatacccagcagtctgaacatcaaacccttcatcctgcaaagtttgaagaggaatttgttttagttaaatggcgattgttcccaagataacacttgcaccagtttcctctcaaacctgtaattccctaatcaggggcagactcccagtaatggaatatggttccacgtggccgacaatttcctcagttgctttgcataatgcttgaaagcctcgcgactcgagattacaggccaccccattcataatatcttcatcaatagtgatctcaagcctagcaagatcaatggtaagtaatggcgaattgataatcaatctgtaaattatgatggttactgttactgccataagagaataaagtcatatatgcttcaccttcctcggaggttttcatcaggaagaacatatttagataccggaccacgagtaggaagcttttcaatgttctcatttatatcatgtacatactcttgtaatttcttcactacagatgtcgtgctgtatgaatggcaacatgcaactgtcaaattaaaacaacattcggcagaagtggagacaaaattatgagagagaacagtccatgcatgaaaaatgggctttacctgtagaaaggagtcaacctgtaatatgtacaaaaatatggtcagtataatttaaaaaactatttttcaatgatatggaagaaacaacagaagcatcagtctttattgaatgttgtgacttgtgaaatactggtgatcccattattttgtttcccctagtcctgcaaacatataaaaatttgtgcagtgatactctgctgcattgtaacactaaggccccgttcttttctgattaagacatagattttacctcggttctgttagcacgctttttaaaaagctaaacggtgcattttgtgcttaagctttctatatgaaattgttttaaaatatcatgtaaatccatttttcaagtttttaataattaaaactcaattaatcatgcactattggctttcttattttatgtgccctaacttcatctttagtagaaaagaacaccgcctaaatgaccaagcaaatttatggtagggcccctgggaggaacaaagcctcaccaaccgcatgtccccatgcctataacaatgtatgaacataataaaacaaaagcttggaccatttttcttttgagtacaattaaagtgcattcaagaaccatatagcaatagttggaccttatatcccctgaaattgtacattctccaggaatttgattcagacccccaccaggatctgcaaatcaccatttgttaattgcatggattgtacacagtggttttctttaacattaggaaacacaactaaaaagttgtaacattagaaaacacaagtaaaacttgaacatacagctccattttgttggtttgatcgtagatggggtagcaaacttatagagcttctctttctcatgtggagggaaatcgttgtaaaacatagtctgtatttctttcagtgcttccatatttaactccatggcatttatggcctgacacacacaaaagaaaagtaattcatatacaaatacaatatttgttgtctcccaacttgtatgtttgaaattgttttgtccctctaagccaattgaatattcgaatgaatcttccctagcatgatgaagacacgttctgcactttttaccccccaaaaaaaatccaaggggtaatgttgcaacagataacatttcaaaagcagagtgatcacgctgtaagttgcaacataactcatgtttaagcagtcactttccttatcctttttgtgtcatttcaatttggcattgatcaatataaattgttgcttttgcactaactacaaggatgcaagcttaatttatgcagctatacaatttaaaagaacacaggtcatagaaaatgaaccatatgctttatgcattctttccacgaagcagtgtattgctggaacctactggagctatataacacaacaagtacactattctgagttctgacaagttcaaatcaggtaccttatgtgcgaggccactgtggaatagcttcccaattgccttcagatgccatgtaatcactccaccggtgccgatgcaaggctgcttatcggccgtatctatccaaaaccttcacaatgccacacaacaatgacaaccaaatcagcacatattcctcacgaacaacacattagtttagtcggacattccctccatgcatcaaacagcacaatactcacaagggtccattcttgagcttatccagcaacccatccttcacaaggccatcgacaccaatgccagtgataagtgagttttcctcattggcaatgaacaccgcaatgaccgaatgtttcagcaccggcttgacctcaccaagtctcctcatgagctgagcaaccagcgccacatggccaaggcagtcggttgtcccacggcccctaagtttgtccttgtcttcactgtcaaacgttagtgagaagggatcgaaatcctggacaagtagagacgtttgggccaccaattagaaccaaggagaaatttacttgaggtaaaccttttagtaatttgacgcaacaaagctagcacgagcaaaaataaacatcatgaaattgagcaaagatttttgcagtatacaacacagtggaagtaaacaatatgccatttttcacattactatatcccatcatatctatcaatatgcttatgcaacgctagcatgcaacttattattttcttacaacaaccacacaacaaagcggttattactatggagaaatcaccagctcacataaacaaggtcactactcaccaggataatccacccgtaaatatgagaatgatgcaatttaggcaaccatcaacgaaattagataagatcacaaaatcaaaatatccggcagaaacacaccaaatcaagcaaccactcaaatcattaattcataaagaagcataaacttgagaagcaatttttgacagcgtcaggagaacaatctccatagcaacctacccattcgtcggggttggcggggacgacgtccatgtgcatgccgacgaaggagatggcgcggccggggacggtgccggggtactcgacgatgacgttgctccggccctcggcgtagctcaccttccgcacgacgagcgggccgcccccggtctccatggacaccgggaggagcgcgtcgaccacgtgctgcgccacgaggtcctcctgcgggacgagggccggcgggtcgttctgcaggcggcgggactcgccgatgagcttcccgaggagggagacgaaggggtcgcggtcgaggccgcccacggcgtccctgagcgacggcgatgccatctgatgcgcttccttgagcggcggcggcggcggcggcggcggctggggatcggtcagttgcgatgggaacctaggttgctattcgttgctgggagattgagtgagagaaaacaccttcccaaactacttctccgtccatctcataatataaagggagaattgcaaatataccactactcttaccctctaattcgaaatagccattaaaaaaacgcagactgcaaatttgccattaaaactgatatgtgtaccttccgtttaccattaccgtttgagctagtgcaaataagaagacaaaaataattcataaaactaatgtgaaaaacaaagctgcacaacaagaccgttttgcccccctccctacccctctcgcacgcagaagcccccatctcccagaaaggcaggtcccgattggccgattcccttccctatcctcgaaccctactacatccccaaatcctctcatctcttcttccaaatcaagagcaaatcaaacaaaaattggttgcaataaagtaggatatggtaaggcagcaaggcggggatggattttgcggggcagcaaggcgggcggccacggcgtgacggcgcggcggcagtttgtgacgctacggaagcagcagcggcgagcacggcagaggcttgtgaagctgcggcaaacaacatcggcgagcacggctgcatcttgggcagctgcagcggcttgctgcttcggactgcagtaacagcaacatgttgtagcagcaccatggcggcagaagaaaaaggagaggaaagactctgttgcttcaatttccttggcaaggtaacattgtcctaattttcatcaaaaccaaccttctaacagtgttagtctgatctgtgagtctaatggcaaggttgttgggttctatctgtgtttggtggcaaatatgcaataaaattttttataatggcaaattcaccgtaccggttcaaaccgatggcaaatatgcaattgaccctaatataaaatataaagattaaccactcgtcttattaaaaaaaatttaaaattattatttattttttaacttattttattattcaaattactttatacataactttgttttttatatttgtacaaatttttttaagataagatgagtggtcaaacaataatcctttatattataggacggaggagtactagccgatgtgtttttctttaaaaaaaactctattgaaaagttactttaaaaaatcatattaatttattttaaaattttaaaatagttatattcatcatgcgctaatagctcaccttattttgcgtctcttcttaatcttcttatttcctttactctcaaactcagccaatcaagtccctctatccaaaataagcgtagctataagttttcgtgtttaattttaattgttcgttttatttaaaattcttttatgattaataattttattgctattagtatattagaataaaacatgaatagtactttaattattcatcttatttaaaaaaattttatgattaatatttttgttgctattagtatattataaagtattaatagtattttatgcatgacttatatttttagattttaaaaaaaattaaataaaatggacaattaaagttggacatgaaaacgagatcgaaaaatagatttgcaaattagagaaaaaaagaaagttcaaaaaatctatctaactttattatcgagggctgctataaaacgggatcccactacaacgggatagacatattaactattctcttgcgagtatcacaggtttcatgtcctcggtattataggtaccatgtaacatggtattacaggtatcgggtaccatacagctagtatcacaaaagaatcagatactatctcataaaagggtatcctaatctaatgggatatcgttgtataggttttctgttattttatgaagttctaatatttttacgagatcaagaggaggctgtcccgactcccgtacgaatcacgcgacattgttagtgtcaacgacgccacggagatgcgtgccatatcgaatcggatgctcatgcgctactaccctattcttaaaatatttttctaaaataagttttcacctttgtactaggtgtagtaatatttttttagaataccttttgatttcaactctgtaggaattaatttattcgtttgtatcttaataaatagctatcataaaaatcagctgactcctcagtttttctctatctctatctcaacccatcaactactatgatgaaacgcaggaaatatttcagattcctacgaaaattgattcgataccaatgtaagccctataaaacgcatggactccggtggcaatcacaaatagtcattcgcaaaagggcaaaaaaaacctcaaaaaatgttaagacactgtatacttcaggagtcgatgtctcgagcaccgtcgagtcacatgtttatacacattgcttctgcaagtgaattcacccatcaatttaataagaaagcaatacaaactgccaatgagtatatgtatattgatcaacaagaacaaacgctaccgccatcttctcatatacaaatgaaaatatgccctaccacacaaacaagactcaggggatactagatatcccgtgtcaaaacgattacaagaacccaggaaaatttgtctgctctgctctaccctttgccaaagtaatagcttaaagaaaaagtggtgtcatatgtaatatacatgctttatgatcattcatgacgccgtactagaaagaaagctccgcgaatccttgaaataaccgtgccaaatacctgggacttttttcttcatcgctaacaccttatctcatatgatccagcccttgtgatgtagcgaacccactcaacggtgttgtaaccgctcttctcccacacctggaatatgcatctcaacatgagttctgaactgtctggtatgtgttaaaaaggttctatattagcattccctgcacgtaccttaaggaaccgaactcgtaacccagaagcagtaaacataggaacctacagaaacaacaaatcagaaagcatggttaaacaagataaccaaactcgaaggcacattttatcagcataacaatgaagcagaagatgtttttttttgtaagaacacttcaagataacacctcggataataaacatactcaaaggccaacgaatgatggaataccatttttttttcttgtgcatgctcaagtttaattcataactgttatgatatctctaacattgcattttctgtaagctcaaaaataaaatgaactggctgacagattttgctaatgataagagggttgttcaaaaggaggtaaaattaacctggaattccatctgaattggcggcctgttccatgatttcttttcccccattgtagaaatcagctcaacttcggcactcatggttgcctcagtttgtccaggaaacttcctgatcctataattgcagaagtgtgtcaagacttatgagtgcaaaaggcatgctaataaatttgtggcaaaattggcaaggagtagctcttcaagagtaagaaaattgagccaatatagcatcggatacagctttgtacaccgtaaccaacaaaaattggtaggtttatgtttatgctctgccagaacaagacctaacccataaaaagaaaagccaaagaacatctttctcatagataaactgctatatagaaataatttgcacttacttccacactagggaatcaattgaagcattatatttggctttcccagatgtggtttggaaactagtctttgctgtttgttttggaacagggactttgacgacaacaccaagtgcaaacatcttagcaccaaaaacactcttaacctgtgtaaaaggttcatcgtgtcagaaaacgtgataatggcctcatgcattcacaatttcagatatgcacacttactttaacatttatctccatgcgtgttcggcccaattccttaatcgttggtagaacccggaatgggagatttacaccctcagtgattcgatatctacaacagaattttgtggtcaaaagccaagtaaagaataaaaatgtcactacaggggaaaactaatacaagcataaggagggatcataatattacttcatcaattcaaattcaccgtctggcggcacaaagctgactgtcttttctgagttaaatcttgtcaagttgacacactggtggaatgtgacatcatcaagctcaatggtctttccgctgttgaggaaaaaggagaaccgaccagcagacaattcagttaaagtagtaaagattgtgtacataccatataaactatactaatcagaaaaaccagatgctcaattttttttcttcatgtactaattattgataaagtgatacctctttgcaggcctggacttgagttgagcttctttttcaagcccgatcttgtcatttaatcccaatttcagatcaggcattccagaaaggaagcacttcataagaatcttcccagtcacatcacatcgtagaacactccctgcagagaaggcaatttccacattaaacatcagtcaaagcaacattaaggacaacaaaaacatcagagcagtacaataaaatcatagtaatccatgaaatacctttagaagacataagaagatttacactttcaacaatgtccaagaaaacctttcaagagaaaagaatactatattagtgtatctcaatgctaaaaagagtcatgcaaagtgctaaaaagaaataaagtatgcagaaccaaaatggcaacaaagaaatcaacaaataaagtatggactacttctgtaacaggcaatctagtgcacattgacaatatgtatgaaaactattctgcatgtcgaaatacatgcagcgttctgacattactagcatctatgctgagctgggattattagaaatgctagctagctagcaatgcataatatgtccaaatacagatgaaacttggaggtggcatttggaacaggcacctcgttcttcttgtacataagaccctctcttctccaaccaacagcaccagtaacttgtagagtggcattcggaacaggcttatctgaaggctatcagtgcagagaacaaaaaaaaaatgattcagatgctttcacacaaaataaatgagcaacaaactatttgatgtgactttttatccggttatcttatttcaatgtcacatttttctcaccttggaggaaaatggcgaccgaactccttcttgagttatatacaattttaagatttcaggtgagaggttttgagggtaaccgaagtccataatttctgcacagttagatgagagagacagttctacaggtaatagaagcatccacagtgcaaattgatgaaacaaagtccaaaaataagatgtcccttaccatcaagaagctcatagattaaaacaaagttatttctgatagcatcttcatcaaaagcaccaccaaagtatgacttgaaaagagccactgcctggtaatttacaaaaaaaatcatacataaaaaaccgttcaaaacactagaggatgatatgcaggtatcagaaggatatatgtctagaatttataactgaagcttcattattgactcacatctaccaactagttaaactaattctacgcccagtcagcctcatcaaacagggcttaagaaattatagaaagcatcgaaacagggcttaaggagtattttccagcaatgattaacaaggaacatcgaccatgtagccattcaaggaaaaaaaaaacttttggttcctcaaaaaatcatcaccatttacgcaattacgcttaagcgatagaaaattctagttgcccccaaaacataccatcattagatggtaaaactgtctaaacttttcgacggcatattgcaatttaaaattattattattattaaacaggtaacttcagaaaaatcatatgcctctttagtaactaatagattcttttgctctggacttattgaggaattagactagccatctatgctacaacacactaacatagacataccatttctagcggaaaaaacaacaattgacttcttgagcttcatattcatctagatcatagagatgtaatatgtatgcatgttatatttattttattccaaattattcaaagatgatataaattgcatacctccacgacaaacttgaaagcacaagcaacattagcattgctgctaaccacgatcacaatatagacattactaatcctcatgtaaaggaatgaacagcctcctatttgccgaacagggcatgtacccagttcttttgtttgcataatgtgcatcctgaatgcatcaaccatatttcccctgtatagtcatacataatgagcaaaacaggtggtcagtaaacttgcacgcaaccaaataccaaaaaaaagagggttttaagtaagacaagcaaaccgaaaatgtttagtggtagtttacatttttagcacccttagaaaataatggctatcgtattaaagacaacaaggccacttgctatatctttctcgatagtaaaccactaggaaagatcatatgagctatgcagcagtcagcttatatgaaatgcttcagtcaacacaacatcgaattcagaatgtggaggggaaatagtataaagtcaattgtttcagataatcgaccaccacagcacagccatccaaggtgaaatcgaactaattctcctattcagtatttcagtcagtggcatcttccttcatgctgcaaaacatgtagcttccacaatcacaagctaaagaacgagataccattccgaaattcaaccacatggtattgcgacaacctgagggtaggggccaaatttcagcacgcaacgagtcaatccccgcatcccgttcgctaatcgaagcctttccgagcggaatttcacgagctatccactagacctcgcgcgatccgcgcaacggcgagctaggaaacggagctaatcgatcccaacggcctcagatctaccactccaaaccacgagcggcgcgggcgcaggaggcgcggcgagacgacgaggcgaggcgagggggggatgattgcgaacggtactacgcacccgacatcgtcgcggtagaggcggttgatgaggacgtcccctcggaggttgaggaagtagatggccgacgccgccaccggcatcgtcgccgcccgctcgcccccgcccgagcgcctggcacacacaccccgctccccaacctcaacgcctggatcccgcggcgctctccgccggcgacaggtcggagccggtgatccgggggctcgtcggatggtgaggtgaggcgaggtgagatgggacgcgggttttggttagatctcgggggcagcacgagcaaccagccccaggtcgtcttcccttccggggagctttttcgtgtactttttcgagatggacctcgcaagagagcatatttccgtggtcgcctattgtaggtaagctcggttggtgttggactgatggcccccacgagaagtttcaaatttcatcgcatctgaaacagtagtagcagcaataatcctgaagaaattttactagtcccaaatccagaatgcaataattgtagacctgaaaataattctcaagaacagaaccaatgtagtcttgtggagttggttaacaaacaagacaattttttctctcttttgggatgaaagatagaccaatataatggatatgtcaattagtcatgcatacgtaattagactttattggaaggaagtatttttctaaatttttcaagttatttattgaaatttatgtaaaattatgttcattcttaattaagctactagtaataaaaatcagaaggcaaacagagttgcatagttttactggaagtaagaaagacttcaatacctattaagacatggaaaaaccatcgtcccaaaacatttgcttttaagtaggtctactcctatttgattaaggttgttagcttaattttttactactttgaaaaatattgtttcatatatgataaatcaaattgaaatttgaatcaaggtggggttttatgaaacatttagaccataaaaatatgtgactatgtgtcacaagtcaaaagtcataatgcatgcagttttctgcaattttgaccatagaacatgtggttatacgaaattcactctttttttaatgattaacgtagggtcgtattcaagttatttagctcataacatgatattccttttgttgagatttacaccatgagtagcatgtgttgttgccaattaaataaagtcttgacatagggtaagatgcttggtatacttttgttgtggtatcgtctatttacccttaagagaatgttttgatttaaaaggaaatatatggacattcttttgcacataaattcatccattcgaacatgtaagtgatcaattgccacttttcttgatttccatggcccgatatgattatatttgttagaccaaagtaagattcgatagttataatataaggttttaaaaagattcgatagttataatataaggttttaaacacttataacttgtttgatattgtcaatacaccctctcagcctctcctttccctcactgagggttcccaacaacctattgttcgtggtggaagcccataaaattaacttacatggactagactataccataatttacgaggatgtctagcctactctactctattttcatgggcattaccgcattatgtgcctgatctaaaaggtcgtgaattattatctaattaatgcctcttttcaaatgcagcctcaacaataagaccatctaagatccctctagaatttactcctcctgctccctaaacaagctcctagcaaactcaaccgtaacttctaagtttgtcatcaatattatactaccattatctcaaaatatagcaacttttagctatatacttttacatacttctaggtagagtacatagttagaaataattatattttaggatgaaggttgtatgagacatgtgacaaaagccagactgaatgtagacaacgggctcacgcataggaacattttgttatgcaacactaacttaccatcgaagtgttggagttaagaagtactctttccgttttatattgtaagaccttttggtgttacttacatttattcattgatgaatgtatatgttttatatatgtgtctagatttattaatatctatataaatacaggtaagaaattcttatattgtgaaacgaacgaagtgtcacgtattatcgctagaagatgtggcctgtaaaaaagctctattcatcaataccgatgccgcaatttatagattggtggtgccaacagctagaatttggatcaggggggataatatccgaatcaaacttgattggtttgttcgaaaaaaccaggggaaatgtcgcctgaaaatctcgatgatatccttgaatacttgaaatgcattacgttccctttttttttgtacgtgatgagaaaacacatttccgatttttttctgtaaaaaatacacattctttttttcgagggaccagaaaaaaaaacacaatttccatctgctttgttgttacagcttagccacggtaatcagaaagagaggggagaaagaatcaatcgagcagcctgaggtagtccctgaagtcggtagggaagcacgcgtactgcctccagactaccccgtggatcctaaccatcctcaccgtcttctgcttcgtcgacggcgagctctcgacgtggagcagccccaggagcttcgcgacggcgccggtcagcatcatgtcctcgaggaccttctccgacggcgccaccacggacacgagccacagcaccttgacggcgagctgcgtggacagctccgacacgcgcagcatcgtcctcgccacggccgccaccgacaggtcgtgctccgcgaaggcgagccgcccctcggggcacttgcacagccgcttcagcagcagcagtacccgctcggtgacgcggcggtcgtcggcgtcggcgaggagctcgacgaggacgtgcacggcgccgacctcgacggccttggcgcgggcgccccgcgcccgctccacgacgtcgaggagcacgtcgagcgcgcgcgagctgagcctcgtggaggcctcgtcggagaggagctcgaggagggacttgatcacgtcgtcgatgtcgacgccggcggtccagtcgccgcctgatccggagctggagatcttggtgaggatgtccatggcgtgcagcctcgcctcggcgccgccgcgctggagcagcgccatgacgggcctgatgcactccggcgcaaggacgacccgcaccgacgcctcgtccgagagcgggagcgcggcgagcaccgcggcagcctcctcgcacgcggcgaacgccgagaagtcgccgccgctctccgccagcgcctgcgccatcacgcgccccaccacgcgcaccccgcccgaggcgacgaactccccctgcattgccacgtcgcccgccatgcgggccctcatgctcttcagcttggtcaccttgaacggcgtctcctccagctcggccagcgcagccagcaaccgctcctgctccagcgcgcgcgacagcggcgtcgccagctcgtggatcgggctcgacagcgtcgacgtcgacggcgacgaagacgacgacgacgacgagccgcgatcgagccacgacgagatgacgcgcttgagagtgtggttgggagtgaggtcgaagttggagagaggctgcatggtggccgggcaggtggtccggccgtagacgaagagccactcctcgatgctccggcggtcgtacgtcacgccggtggacaccgtcaccggatcctccatgagctccatggagatcgggcagaggaatagctgaggaggctcgtccatggcggccatgggttcgcgtcgcagtcacagagctgaagctgagcaagtaatgacacggtgggctcattatatatacttgtaggggcatatgggctggcaagtgtgcaagtcaatagtcaaaggtaagagatgcttgcaattagtggtgagaaggtcatggtctcatggaagcttgatgtgacctgtaaattggactttttcaagtgacgtgcaaaacatttccattttctaaaacatagtatatagtattatgtagtatttttcgagatatgtatgccatgccacatccataaatctgatggaaattggaaatgtttgtggccatacttgacaaatgatgaccaagtgcaatcctaatatctccactaattaaattttactggagtagttaggaggagactatgcaatatgcatggtattaatttaaaacaaaaaacataagaaaatgacaaatgtgatatgcatatcatgaattgttaaatggagacggcagacactttgggtgtggacggcagatatcttccgattattggtgttgatttttaaggattttcatgcttttctcttgcaaggctgtatattgttgaactcttttgcttacagttcatatgattttagttgcaggcggttgagcgcttcgcacgacgatgtttcctgtcctagaagtgagacgcgcgcgctctaagctcctcggagtaaacaagtaagataccaccacttgctcaagtcaaacgccgaaagttcttaacatttacaagtcaagaacaagataccatttcctttcaagaacggattccgtactgaaaatctcaaacgtctttgcagtgatgcagacgaaaataattagaaaggtgattatgttttgtttgcacaattgtgtacgctgagctaacgtgcaatacaccaatagaaaaactctctgatctgaggatgcataagtatacatggaacgcactatacctctcagatcatgttcgcattgaccctgtaatgcgattcgtatctcagtagccagtaggtacgtcacaagcagatggctttcaaatccttgaaaaaaaatttatcaaaggactatttaaacgcagctcatgatcgctaagaatcattccagacgttgactaatgcacatataaaatgcatcctaagaattatcaccgatcgtaaagccattataatatatcatcagatgcttcgtactaatctgccaagagatcgtgctagtcgtacaagtgatttctcctgtaaatttcttgttacctaaagatccaaccataggctagagtatctcaaagatttgatatcttcatctgggattcctccgttacaaggtttacctgatctttgcaatgactttgaaactggggatgaatggattacatagatgactgcaggtcaatcttatggagttcggttgcaactatccatttcagatcaaacggttgaaagttgaattgagctgggaaatccggttggaacaagcatgcagtttcagaattgagtgcacacatttgtaatctcagagtgtcacttataaatatacctagctttacgccaaacacaggaagtgaaaacgtttcagatatgaaattcatgcaaattgccatcattccaaatggagcgttaagtttgccttttacttcttgcttagccgataccgaaatcagaatcaaatgttagaaatcttctggtcgacggtgctgaatcgttgactgaatcatcaaatggatagcacttgcaatttgtttgaaaacaagctggcgtcgacccataccaagagagatcgatccagccagcaaaaaccacggcccattccaggcaactgcgaacaacagtagatataggaccaaccgaacaaataacaactgctgtcctaattattcgagcacgcaaaataccaatggactatcaggagttcaggactttacgaaaacgatgttgagcaccacatgagggacacattttcaatttcttcaccatgaatatccaatcatattacatttccttcccattcctgacatgaacatgaaaacggcgccttccaaagacgttctttctccaaaaatgaaagaagtgtcaatctctatgcagcatagctagccagctaggggggaggggggtgagggaattgtcacaggtgagtatgtaaccaatcaactaagcgggtcacaaaagaaagtgttcttaactctgctttgcaaagggattcctcatatgtgtcatctctctctgcaatcttggtccaaccgagaattaactctctagcacattcatggactgtgttttgtgctgaagctaagatctagaccaacgctggctccaactccaatcgctttgacaaatgtatggagtgcatcatctgtcagccatctgtgggtgtttctcccctgatgagcataaatgcagttgctcagaggctctgaccagctgagatcacttgatgcgtcaccataaatattgacatcgacattgttccaactgatcatcacacatatgttccggacgacttccagattctcccttccagagaaataaccatgacagtgacatcatcatggtattttcttcggtccccttgaggtatatctagtaactcataaaaatccatacctaaagaaacaaaagtaaaagttaaatcatggtattactgagggagaaaggagaaaaaaaaaggtacatgtatttgacattaaagacaactggaaaccgtttcgacaagacattcatctattgaaattcaaatattcaacacaaacgtgtaccaatgatgatgactgcaagttgttcataacaatcaatacaaaaatatcctacagtagagccaaaattaccaactgaaccatggtgttctttacaccaacaatgcaaaatttgttttgcttaaccagcttgcaccttaggacacatagtgctgaaaaacagtatacccagtttgcaaaatccagctgtagttcatttcttggcaagagggacagatgctccaagtgtgcgagcatgcaggctgattagctcactggcccaaacagtttcgagaaaccataattgttaagctaggacaatgtcaatcatctctaacactctaagccatagtggagtttgtgatgtagtaaaagtgtaaagtgtatcttggtctcatatacaggtgggcaatgcaataagccaaggatacactggtagaattttatcaaatcacaaacttgagggagttgcatgagtatctgactatttcatcaaacagaactttatgtcaagaatgattggtaaaagtataaagaagttcctcacatgccatggactgatataggaagttttgacaaccgagacaaacatgtgcaggcaaatcaatgtttgcacataatcatccaattctatacgcatgatgttatatacaatgacaaaaaaaaccacccgagaatcaatcaggaattgaaataagcaagaggtatggtatagaagagagcctaccagccttctttgctgcacgagagagaagctcctcaattaaactttgtgcaggatcaccttctggaaacctctccatgaaattctcaacatgcaaaactacctcctcgttgctcaggtactgatataagccatcggaagaaagaaccaaaaactgatcccttgcagtgagcttgtgatggcaaagcgatggtgtgcatgatatatacggtgtatcaccaatgtaatcattgcggaacatctctaacaatccattgttcaattttgcctgcacaaatacacgaagttctatgatcaagaattatctagtgtctatattaattcaatcagggcattggattaatcagaacacatgacagatatagtttctagttaaaagtacaaagtactgacaacaaatgcacttgctctgaagatggatatgtataccacacaaaacaaacatcgtaagtataagaatcaaattaaaagaatggctgacccactcaaacagtatcacaattacctgtttgagatagcctgcaccaaaagcccgggtaacttttaggcgacccttcactctatcatttacaatacactgatcatcatcaggatgttcacgtttgatcctgtgaacttcctgcagaccaacacaaaggatattaatgcatagccataaaaataatgataaaaaaaggaagcgactaacaatgcttaccataactagttatatgaagtactgaaatataaaaagcaaaagtgaaaaagggcaatggtctggcttttgaagtgcaagaggatagtagtcatattgcagacgcattcagataagtcagcacattgttcccaaacaacgacatgagcatccccatacgcccgtgccattgtgccaaccaatggatacaagaaaggcaattgcatgtaaacacgtgtaagcatttgttcccctatgtcaacgagaatgtacctcttcgatgctggtgctgtgatcagtcgacagctgcagtggcttaagcccaataatggcgcatccgccgggccttgtctcgatctccaagcccaccccgacgtcctccatccgccgcatggttccaaacacacagccatcgtcgccatcgtccggacgctgcgccacaatggcacggctgtccccaaggttcatcacgtacacgttgtcgtccctcacgagggccacgagcaggcacgccccggtgaccgccaactccggatgggttcccattgactggtcggtcatgtccaagtacgccgcttccgtcgaggccagggcccgggtgagagcggctagcaccgccgcatggtccctcaccgcaggcgccggtgccaacctcctggaaccccattccctgccgctctcgtcggccgcggcgtgcgcccacatgtgaaaccgactctccttgagcctgtcgagtgacagcgcgaaccggccagagcccgagaagtcgagctcgctgtcgtcgtcgtcgccgtccacgagaaactgccagagcttcttgttgtccgcgtcggcctccttgtagaagatcccgcggagctcgcggaggaggaagcggtagaggttggtgacgaggaagtcgggggcctcggggccgttgaagccgtcgtagatgccgacgaagagccaccgctgatcctcggagaccaccacgtggacgcggtcctccccggcgcggccgtgcgcccactgcacgccgtcgtcgcggcggagcggcacggcgcacgggcggttcttctccgacacgctccgccgcaggctgccgaaggacggcttccggaacctcctcgagaaccccctcgatgaggaggacgcgggcttgggaggctttgcggggagcgggccagagaagggcacggcggggtcgagcgggccggagagctggccggcgcggtcgatgggacccgagaggaacagcgggcccgaggagaggttggacagctgcagcggcgcggaggaaaaggacgacgaggtgtggaatgccgaggagtaccccggcgccacgccgccggcggcggcggacgcgttgtagagcgggacgggcaccgacgagttggcggagagcgcggcgccggagatgccgtggcggaacgacgaggagtgggcggtggccgtggcggcggcggcgtagcagaaggagtggccgagagcgtcgtccaggcacggctccgcgtccacggacccggcgccggccgcgagcacgtgcacgcggtcagcagccgtgacgcgccgctgcccatgccatccgccgctccctccccccctcccctccccctccggctcggctcgcgcgcacctctcgccgtgcggagggagagagaggcggcgaagggcggagggagaggggcggagtcgtcggcggcgccgtggggaggagtcgacggcgcggcccaccggatctggcgcggcgaagagcggaggcgacgggtggtggggcggagtcggcggcgcggtggtgcggagtcggcggtggcgcgatggggtggagtcggaggcggcgcggtggggctgagtcgtcgtggcgcgtggggcgcagtcggcagcgccgacgaccggcggtgaagagaaggggaggcgccgggcgctggggcggaggagacgagaaaaaggagggggagtgggccgaataaaataaagaaaagggtaggagaggaaaacagcgcttgtgtttgtgggctgggatgggcttatcttcgcaaagtatcctcagatttcgtaatatttacttactccgtcctaaaatataacaacttatagcttttaaaatttatcataaaatataacttctccactaatattctcttttcaaccaattataaccctacactatttaattttccacctatctctacttatcctccaatactatactcacacatttaatcctaccaactttcttaataaccgtgtccaactctaaaaatgcttatattatgaaacggggggattaagaagtaaccttcaatagaagtagtgtgtcctactcttatatagcatgattttagagcaagttcaatagtatagccaactactagctccaatttatctatagccaatctaatagctcattcatacaatagttacatactacactattaatatctagtcccacctgtcatacacacactatgtcttgaaatccatgctacagctggctacaaatctatagcccactgcccttctttcttctcatttatctctttaaaatatatttacagctgacttttagcccgctgttgtacatgctcttaggctatatggttcatataagaccactgctaccgtggtttctattgggaatgctcttaggagaaaggaaagcgtagcaagcagatgatgcggaggcagcactaacgagtaacgagtgggcttttcttaccagtacgcccccactggccgaggcagtcgttcgttcgtgagtgcaccgtgcgctaggccggattattttagccattaccaggcaccaaggaagaaccccaaatcctaattccaacccttctcaagtaccggattgaaaaaaaaaatctcctataaatggtgagcctaggagggggctacacgtaattacgagtttaacttggggtgagaacgcaaattgtcaggtggtgctggtagtatggtggaggggccgttttgtccgcacctgctccgctcacgccggggagcaggggaagagttcgccagtgacgtggcagggccgtgttgacgtggaggggattgggggagtgcaggggagtcaacgtttcgcgccgagactgcccctccttgtaggggctaattacggcgaaggggactccaccgaggggcaaccgcgtaaattcgcgcgcggtggcgtggcgtcgcgcgcggggtgtccgtctcggcaaattggatggctttggcgggccaactgaagcattgggaactcgaactccaccatatctgacactcgtagaaagaggaaaagcgacagtataagatagtactagtattttcatgcaccatcgaaaaaaaagagaaaaaaaaggtaattaagagaaaacctgtgagcgaaaaaaataaggatagaatattctttccacatattatataaaaaaataaatgagagggcccacggcgcaaataaagaattatgggagtatcagatttcaggtgcttgaaatttttaaaagttctcatctactccctccgtcccaaaaaaaaaaggcaaaccctggttttccgtgtccaactttgattgtccgtcttatataaaatttttttataattcatattttcattgttgttagatgataaaacatgattaatgttttatacgtgacttgtttttttaatttttttcataattttttcaaataagacggacggtcaaatgttgggcatggaaactagggtttgtttttctttgggacggagggagtagatgaggattcaatggtttccgttactccattacttactcatttaaaagagaacctttttttttcttcataaaatgttgagcagtagattattataccctaaacatgaaataaacttacagttcataaatatacaaaattacgtggaaaaagcattcaaacttaaatcaaaattaaactaaacccatatataataacaaaacgatagttatactgaagtttaataaattttcacgtgcatgtaatctactcccaaaaattattctatcattctatacagggcctattcggctacccatttactacaattacaagccaacaataatatgtgtcccattgtccactgaccatcggtcccacatgttagtgagcagtcctgcatgtgcagtaatgaagagggtctagaatggtgttgcctagttgtagctgcagctgcaataactccgtaggctcttctactgaatggggcaacagtcaatattagaggcaccgaggaagagaaattcttgaaacctctatggtgtttcatgggagcaagtttaataatagagctaacaattagctattagtccatgttagagctaatatgtataataaattaactataaagtttgctctattttttgtctgaatctttttcttactatgaatttaatgtgaagcttttctctttctcttgtataagagccaacactcatgcattttctttgtttttctcttacacataagtttatagttggtttatagctcactactaatataataaaagttcatctcgtaaaaatccattagaataagtcatttgaacagcaacaaaaatctaaaataaaacctttcacatagattaaatttgagataaatgccaaaaaaaaaatctacagatctagaattcacaaggataagttttgctagaaaaggaaatccagaaaacagaaaaaaaatcagtgaaaattctattaatttaattttaatgacagttactaccaaatgctaacattcgtttactacaatatatgttaacagttaatttcgaactttttatactatgcaaaatggctttcttgataaaacatttatgtgctcctgatgacttccctaaaaaaaaaagttgctcctgatgacctgatgatattctctgggtgtttcacatgaaagaagacgggaaatgaaagcacgtctaataaagggttcaataagtttcaaaaataaaaataaagggttcaagggcaaggggcattggattctggaagaagaggggtacctggcaagtcaaactcaacagttccttgatggatgcagtgtgccgaaatgcggccccgttgttttctgctgctaacctgatacttacccccaagttccattctgaaaatctcaacaggcaaaagacaaaagcatgattgcaaagttgcatggaaaaaaaacagcgacttcacctgcggggaagacaggtaggaaccaatctttgacgaaacagcttgttagcatctgaacaggcaaaagaaggacggctaactttaacatagactatgatgcttcatgtattgttgtcaatggcttaaacagatacttctatatgtgttggtacagcatacagtgcgcaggaaaataggaaaaattatagtcacttaagctattacggtggagttcagtaattcaggttgattctttgttctgctgtgtggaacacacaacaatatgttaggggactcatgaatttaaaaacgggattaggaaaacacaagagttgaagtgtcaaatctatagtcattagaaattgtaaaacaaaagaactattcaaccacgtatggacacaaagtgaattttccatgaggtttaaccataagttaggattcctccaaaggagtacaatctacgctactaatgttccaggttccaataggcaataattatcgtggagagtttggccaatgccataactgataagataaaagtatagcttaaaaaacggcggtaatcaaattgcccgctataatttagacaaaattagtcaagacatgtgtctataatactatagcacgagaatgttagagcaggcacaataacagattataagccaacaataaacatatttcgaggagataaaggagaagagagaagagcagggagctataaatttgtagacagctataacacggactgtaagacacaatttgtagatattaaaagtgtagtatatgtttatagataactattatatagattggctattaaattgattatagatgatttggagctaatatttgactatactattaaacttgctcttaagattagatatcagatttgaaagtcacatcacaatgagctacagtaagcattaagttaagctaagatggcacagtatgaatgatttatggcacgttgttcttgcgcaatgcatgtatccggcacagacagcatggatatatatggttcgagagaacgcaaaggatccagtaagggtgtgtttagattccaaaaatatttggccaaaaatattacatcaaatgtttggacacatgcatggagcattaaatgtgtatgaaaaaaaatcaattgcacagtttgcaatgtaaattgctagacgaatcttttaagactaattgcgccatgatttaacaatgtgatgctacagtaaacatttgctaatgacgaattaattaggcttaataaattcgtctcgtagtttataggcggaatctataatttattttgttattagtctacgtttaatactttaaatgtgtgtccgtatacttaaaaaaaattgaccaaacaactaaacacgacctaagcataggggcaggggtcatagggtctgttcctgcgttttcaccttcccatccgctctctcgcatcacatgcaaggaaaaattttaaagggtactacaacactgctcaaaccaaccaagccatgggaaacaaactgtttgcaaccagagagtcagtggttgtctttgaggcaagcctaatctattgaatctagcggagtttaatatactgaactacaattaaaattttgtttcgcttgacatagggaagtggaaggcaagtagtagtaggttttaactttaactgatatttggacccacgtgacagcacttggtcaatagggttgaaatggattgagtgcttttacaccactaatagaccacaagaaacatgagcctagaaatttcaagacatcaactatttctaatttataaggtctactgaacacttctactttcaagttaatgtccttaaatacttaaaaccagctgtacaaacaatctatagtaaacttctttttttagaacttaatttgagctgcagcaaattttaaaacttaatttgaatcaatttagggggcttgtttagttgttttttattttccagacttggcttttagagctaaggatataagtataaaggtcttacctaaaaacacctctactgcctcatgtgtaatttgggtggttcttcaatacctgatttagtatctgaagtagatggagtgcaatccttaataaagtgaggtagatatttttctttccaaatcaaaattaccaagaatggttggatgtattattaattgttagaacaaaaacgatgaatgacttgaatcaattgccaatatgaagaaatgatagattggtccaatcaccaatcaaccatcactccatcagcaagcaagcgatataaggccttgtttagttcctaatttttttcccaaaaacgtcacatcaaatttttagacacatgcatggagtattaaatatagataaaataaaaactaattgcacggtttgcatggaaatcgcgagatgaatcttttgagcctaattagtccatgattagccataagtgctacagtaacctacatgtgctaatgacggattaattaggctcaaaagatccgtctcgcggtttccagacgagttatgaaattagttttttcattcatgtccgaaaacccctttcgacatccggtcaaacatctgatgtgacacccaaatattttcttttcgcgaattaaacatgccctaaacaaacaatccttgattgcgcctacgataaggtacctttttttttacctcgaagaaaaggaatactttcacatattactccctcggaaagagaaatatatatatagttgaattaaaatgatgggttgcaaacaaagattgtgaattagcatgtcagccatattgaactatcgatgtttttttttgactaactatcgatgttagtgacatttttttcggagtgacgattatgtggtaattttacctctgggtctcaatttaattggcaagagatcttgtgaagaaagttgttttgaagaaaattaaggtgtcaagtgggaacctgctttagtttgtccgcttcccaccaaaaggtccactcaactgggaccatccatccgtgaaaaaggaatcttggacttgattagtctccctgcattaagataaccatagattaaagtagaataaaacaacatgggagtagggctaaaagattgcaacactaatatatttcctcaagtccaacacaggtaaatagaataaggtaagggtatgccaggtctatcgctggactggggtaccgatggactaaaagattgaaaatgtttagaaatatgggccttttggagaactacaacattgttaaagaaggtaaagaagtctggtacaccttttgcagcatagaaaagaaactattcacaattgacctattgcttcagaacaaagattaaagaaatgtaccatcaagctagccctcttgggtcttgaagggcaaaagccagcagatctattgtggtacgatcagcaaagctgcaggaaccaagaaatcaaatccatatttccgggaaataattgattcccagaggtggcaaaaggtatagttcgaaggatgaaccccaccaacaaaaaagttctataagagttggactcacttcagtaatactccgagtctctgacttgcaacttttgcagttttgtaaaatcttttatcagaaaactgtgctcttatgcaacctacatggaggaaacataaattgcattaatttatcaatagtacaccaactatttctttgcaaattgtcctttgtctcgaacaataatatgaagtgataggccaaaacatcaaattaattgtgaaatagcatagcagggatctacccataataagaccgtacaggtacaacaaggtatgagtattctggatgtcccagatatagaattagaaaaccataagaagtatttggcattggaacatccaagaaaagatttggataaaataacatggtataaataccaaaatagtataccatagaacaataaactgtcagctagtcaactttccattggaaaaagattggcggcaagagaactccacttagaaatagccactcaagaaatgttatggattcatgcccataataacaaagataggacacgaaggaaaccaaacagtttttttaaaaaaaactcaagctagtatcatattcatttctaagacattctagctcaggtgcaggaatagcagatgatattggtccatcctaagtcctaacagcatggcagaataacagaagatagatagagattaataagtgagttctctaggtattttaatcattccagttgataagtgttacgtccggaacttcataatctagaagtccagatttaatgcgaactccctctatcccaaaatatagcaacctaatcctggattagacacaacctagtagtacgaaagatggacagacccataagtaccatgcaatttggtttactcacaatagctgaactgactgaattgtaatgattgttgttgttgctgactctctagctatgtctagaacttcaggaaattgatgtctagcctggaaaattctttcatactgtatgtgataagtcaaattatatgctatcaaaccatctgatggtaaaggttaagaataaagcagctgaggagctagcaattgttcctgcaccacaatgctctgttcttatttcctcccatcaaaattgttatattatgatcatttaccagacattctttcaaggatttaaccaggaggcctcatagagaaaccccattaatgcatttacaacttccatgaccaccactgttgcacgcaattgcaggttgatgtgttaacatagcttccatacgaacaatcacgaagtgctcgttctgcatataatataatacgcacttgttggaattcaacatgatgtaccacgaaaaacctaaatgcaaactagacaagtatctttttagtataagacacaagcaattagaaagttcatttcttaagaacaaatgtaactctggaagagtaaaggacacctttcagtcactgccaatacttgctttctgagtcttatcctacctgccctaagccccaagttgcaggaaaacgatatcacagaactgataatatcaaaaaccaaggcaactaatagaggaaaaaggaacacacgcataatcacctgtaagcatcgaagttacttcatgcagataaccactggatgaaggaaagcaaatgcaacatggcgagatcaaggctcttcttttccctaaacagtggaaggcaaatgggtgggcgaaaataaaacctatacagcgatggaaacaataatggttatgacttcttccagtatgtcaattacggttgcaaaatatcttccaacaaatactaatgtgttttgcatgcaataatcaggcagatggctacaaaatatgactctgaaaatatgcacaataataatgaatgtagaactgagattaaacatacaaagaggttttagaaattggaaatactaccttggccgtggccaagtctttgatttaagtaatggaatcagaacaaaacttggtctgctactatgatgtcaaatgcaggaaagttgcaaattaaaggacaagaatatggaagctgtatgcaatattcatggttagtaactaaagattaaccaggagatcaattagagaaggcatttgcagaaatttggccgtagaagacatatgtttgtttagtatttatatgcatcattcacctgaaaccatctaacaaccatcagagtaggatgggaaaggataaatattttcttggaaatttatgcccaaactttccaaagaaaatgaaaccacatttcaaatttaaaaatggcaagagctactagaagtttgacaaacaaaaagtacaaaaaggacattggaaaaactgcatgcacaatgcaaaacatggaatcttatagcaataaccaatagaaaagcggggacagagttttctgtgaaatcaaattgtagcatttctctgcacaagaactctacatctaaagtgatgtctgcatacatcaaacacaattaaattttcagttaacattaaatatatttggtatgaatagaattcactcactacaaattcaaatatatttggtgtgtatagaattcactccattctatatctgcttggatgcatatatgaattcagaagtgaaagtagatatatggaataattcaacacggagtccaagcatatatcttcgtatatactactgagtacaagctctggcttgtgaaaaaaaaaacgtgaatattagggaagtacctaatatcaaataattagaagggatgaggcttcaaacccaggtcgtctagcccaccaccttgtggagctagccagaagacccctgggcatttctctagctcgtgaaaaccaaacctcttttagtttttcttttccttgaggaagaaaaactccataataaacctacgatttatcaattcagtaacctcccaaacataaaattctaaatcaaaggataaagcaaaaacagaagaacgaaatcctaaagaagaaaattgatttaacaagtgtattgttcatgggggttttccccttctttcacacttcacacttttagaccgagctatgcactatgcagccaatcgcatagctacatcgttatttttcagagcaatcgcgcaaactggggtagttgtcccagtacacctgcgcactcacgcgctaactctgcctcagcattcagcagccataagcgacagcacttcgccctaattcccctgtagactacgaatcctctcggtacaaaaggactcaaggagacactcttctactccaagtaagccacacggtagaatctcccttcaaggaagacgacgactcccggagccaatcggacctacaggctacagttccctcagcacgatcaccgacgggaagccccccccccccaatnttttnaataatgcggatggaaccgaattcaaatgcaaaaatgcgcgaaaggagaggtgcggagagatgctaccgattccgagaccgaggtggatggtggcgaccagcagctgcccgcgccgatgctcgccttcggctccgacgagtcccccgccgcggccgccatcctccgccgatcggccggccgccggttcaccgtgagtggcgtgaatgcatgatcggttgggccttggatcgccaggaggttggacttcacttccccaccgtttgatgggctggttgggcttcttatgagttgggcctttgaattaaccgagccttcgcctcccttttcttcagaaaagtttacaaatctcgaaacaaaaattgttcagacgttctgtatttctgaacaaagttgaactaaatcagaaagaatactagtagatggataaggcaagaggttagtcgttgtgcttgatactcttccaatgaccaagaatggcgcatggaagagaccaacaaggttagcaattggactgcgtgccagtgttcgtttcatagcaggtcgttcataaccgcaagagatttttattttcactctgaaagagggcaaaatgtagcacttcgaataaccatacattataaggaaacaactaagcttatgcaacaacaaaataacatgcaaggattaagcaagcctgttcctggtaaatagttcttcgtcacaaagtcatctgtacaactatctgttcttttttttccccctgaatgtttcttagggttagaaacataagcacccaaaagtattccatttccatctttccagctaaaagtgaggtataacactgatatactgtgccacacacgcacgagtaggagcatcgtcacagttaagtgaggacattcttgggagggcacggcgtcggttgggcatccggagaaaggtaggagattgagatcagctttgatctgtatttctctgctccatcttcatgatcttcgtttgctgcacgtgggctcggtgacttcacctccaggttctgggctgaaggtttctccgggagggactgagagatctcaatgagagactgacgagcagcttcctgagtgaactccgttgctgatggcgctgcaggcgatgccatcggtcaaaggctacatttgatgtaaaaaaggaaggatgtcagaactcttgatctttgtctcggggtcatcctaactctcaagacttgaaacatcaacagcaaggaaatagataatatgtactgaacatagtaatgaatgagataaccaagaaacacgagcaagttttgactagtgattctcccagagctctagtgccaagctaacacatcaatcgctgatttggcagatcanagaatgaagatgcacagtgcacctttatcaaacattataagtctttgatgaaattatcagaacgcatttacttaatacaggaccaacaacgcaggagacagtccaaggcatcatatccatacattggggtctttttttagataatggaattcatacatagtgactgatcgcgtaaatagaacttaagaagacccacaggtagttgtcagattctcagtgagatcatgcatatgacttgatagaatttgaccttctgattttatttcatacatatatgacccagttgctccaacttttgttgccatctatggtcaattgaggtaaatataggtttcgggaataacaaagattcctttagaaatcaagttttgagaaactgagcctgccacaatagcccaaactgtagtcatgcatgcatcgcccaggcatggttcgttcttgcgccgctttttgaaaacacataaaagctttgcacattactgtaccaaggagaaaatgctttgtttttgtactgtgttaaggagaacatacagaaactctgcattatgatgcaagaatacgtaggcaacacaacaaagctttttaaactgctgttgaagaatgaacacatgaaactttctagctctatatttcatttcacctctaccactgaaaaggactgtagaagcgagaatggtgaaaacatctaaatatgcattagttgtgctgattattttagcagtaagcacaaaattaaattaatacgccttgacaactgatattagctttactgagcaaatctctgtctaagctatatattcagaatcaaatgttcctttattgaggatttgaggtccgtcaaacaaaccaccttcttaacactggacattagtaaaagaacttacctggaaagcggtccaaactgtagaaacgactgtgatggaaggacaagaatgaacaaaggattctatattttactagtaccaacctatcaccttacaagaaacaacctctagcctcattagagttagctccttgaaggaactctaacgaaggtaggggctggctcttccaccaacctccaatgtaaggaagtcagtttagctttatagatgccagcaaatgatcaaaacttggtttgataacctattcgcaaaaaaagattgtacaattctgcgtttcaacgctaaccattcgcagaaacagcggtaggaaagcctaagaatagtacccgttgaccaaacttagaccaacagtaaagctatgactatgaatagccttctacagctagtcaatactagtacatgagattcacaccctgaaagaatcgaggtatgaattgattcaccaaacaagaggcggacctaacgttacagcatggggattcagttcaacccctgatgattctgatgaataaactgctagtactactcgagaactttagcatacaagatccgcacgaagatggatgctacagagtatcgattatactactgctcaagaagaccaggaaaagaaaaactccgaacaatatattcaagcgagttattagggttcgtcaccagtagatcagtcgaggttcgggggagatcgccggtcgcgcggatccagtagatggagcggaggaggagcaggacgattttgggcgtgtttggcggagaggcggagagcgtaaggaaaaataatggggaagtgaatcgtttgttgccgtcgcgagaggaggaagaagaggaggaaggctacttggattgtgacgggaagaaataataacggtagcttgtcggaatgactttctaaactatttttctcaagtccacatggtatgtacgagtgtttgattgtttcttgttgaggccctcgttacccatattttctaataaaactaaaatgatttattataaaataaaaattaatttatatcttttcttagtgatttaaaagctaatataaaaaaaccaagttaatatattttaagatcaacttaaaattatgtctgaaaattcaaattttggtttttagtttagcttattaagtatccaatgggcctctcagatttccatcgaggtgaatgatttttggccggtgtgttaccaataggtattgataggagtagataatatatgtaatgatactgagatgataacaattattcgaggataaacggaatactctctccgtttctcatattataagtgactttgattttttttttcttggttaaacttttaaatttgattaaattttaaaaaatgacattattttcaatacaaaacaaacataatatataaagatatttaatgttagatttaatgaagctgatttaatgttataattattattaagttttaataaatttgatcaaacctaaaaaaacaaagttgactgagaaaaaaaattaaaacagcttataatatgataatatgatatagagtgagtctaacccccacgtcgtcccgccaggcgggcggctcggggtggaaaccctagccaccaaagtacctcccccagccccccaccttcacctcaccgccgtcagagtgagccaccgaccaaccgcacggcgagccatgatggtagcgtcgttttctcgcataggagatgcggtcggcatagcagcaagccgcgagcaatggatggcgtagagcaaggcaaagtgagcgaggctgctatggcggtgcaatgatcggtcaacggccacgacacgaggtggttgggtgaccggtaattgtacaggccagatccagtcgtcatgatcgaaactatcacccctacgtgcggatccgttaccccacgggtagatccgaccctagacaccccgccggtggcctccgatgggtaggggaggtggcttccagcagagcaagggagggggcactcgtagaaataggtcgtgtgtgtatgtgtgtaagtgtgcatttaaattgtacatatgagcataagcattttgtatcgtgtttttttttctgtaaagatagattttattactacacgaccatagccaagctaaagcactgtctaaatccaccctgggctcaaccagccaaaactccatttccaagtcaaaatggtagatgattcagacaaacattatgacattagccatgttgccctgttgcctgttgcctgttgctttcacgaaaggctcatgttccgctcatgcttatggtgatgcacactttttattaaaaaaactttagtttataaatggtttaacacaggcatggcttagctctaaggtacggatgtgactcttccacatctcacttacaatttaattatttcttttcataaaagggataacccaaaatataaatatttgaaaaggtgtgctttcaatgtaaatctattgaaattactacgaattaaggggcacaaaccgtgggggaacgtatgtggtcatttggggaagaaaaaggaagaaatgcttccaagagagaacccattatagacacatgcgatttgctattgactttatactttggacaaaaattccaagatatcatattataaacataagattataaacatccaaaatttggtcaaaaacttaaaatttgatatttcagaatttgtatccaaattttgtaactttttgtcttaggggtgttttggtaatttggataaaattgtacattagtaatggaggctcatcagacgatgatgttgaattgtcgaagttaaacaaaagccgatagcgtattgtagaatatgactaaatgataaatcataaacatgtgacaaacttagtggcatatccactctttaatttatgtgttggctttaacttaggccctgattgattcagcttagcattattataatctggattattataagtagattgaaacaaacaagtaaattattttgatagattattataatctataagccagattattataatctaataatctcctttggaggagctttttccagattattaagtgactaaagactcattacccttacatgcatgtaataatctatagaaacaaacaactcacagcttattttatgtcagcttattataatccagtttagagtaatctgatttaataatttagattacaataatcttaagctaaaacaaacatggccttaaacgaaactcttcacatgggccacttccattgggccaagatattctgtagacactggtgcaggcttccgggctcaaactttgaaatgtcatagaagttccttctgcagatttcagtgtacagggtgaatttctccgtaattggctaactagtcactagggaagactttttctgtaaggatcactagggatgacttaagaaataagtccaatttaactacctcaattgtagggccaatctgatttatatccctcaaacgcaatattgcatatgttgacccccccacgaaaaaaaataataaaaccagtacaatttgattcccttgatattttttagggtggtttcgctaacgtggcatgttgacttgatctacctatgttgatgtgacaacctagttataaattgaagtgggaccacatgtaaatgactaaggttttaaaaaaaactgtgggacccacttatcagctcctcctcttcttcctcctctcttatcccccacttatctttcccaagctcgtcagaccatcctactcggcgtgccgtgccgttgtgtggaggcatggcttagtgtagctagctcacctggacaaaacagtcgtggaagtggaagcgggtgaggctggcgaagctagatgcagggggcgtcttggcagcgccctcttcaatcattacgcgtcgcatggcccggagccccggatgtgcgtgtacttgttgcacacctgcgccaacgcgctggccacgaccacaaccaggacggcgccacgagtcaatctcacttttcgctacgtacacggctcactctgacgcacaaatgacttgagtgtgttgcactgtaatacaacatattacaatcaactatgtttttttaggaaagtcatttagcgtgctttattaatctacaaacatagttacatcgttcactggaatgttccacaagaaaattggggcctcatcaacccaattacaagaattcttaaacttaaaagcatgattacctagaacatgtgctacacaattggcttccctattacaacactcgacagagactttaacaaaatcatacatcaaaaatctggcattcatagaaaattaccacaaccgttgttgccgaaaaacccccatcttgcatcatctccaccacctacaaacaatctgattgggtaacaataaatcgttgttacttcaactatgttagcctcgtaaggactttttttccttcttccttattaatttacaaaaaaagttcattttactccctgaactatttcattggagcacttagcccctttaaacttttttttctcattttacaccccgcactattgaaaatggttcacttcacatcccccccaaccaacgctacctctcttctttagttctccctgtataagtcatattttacgtcaacattcttttgtgatttttttccctcactgtttacataggttgaaagcacttcaaactgatttaaacatcaaaattctaaagttcgagcaaacaccatgaaaaattttaaaatatttttaaactttggtaatggtgtcatctatggctctaacaatatcagcttaaaatacagcttgtataatgagtaaaaaaatgttattaaggagtaaaatgaatcatttttaatagtttaggggatatataaaatgagccaaaaaatagttgagaggataaatggtctattgaattagtttgggcgagtaaaatggatttttttttctaatttacatgctcattttattcacctgttacttgtaatgtactaccgttgcttttatgtttgtgtactccgctgccatggagacatggagtgtctacaggacaataccatttacagaatcaccatatgatatttctgtatcattttcacatctatttccttacgatagctattcagcctattctaatactagtatatgctctgcatagaaaatgtgaaatgaaaaacattcgggatatggtccactaaacagcataggaccatgaacaacattttttttctttatgggcacgagaacaagtgatcaacagttgacactgcacaatcatgactaatctgaaggggcgagttggcaagttgcttcagaccacgttttgttgaggagtgaaccagataatttttaggtcatacactgtacgacctatccaaaaggttttttgtggagcttgtgcacccacgatactgaaagtcttcagatcatgcactattttctatagtccccacacactcaaatcaaaagccccatttttattctagtagcatgttttgtcaaaagcaatcatggtatttaatcgttgaaaattgattcgaggtaacaaacttggacagttcactgccccagtttaattgtagctctgtttatctaccccaattcgatcattttctgaattctgataatcgaaaaaggctatcaggaagaggcagggaacacacctaaccttaaaatttggccacgatattactggattctgtttctctccccccgggacatttcagaccaaggaatttgcttccaggtagtcaccactgttgacttatctcaagttgttcaattctacatgaccccaaatcaaagttgaattggtggcaaggtacagtgaattcgagacaagtggtggggggaaaaaacgagctgctacagttgtttctccacgacgcatgaacgcatttttaaccgtcaaaatccttcagatgttcactgctcatgctcagtatacataacaacaaacgaccatgtcattttccgggcacaggaggaagccattaattagatcagggggagaaaaataaagtagcaagcagacctaccacagcacatatacatgagtcactctcaactccctacttatctcgagaaggcttatctcactctctctgcatcgcatggaagccactaaagccaggcttcatccaaagatcatggccataggccggggaggcagtgttagttggctgtagccatcagaatttcagaggtttatgcatgccagtgtggcactttagccccggctgcaaccttcaagacgtgcatttctcagccagcaagcaagctgcccgccggacagcagcggtggtcagttcacggccgtgctggctgaaaattcggtggcttcgtagcatcgcatctcttcttcgtcggactcgctgcagcgacagctcggggagctgccacacagtcccctgcagtcgtttcgccgtcgtcgactcttcgtcgtcatccccgcgcgaacgcgtggtggacaaaggcgacggggatcgagagggtagctagctgcgctagtgggggcgcaatcggagcgcgacgtcctgctaaaggaggccctctgcaaatgcaatgataggaacgtcacgttggtttttcagagcatatatgagaatgagaccgagaggtaaactctgtaatatagccaaccacgtaaagtggcgggagtatgagaagaattaggtatgtcggtgtcataccgtttacatcaagaatcaggtatgcctagctgagctagccgtgtagctgatgataattagaagatcgaaggcgaattctatggttagtttcagtgacagactggagtaggtctagaagatttttttagcgttgtttatttcattaatcacgaaagtatggtaaagcgaaagtcgatttgaaataaatcagtcgtcgtttcgaattataaagtaggctgcagccgctgtcaggcgatccatctagaatgcacttaaccagcgtgagcttggttacctgaaaaacgtagctgcgtgtcacgcatgcctttatgctaaaatatggaggcgtgcagtgattgcagttcatcaacgaaagggaaatcggaaggaaagcaatgattggaaagtcctaatccccattagttaaaccgatctgtaatcactgtcgagcaattttattcacccactgcttgctactcatctggtcgcaacgcacaggaaagattgattggattagcttacctgaaaaatttgcacgcctagagtcctggacgtatgcctggtaaggcttctacgtccagccctcctagtgcacgcatctatgtctttttaaaaagacaaaaaaaaagagagagataacatttctgcatttttcttaaaaggaaaaaagtgcgcaaatgcattggaaagcacaatgcaattgctttctttagcaaatatcatagtcactcgtactactacgttttaatctggatacacagtatatggacctgtcgacacactttcatggtagtcatgcaaaatgcagctcatgtagcgctgcagacacgtaggagtaaatcactagtacagtgcagacaaaagtgataacgactcacaatatacacacacctgacaatatgtcgtcgtatggatggcctatattcccccgatcatcatatctggcttaccgacaagaacatttgggtacattcaactgtaaaccccccccccccccccccacacacacacacaagaaaagctcggccatatgacagggaacacactgtcacacactaaactctgctaaaaggtagctagcctaaagggacgacctgtgcagaggaaacggtaggtcaggatcgcttgaactatgcgagcgtctacccgtgcaggaccagaaaggggatgcgccgatagatcgatctcgctgctcgccaccattgtacaccgcgagtacagtacaccctgctcccgaattgcggctccctagtccctccatcgcccattgcccgcgcgtgcaatgaacacatatgcgcggaagtcgaaccaactaatcgattcgcctgcaccaacaggaacaggggaacagccagctctgtacgctcgccgagccggcggagtgtgtgcatgctgcatgcgcgcgatctggtcacacatgggggtcgtgaccaggaaacctgaaaacagttggcccaacttcttcgtgtctctcgcggtctcgcgtggcccgcggctttagcgcgcagcgtgcgagcatggcagcatcacagtcgtcgcggatccgtccatgagcagaagcgcgtaccacgtcccagggagcagtagctatagctaggacccctaccaaagtagtagctgtcgtgctgctgcacaagggggtggatggatggatgcgtgaccgccccggtcgtgggcattggatggtcgacggcgatgtgcccctcggaacggtcacgatcgggtaggcccagcccttgcgatagccgatcgggggggttgagtggagcgtgacagggcggatgcatggcagccaaagcccacgcgtgcgcgcgagcgatatgccaaccacaggagagagagagagaggcgtagtagtacgggcgtacacctacgtgcgcgttgatattctcctccgcttatacggccgcgagaaaagcgggggaaaaccggaaaaaggaagcccgaagcctagcctccccgcgcgcgcgaccgtcctggccgggagatcgcgtgggattcggctgtcgacgtacgtgggccgcgcgcgggccagtgctcgcgagccgcgcgttgctgtgcatgtatgcgcgcgtgtcgtttcgcgcacggtttcggagagggaggatcgattggatcaggggttgtctcttttggcctaaccacatgtcacgaagggttagttgatgtattatcatcggcacggcagtgaatatagtgattctggcatgcatgcagcatgcatgtggttagtagcagtaagctagcgtgcgtgcacttacgttgcattggttgatcgttcatagtatagctataagaacaggcacgttttggtttttatatttttttaagcgtgataaaggcagtgacgggtaggattgttcagctagtaacctttggttatcttgagccgtcgaccatgcatgccctttaggattccaaacggtcgctgggtttaatcgatctgccgtactgccaatgcgctgcaaagcttggaccatagctatctcagctcagatgttagtagtatcgatctatcaggacgtacgtggaattcgtcagaggcgtctgcctgattcagcctgaagacatatatatgtagctttctggggggaaataattagcggaggtttatttttctcgaaatatcattacaaaggacggtttgtgtaattgtattcattccagaaccagtgaaccaggacactagaaaatacagagtccaaacgtatggcgcccatctgattgacagcatgtccaatgtgatatctctccatgttttttgcatttagtttaacggtcaaagacgggcaatctgaattaagcagcatgcaatgatattttgagagcaggactgtcaggaaaatgttattatcagcatgaaggtacacgagttcattgcctcaccccgcacagcggcgtgccgtcaggttaatcaccacgcgaacggcgcccatcagctgcctgagagtcattatcagcagcgataattagtcccatctacaatgatcgatcgattggtcatctcaccgaaccctgcaaccgtggatgtgatcaattcttacttctcaggcacagacctaagttaggactggccttggacaatgatcgcatgacattagttaccagtagtccgaatcgagcaccagctagcacatcttgcatctactgttacgagtgtacagtagaaccgattaggtcatgtgcaatgcgagggcggaagacctcttttctttctcacactacagtctacccattgcatgcgtcaaatttactctgtaccaggtccaggtttggaccttgaaacaaatgaaaatcattactattgttttccaagcgttggctcaagactagtgaggatgacatgattttttaagtatatatattgttccacattcagtgttaaccactgtgttagggataaaccccactcttagggttagagcaagtttaataggatagccaacttctagctacgaatcatctataaccaatgtaataggcaattcatacaatagttgcttactatactattaatacctagtcctacacctagctatagctggctacaaatctgtagcccgctgctcttctctctcttcctttatctcattaaaatatgtttatacctggcttatagtctactattgtacctgctcttatcgtgttaactaataacataactacactattgatggcccatgcaaattgcgcgaaaagtatcttttttttcttatataatagtgtgtgtgtgtgtgtgtgtgtgtgtgtgtgtgtgtgtgtgtgtatatatatatatatatatatatatatatatatatatatatatatttcacattttattattaaaatagcaacatagttttaaattatttactaaattgatcatacgtgatagttattaattactttcaattttgatcttagttatttctaaattgtattactacatgtactctaacctctacttccacttgtcgacgtttgatgtcacgactacggtatttggacagtatggggatcgttggtgctaggatatatgtgagactgaggtaaagagatggagacatggatttttatacaggttcgggcccctgagtagttaggtaataaccttacatcctgttggccgaagccggtattgctcttattcaccataatcacaccagtacaatatgtgggtagcctatctaactgttgttgacatgtcagtttgaaggtctaactcgtagtcgacaacaaggtagtcttcctcctcgaatccgtgcccgacgagatcagagatagcgctttcgtatctcctgacggtatccggagacaccgtaggggaatagccatgcctatccctgaagtcgatatccggcggcgtgtcttggcgtatgtaggcttgtatgttgattgtgttgggtgttgatgaggtggtcgtccctatcgtggtgatcgtgttgatcgtctcatggtggttgtcgatcgtgttgatcgtctcatggtgagtgtctgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatctgaagtcggtttccgtataggacatggtatgtggtgggtcctgccgagatttagtcaactactattaggtatgtagtatccataaccatgacaccactattctttattttttaattccgcattatcattatttataaattttatttttatatggattctaaacacttaacacttgtttcaatattttttatttttaaattttgaatttcaattatttctaaatagtactcctatatatggactctaaattcctctttcaatattccttatttattaattctaaattcctattatttctaattgtattttttatgaaccctgaactcatattttaatacttttttatttttaattccgaattttagttatttctaaattatattcatatatagactttaggtccttcttccaatatttatttttttattttaaattttagttatttctaaattacatttctatagggactttaaactctacaattttagtatttttattttagatccaaatttattttaaattcctatgtagactttagactcttcttataatattccttatttttaaattccgaattttcgttattactaaattgtattttttatatggactctaaattcatctttcaatattccttatttttttaattcctaattttagttatttctaaattatggccgagtttagttccaaacttttttcttcaaacttccaacttttctatcacatcaaaactttcctacacacacacacttccaacttttccgtcacattgttccaatttgaatcaaacttccaattttgacgtgaactaaatacactctatatttctatatgaaatctagacttgttttccaatattttttaaaaattttgaaattttgttatttctaaattgtatttctatatggactctaacctttacttttactttttttatttttaattctaaatttcacttggttctaaattgaataccaatgtggactctagtttcctcttccaatattacttatttttaatttcaaatttcagctatttttaaattgtactttattatggactccctttttttcttattcttgattaatatgagaatttctttatcgtgagagaaagtgtggagccttttttctattatttaataagttagtagatagaggattgaacacccctagagcaatgtcactctcatgtaacgagtcaagggcaataatgtaattttccgttgtcaatgaatagatagggccctccagagacaagggggatcccaatccatcccatgaatatatggttactctaactctcatccctcctctcctcctatttgactatctcctatatccaaccttaggctctctccaatgaggggtgggagcccttgccatgattgttcggccaatttgttccaacaattgcatgttttatcaggaaactcttttaacccatagagggatgttccatcgtatcgtgcttatcaaataaatagttttgaagaattaagataattatatttggcaagatatattaatatatcactccataaatatacaagtttaaatttgacttctataagttaaaataaatagatatgcttgtgtgtactagtttaagttaaattggttatttttgttacaacttatggggatcaaatttaaacttacatatttataaagtgatatatcacatattaatctatcataattttactatttagatgacatataagagcgacaggagaaaacatcttctcaaagaattataatccatttcggccctgtttgacacagctccagctctatctttcctggagctcagccaaacaatttcagctccacctaaaatgggagtggagctgggtagagtgctctcacaaaatgaactagagatgtggagctaggttttgactgctctagaactccactctgaacacaactcctaaaactaaattttagagttagaggtttaccaaacagagccttccattctttaccatacttatttaattagcatctatgaaactcttatatgccctgacgtcctattgtctatccacattgctgatggcctttggtcatgtgaaatgagaaaaacaattctaatattacatgatgtaagaccgtatgcaatgtaggagtaaacgtcctggggtagtactccgtttcacaatgtaagtcattctagtattttccacattcatatagatgttaataaatctagacatatatatctatctagattcatagcatcaagatagattcttcacattcatattgatgctaatgaatctagatagatatatatgtctagattcattaacatccataatgaatgtggaaaatactagaatgacttacattgtgaaacggaggaaatagttcactagtgttttctttctcactttgactataccgattgcaatgcatcagatttagaagttgttttgtaacaattgcgtgttttaccacaatttacagggtagacctaatggccggatgcttgtgcgcggtcgtgtgaagtgtctggacactgaaccaagtgtatatttatggtccactgtgaaacattttcctaggtacttttgatatggttgtgtttagttcccagggaaaaaatttacaacatatcacatcgaacgtttggacacatgtaaatagtattaaacatagaaaaaatatataattgcacagtttgcgactaatttgcgagatgaattttttaagcctaattacgccatgatttgataatatgttgctacagtaaacatttgctaatgacagattagttaggtttaataaattcgtctcgtagtttacagacagaatatataatttgtttcgttattagtctacgtttgatattttaaatgtgtatccatatatccgatatgacacgccaaaactttacaccccgatctaaacacacccataaaaacattctacgtaaaaccattttaaataaggaagaaaactatggcaatttgcagattagccctttcgcattttacctcggcacacggtagactctcgaaaatgcttcctgacgttcgatagaaaacaaaatgccggacggctgcgtatggtgggacccagtcatttaactattcaaccaatccatttcccattcgccattccccatccttatctcttatgtcttatcttcttctccccattttcttctcgccatcccggtgaccggagggcaccgcaggggttcgtcgcggccgcgtggctcgggggacggcgtgtactccgccgcggcgaccacgctgccctacgaggacgcggatgggctcatcaagtacttcgccgtcgacgactcccgcggccgcgtgttcgtgttctctgtcgccgtggacgcgctgctcgagctggagcctagggtgtgcaacgagccgccgatcactgccctgcttgtgtacctctctccgcgccacacctcttcttcctcttcaccggccatgccgacggctccatcgctgcccaccgcctcgtcgagtcgtctcattatttgttttcgttgcacctttgtcgtgaaatgatgtttcattgtatttttattggatgttgcatatattattgtctttttgttgcaatcagtagttttcaactgttgcattcacccaccgcctgatcgagtcgtcccattatttgctttttgttgcatcttgtcgtggaatgatgtttcattgtgtttttaatcgatgttgcacatattgttgtctttatgttgcaggtagtagttttcaagtgttgcatctagttacaactttttaacccggtgataaaatattttctcaagactgatgaaacatttctctccaaaatacaaacaactgaaacatttatattaaaacaattttttattgtcaatgacacatttctctgcggcacgaaaacattcctcttgaaacaatttttattggtcagtgaaacatttctccgtatgcgctgcaacaccgtccgatattttaaaaaatatcagactttcgatttgtagcactctccgtaaactctataggtcccgaccacatcgcacatgaccttaggaatgacaccttggcatgcatattgattcagttcaatatatatagcgacacatacagtgaccgagatatgtgggatctctcttagcctcctcctctagttgcaagttgcaaccaccagtggctagagaaaaacagaagcaaagatttgacaacgcttgacgacagtaataccacagcgaactaggcgccaccacacgcccacccctcaaccggcgtgatgacgcccgtgcgtgcgtgtgatatatgatccgatcgatggcaaccggccgatgatgtatcgtcacactaccctgcatgccatcagtggaagagagcccacgttgagctgtaaagcacagcggccactgtgaagaaccctggacgtcaatccgcgcactgttaactgttccctgaaaccggcgagagccagccggcggcaggcggcagcccgaaacaacggctttccgatcgatcgatcgatcgctgctgcgcaaacccgcgaaaatgacaaatgcatgcacgagataagggagtgtggcaactggtggcgcattggcagccactggcgccagtccactggtgtcgacgcaacctccgacaccgagcggcggagcatgcagcgacgatagctcgcgctagctagctcgatccattccgcgcagcttaaactcatggatggcagtaaatatgctatccctatctctaagggactaacacagtagtaacactcacctgccacttgtgcaagcctatctaggctcgtgcattgtactccctccgttgtaggtaacgctgtaactattttatatatatgtttaactatttatcttatttgacaattttgtgtaaatagataagatacagattatgcttaaaacaacttacaacaaaataaataatactatatattatgtaaatcttttaataagacaaatcgttaaacatatatatatatccacaaatcaatgacgtcatctagtttatatttttattcccgttcaatctacggatatccaatacataaggtcagtaggctgccgctgcatgtaacctaaatcaataccagttcttacatgtgactattttaggttatgaccagaatatgtgactatttttaagagacagaagaattagcggaaatgagaacaatttttttggcatcactttcccctctttgaggacatgtttaacttatcaattaaacatcacaagataatagtagcaaacatcatataacgtatcaattcatcgagatagcattaattatagcaattacaaccttcaacttaaaattttggctagtgaaaaaacatgacaataatctgatcttagttcggttcagtttttttttggggcctcggtcttttttgccatttctacctgacgaagtgacgatgcactagccagctactagtagagacgaggctcgtgttccgtacagcctcgtagaataatcatcgtgcggttgtgttcacacaggcaagtggcaacatattcaggggcaaacaatccagagttccagtctcggccttcatttactcaagcagatgtgattatatgaaggaatggttggttgaccacgactaagcgtagcagtctaatgtagaatgccactccatttctggatttccaagagaaagcgtgaggggcatctttggcgtgcacccatttccagggtcgactagcagcttgcaattaccctgcataaatagactggcgagtgaaaaagatgcggcgggctatatatgctgtcatgtagtattcctgtgcagataaaccctgattaaaaccagacaaattgctggactcggcactaagtttttcgtcgtttgccaattatctaaccaggtaaagtcacataagttactgaaacagaacacgagcagccacaccaaccgaccacaaataagagtaaaaggcacacttgagattgccaggaacgatctgaatttttcttgggaaaaggctgctcttgcgtgctacgatggccgggctatgagaacgggataaaaaaaaaaaaagagaggtggaaaaacggcgacagtcatcgtcgagcgcgacgtctcggtgtgatgcacatacctaagaatacctgtttgtgacatcatgcgagcaagacacgcacgctcctccacctcccttttgtgatctgcacatcctactcacagtcgcagagccagctagccagctgcagctgagctctataaatcccagacctctctgctcagacacaaccacttccatagatcccctcctcttcttcctcctgctcggcttcctcacacagagcttctcgttgcattagccgacggaggccaccggtgaggagagcccgaggaggagcaagaaatggttagtacgtgctcatgatttgatcgttcttggcatatatgttagcaaagctacacggtttcagcttgtttctgtagcttgttggtctgtagccaagattcagttttgtctccatgttcagtgatgaaacaccatgcgtatacatggcagcacatgaaactggaaactaactgacagcatgtaacttgatggttgcagtctggcaacgacggagacatgaagatgagggtgatcgtcgtggaaggcgatgagacgagtaacgccccgaaggatgtatgctgcgagtacaccctcgatggctccgtggatatcaagggctcaccggcggtgaagggcaagtccggcggatggctcgccggcggccttattcttcgtaagtactttgtgctgaactctgctgatttcaccatctccttcccggctgagacgggccagcaaaaaatggagacaaagtcgatgactgggctttccagtgaagtgttttcgcaacagtgcaagtcggtctgaggtgactcgacgttgaggcttaaagtggcggtaggcgccgggtctttacgcggaatgctgcatgacgaggtgacatcggccatgcaacgcccacaactggagggttcctcgccacgggggattcgggcgcacgcattactagcgccacattaggatctccgtaggagacatcggacatggtatccacgatgtagcaaccatgcatagcgatcaaatgatcgatcgatctgtagggtatgtggagtacgatatcgccctaccacagtttggctttattgctgctttcatgggggagttaagcggcgcactgtttgcatgtgtgcatcgttttatgtttgtttagaattattcttgaaggccttgacacctttttattttgtgtgtgttgtgcagtgaaccagggtctggcaaccctggcgttcttcggggtaaacgtgaacctggtgttgttcctgacgagggtgctgcagcagagcaacggcgacgccgccaacaacgtgagcaaatggaccggcacggtttacatgttctccctcatcggcgccttcctcagcgactcctactggggccgctacaagacctgcgccatattccaggccatctttgtccttgtaagcaccaccacacggcacatccctctctctccgcagttctatctgaaaaccacgcgcctttctcggtgcgatcgattgatctcatgtttctagctacttcggtctgatctgttggtcgggcaatcatcagtgaccagttttttccgttctgattgcccatttcacgggaaatgatggtctatagatgcgtaggaacgtacgtacaaagtaacagcgattggtgcgggagaatctgtccagagtggagttaattcggcctgtactctgtactgggtggattgtatctgcacgtatgctggtgtcgaaagtggatggtccatatagtagaggcatagagtagtacgtggtggcgccgaccggtcggtcgatcggcccaaggcacatcgcggtcgcgttgcgcgtacgcccaggagatgtggatcacgcggctgactcgttcgcgtcacggtgttttgcctgcagggcctcgcgctgctgtccctgtcgtcgcggctgtacctgatcaggccggtcgggtgcggcacggagcacgtgccctgcgagccgcactccggcgcggagctggggatcttctacatcgcgctgtacatgatcgcgttcggcaacggcgggtaccagcccaacgtcgccaccttcggcgccgaccagttcgacggcgaggacccggccgagtcgcactccaaggtctccttcttcagctacttctacctggcgctcaacctcggctcgctcttctccaacaccttcctcagcttcctcgaggacgagggcaactgggcgctcggcttctgggtctccaccgccgccgcggccaccgcgctgctgctgttcctcggcggcacgctccgctaccggtacatccgccccagcggcaacccggttggcaggatcttccaggtcgcgttcgccgcgtgcaggaactggaaggccggcgagtcgccgggcgccgtgacactctacgagagcgacgagaaggcggattccggtgggaggaagctcctgcacacggaaggtttcaggtaaagtgttgtgtggttttgtgagctgtgaactgatcacgcatgcacgcactgaactcgccatgtattgcaggttcttggaccgtgcggcggtggtgggcgctaacccgaagcttggcacgtgcacccaaccgcgtgacccctggaagctgtgcacggtgacgcaggtggaggaggtgaagagcatcctgcggctcctccccatctggctctgcaccatcctctattcggtcgtgttcacgcagatggcgtcgctgttcgtcgtgcagggcgccgcgatgcgccgcaccacccggttcccgggcttctccgtcccgccctccagcatgtcggccttcgacatcctcaccgtcgccaccaccatcttcctgtaccgccgggccgtctgcccgctcgtgtcgcggctcacgggccgccacaccggcccaaccgagctgcagaggatgggcctcggcctggtgctcggcgcgatggccatggccaccgccggcacggtcgagcacttcaggaaggccggcgccaccacggcgatgagcagcgacctgcacatcatgtggcaggtgccgcagtacgcgctgatcggcgtgtcggaggtgatgatgtacgtcggccagctcgagttcttcaacggggagatgcccgacgcgctcaagagcttcgggagcgcgctctgcatgatgtccatgtcgctcggcaactacttcagcgacgtcatcgtgagcgcggtgaccaaggccaccgccgtgcgcggccgccccggctggatccccgccgaccttaacgagggccacctcgacaagttcttcttcctgctcgccgtgctggccgtcgcggacttcgccgtgtacctcgtgtgcgcgagccggtacaggagtggcacggtggacgtcgaccggagcgacggggaggaggaggatggcgtggccggcaggcagatggcggcaacggtgtaagcgtcaggatgaatcggccgtctgctcgcgctcgatagatgcatggcaggctgtcgtggttcttgagacggagactgcagactcttcgaggggatgagttgcattgggacgagttggtttagcacgacaagtctccgttgatgataggacatgcacggggggatagtgacacgatactaaagaataagaggtcgcctacagatgcagtattgttctatcatgtacgcctgtgtttcatcgtttcacatttttctggccaatgtaacaagagaacgcgactgttactgaccactcatgttttttcttctgcaagagtgactgatcaatgcttctgtgcattgccgactgttgattgatacgcatactagtgctaataatacttcattttccctgcctagtactgttttgtttctactatttacaattcactgctgttccttcacggtggcactgttactttgggcctgtttggcacagctccagctctaactccacccctcctagagctggagttcagccaaacagtttcagctccaccaaaattgagagtggagttgggtgaagctctctcacaaaatgtactagagttgtggagctgggtttaggccccgtttggcatagctctagctcccactccaacttatcaggagccggagttgtgccaaacgatccagatccacctttttttggagtggagttggcagagctactcctaaaaaatgaactacggggtggagctgggtttttgctgctccacagctccactctatcccaaaagacccactaccctctaattttttagagtatctacacgaaaatgccactcaactacccctacaatcctcctttcctcccgttctctctcctcccctcccaatcccgagcgggcgccggcggcggtggcgggctgcggcatcggcgggatgacgacaggcggcgacaggcggcgcagcgtgacgatgacgagcgggtggaggccggcggcggcgggctacggtagcgtcggcggtagggggccacggcgacggggcgtgacgacgacgcgcgggcggaggccggcggcggcgaagggctgcggcggccgggggctgcgggacgaggacgggcggcgcgcgtggccggcggccggcggcgcggctggggccgattggtttcgttttttttcattttttcattttttttttcagatctagaactgaaagtatagccaaacacttttaacgagttttcaacttcaaccggagctagctctcactggagttggagtttagagttaggagttggagtttggagccctaccaaacggggccttagacagctacacaactccactctagactcaactcctggagttatatttaggagttggaactgtacgaaataggccctttgttagcagcaaggcggtgaacagctgaaataaagttaagtggtagaaaaataaggtgtgtgcgcccacttgggtttgtgggggcgtaaatgtggtatgtggattcacatccaacttgtagccgaaaaccatgaaatcgttatttttcagtagcagacgagttatctatttggctgcctagcactcaccatatttggattgctgggccaaatttgagttggaagtttattatttctgtggaagagtacactttaagggtgtgttcagcacccctttttcccaacccatctctctcgttttctgcgcgcacgcttttcaaactattaaatggtgtattttttgcaaaaagtttctatacaaaagttgcttaaaaagtcatattaatccattttttaaaaaaaacaaatacttaattaatcacgtgctaattgactgctcagttttccgtgttactgttccgggttggaaaccagcctatgcaaacacaccctaattatcttggctatgcattgagcttcattcgtgtccattagcgcaaaaccggctatagagcgttaccgattatcaaaactaatgtaaatcaagtccctcggtagtttacacggcgctttcatcctacggctacatgacagattaacttagtccttatccgacgtaatgcttacatgtaattacagccaaggaaaaaatatataataggactcgtatccacatgtaagtggtaattgtatagatgttttttttattttgagtaaattatcacagtactgcaggtttaacatgatatatcacaaaactatagatttagcactaaatttatcacataactacatgtttaagactaagtatcacaaaactatagatttgatatcaatttaataacagaagttggacttatataactcaaacatagcattagtgctgaggatttaaaccccaaaatctgtagtttacgataatttcatcagcaaatctatatcttttttatacttagccttaaaccagtaggtttgtcataaatttattgttagatctgtagttttgtgatacatcactttaaatatgtagttttatgataatttaatcaaagtatttatagctttgtgaaatttactcttatattttttttccatgtgaaacatatgagtcctacatctttcattagaaaaattatggcacaactacgactcacattgggtctccttatttttaaaattttttaaatttttttctagtttcgtgattaccacaagtgccatgttagattaagactatgccaacgtgccaagtagaggttacataggtcaaaaaccactttcaaattagtcgagggactcgatttgcagtgattttaaaagttagaggatactcttacctaattttatagttgagtgatgcaaactcaaattagggatgcgaaatggaccgtttccttcattagttgggtttgatgattgaaggtccgatctaatttgtatctcttaactactatatcagatatcttgacccataactattaaaaccaatgcaagatgactcccttagtggttttgagggtgtttttttgttgacgtgactcgttgacctactctagcaggccgagttactatgcggaccccacatgccaaatcccttctctccttctccaccccctcttctctacccttatcttctggattcggcgcgactctaggagtgggcaacgcggcgcccgaggcgatgggaggttgaggagaaggcaatgggtggcaacagtgtgacgatggcagaggagctcaagggagctgcggtccccatgtctctcgacgggaggcaaggcggtgggaggtaaaggggagggcagaggctggcggcaacagcgcaacgacgatgcagtagctcaagggggttgggaggcagtggccatcaccgacgtccctgtgtaagcaccggtggagagaagcatcgtgaaggcggacacaatcttcgttgcgcggtgtcgcgcgcatgaggggatgaacgtcgtgccgtgggagatgtgacgggtagggggcgacggggtgacagaggagggatgagggagagaagagggaaggagaaagagattggggatgaagaagcgggcggcattagagcccaccgccgcgagccttgatgagaaggagatcaaggatgggtgggtcttcctcgccgactagcgggtcaagggtgaagaggccaccgtcttcatccatggtaaggactatggtgttcaacgatgacaagaggggggaagaagcaggcagcatcagagcccgttgtcgcgagcctccatgaggaggagactgaggtcaccgccgcgacctatcgtggacaacctcgctccgggtcttacccaccatcgagtccaatctcgggtgggcgcttaggcataccctattcactagacccgaatccataaatgcataactgatggcagcttcaataactgtcattggcataccacatacctatacgtccagtcagggttcaggatcgagggaaagacacatgtgcatgacatgacaaaacgggaggccagcgtcgacctcctcgaggctagtagtgacgtgatgtccttctcttcggccacaccgtcgccattctccttggctctgtcgtccaagccgctgactgccgtcctcgattccattgtgcccgaagctaggagagagagtgaggagaagagtgctcgcctctagccccccgatcccgtgcacgcagctgtggagaagaaggcgagagg

SEQ ID NO: 46409 - DNA, 3934 bp, Oryza sativa
catcaaaactacccatattgttccctccaggccatttacaacacagcccccaaaagatggcacaaccgcacaactgatagagagtgatagtgataggtttctgcgatcctgtgtaaggagtactccttgaaaaaccgacgtacctctctcactgcaacagggccccacggagacgaccccaacaacttgggtcgatagcggcggaccgatttcgcatccttcctccggctcagcgaactcgtcccgcaatcaaaagcggggcaaaacgataaaacaaacctcctcctcgtcaaagccaagcctgcgtgacaccccgcagctgcgaaaataatcccaaaagcgcccgaatccactaaagcccacgcgaaatccccagactgcctccacgcgcgccgcccgcacctcgcaacccccaggggcgtttccgtccattcgcagccgcgcgagttttagctcccgaggcgtcgaggcggaggggaaggagtcccccaacccccgcaacccccgtgccctagactcccccgatctcgccgccgccccgcctccggcgccgctcgccggtgacgacctgctccgccggcgcccgaggccctcgcccgagatcccctccgacggctggccctgacggggccattcgccgccgcgaggccgcaccgccggtcgccgccggtggggcgcttggggtgggtgggcccctctctgatttgaaccccggggccacgcttgggtgcctctctggttcagagggtttgtgccgaggtgaggaaactatcgagtcgattcgactctatgtcgctgtagtttagggctcctacttgtgctttgggtctgggctgcacttttgtggggtttagcatttctgcaggggtttgcgtcgatggcatgggcgcctgcctttcagcttgcggtattcaggttttgaagttttggtgcataagattggtgatattttattcttttattgggagtaaggtaatgcggcataagtatcagttaggatggtgataatgtggctaggctgagcgtttatgtgatgcctttgtgctcatttctccgatcgaccaatcagtttgaccaaagagtgatgggacttaacatgagttcagtgcatttgactagtgttgctctgaggtgcaatttgccttctgctacatattgtttttgcaggtaactccaacatgtactgttaggaatttcatgttgtcacatgctgtataagctcagatactgtcaattagctctgttggttattaggggttattaatgttgcattgtgactatgatgatcatggttggttttgggtactcgttgaaacgtgtgaatagatgttttggacaattcgtagggagttcaaaacatgtcataccattcacggatgacttaatgacctagtttcactgttttatttctcttctttctgtaatactttttttttttggaaaaaagtttagaccttttatctcatgcactaaatgtattttacagtttgtatacgatttttctgaatatgccccaagacatgagatagttctctacaaaatatcggaaagatggcatcaaaaggtcctcgatcaaagttagatcatgagacaagagccagacgccagaaggttagcttttagcattggtatttatgtttagtagctgcaaatcattgttatactatttctcttatcttcacacacatttttctttctattccacgcttgcataatactgtttttgattttgtcaggcctagttagagaaggaaaattaagtcatgttcttttgtatatatgtaaatccattttcactttctttgtattgcactgactgaaaagttttgtcctatcttgtgcaggctcttgaagccccaaggggggagcctcgaaggacgaaaactcactgggaccatcttcttggagaaatggcttggctggcaaaggttacttgctattagtacatttgacagatcatgatccttctttcactgagtgaatttgcatggttttataatgaagatatactaatcctattcccttggcttggttaatattaaatgttgtgcaggagtttgatgctgagagaaaatggaagctgtccatggctaaaaggattgctcaaagagctaataagggtgtagttgaccaagcaacaaaggacgagagaaaacagaaggtttgcttgtcttttttttattaattaggcagattaacatgactccatgagagttgtcttattacaattctgtcccatattgaaggctatcagcagctttatcatttatatacatagaataataaactgtagtaatgggaaaggttggaggctgggaaggcgacaaggaagctggactgtaatttattgctggcaatgacccacatggccacatctgcatgcttgccgtttgctgaactgagtgatgtgcatcttagtttatcctcactgcagtacacagggaccttaactgagtaccctttatttattaccatgatctgactttaacctgccgagaataaagaatgaagaaccatagctaactgattgcttaactgcttgctaaacctaaatttggtggagactttgatcaataagatcaggttgacaaataaagcctagaataggttaaattcacaagtactgcatgttttggcataaactatggtcagtctaggaaatatatttcattagtacataagacattatttataacagcacattgaattgaactttgatgaagataagttgagaaccaagcagtgttccttcccctaatttgttctttcaactgcaagtaaatatataaccagcacattgagcgacatactcaatgaccgtagattatgtggatagcaaatcagtattcatgggttttatcttaatgttggctgcgattttcataggaggaagacgtcccctgagaaaagttgccctaaatatttctaaggacgtgaagacttcttgtacccaatacacaccccgcctagctcgttgtagctcacggtcgatctctcccctcacgttgtccgatggctggctccctgtccgactgatactgctgctcccctcatgctctgctttacggccaagtatggacatggacttgcccctgtgggctgtggcctgctcctggtcaagtccttcgtcgccaacgcgcaacgtacttcagttcccgatcaagcggttattgtgcaattcatataatctcgtttcgtgagttcgtcgctgcacactcactctctgttgttctgcgcacactttttctagatattcaacaatgctggcagaaaatcttgttgatgtgcgccttcaaaatcaagaaaatgactctttacagactaatcaaagatcccagcaggaactagcacaagagaacataaatgcatcaagtccgactgatgttggtgtgtagctttatgaaatgttctgtatatctctgaaattttaaatgtcctttttctttagcttttaacagtatgcttttacagacaatgtggaaatcgatgatgattacaacagttccttgggtgaagagccagtaagctactattgtgatttttttgattcttttttttatttttcgtgggtagcattacaacttgttagatttctacagatactggtactggcaccaaccattattactttttttgtaagttgtgtaccagggcaaggaatacatattttcctgtccaaaaaagataataatgacacctctccttttcctttttggtttgtttttcatttctcaggacattgaattactcttgtgtgtgtttgtgctgtagaaagatgatgaacacacaatcgatgaggatgaagctcaaattacggaggctgagcgcaacgaggaattggctgctttgcaggcagaagctgatctaccactggatgatattctcaagttgtacactaaaaataaaggtgatctccgaaaaacagttctctttt

SEQ ID NO: 46410 - DNA, 742 bp, Oryza sativa
gcatgcctgcagattcatgatcttcaaatgtgtcattgttgccctccacaatctctgcagactggtcattattcacttttacggtctctgcagactgatctctggtcagtttcatggtatctgcagaaagatccctgtttacctccacggtgtctgcagactcatcatccacaggcatgttggcattgacatcctcaactgatagtgcaggtgaattttccaattctgttgtgtcatcatctgcatagccatcctaaacataaaaaaggcattacaaatggaccacagtaaagcataactgaagaaagaaatagaaattcagcagataccttttggtatcttgcaagaagttcttcaagtgggatctcactctctttctgcagtaacttaacctacagattaaaaaataataataccaatgatccagaactgtcacaagaaatatgtattgcacaagggtgcctctagtacaccatagtagtatgtcttttgtatcagtcctagtttagacaagaaaatagttttgcatcaatctaggccaaattaggttgtatacactcgaatattcaactggatactttgaatgtgttgccatcctagagcaagtttattgtatcacaaaaagtggtatagtttaaatcggaatccacaaaattactatctagttgttataccaagatatttcgtattaaaatattaaccttactcatctactccctccgtcccaaaaaaaaaaggcaaa

SEQ ID NO: 46411 - DNA, 3408 bp, Oryza sativa
  unsure (1)..(3408): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcattttgtttcacatcaaaatgcaatgcaaaatgaggcacgatttatgttttttgcgcagttttgagggcactatggtgccgagcagggggcaagcagcacttcttaccttctgcacctgcattagccttggcagcgtcggtcttgttctatcaattgcagtcccggagggtggcaacaactggttctggcttatgaccttaagcccattggcgtatgtctctgcaactctatagcagaaatttagaatgaaatttccaggtcaaatgtagtaacctgtcccttcttgatggttcaggggtgtatactactggacaaaggcatcaagaaaagaagagatcaaggtcaaaatgattttatcggatgacgggaatgtatccgaaattcttgtgcggggtgatgatgtccaagtggagcagatgaggaaggagctcaagttcagtgagaaggggatgatatatgttaaggggatctttgaaacatgattgaatagcttgttatctacagaacagagctaacaaaagagttcaaaagagcagttcccttggttcaaacttcaggtgagggagattttgaatacctacgggcaaatctgtatcttggcttgagaggaaaagaggtgtatccatgtgagactccattaagatcgtgacacaaattttctacctaggatatatatagtgactcaacaagcaactcttttcatgaagatagacagtgcaaaaaataataaaattgaattgcatagtagtaaatgttcgagtgcgcagctcggctcacccaccgtgggccacccaggtcacattgggcctgttccaccacaagtggtatcagaacccaaggtttggaacccaaaacaatttccatgagtcacatagtggagaggctaggtaacaagtcttcggggtcacatgggttgatgtgacgggggaaattgttagacccgaggcccaagtaacaagtcttaggggtcacatgggttgatgtgacggggaagattgttgggtttagtcccacatcagtaattgatgatggaggagcacgatttaaaaggtgagggcggtcctcacccatcaaactagtcttttgggttgtgtagacctaggacctaaagttatggctccggttgggcctgtggtggagcaggctcaatgtgacctggtggcctacggttggtgggccgggctgcgcactttaacaagtagtatcagagcagaaggtttcagcattgcatcaagaagacaagtggagcaggaaacacgaggtcgtcagccgtggcgatgagattgacggtgacaacgaggacgttgcggcggcgacgacctcactcgcgatcagaccggcgatggcggaacatgatcggaagacggggccgaacgtggccgaaggcgttcggagagatcggaggggtaacgccatggacaacgtgcccgacccacgtggcgaagccagcgagcgtggtgcggcgcagtggacgtggagggccgggacgatagggtcgtggacggtgaacacgaggactctgactgcggtgtgtgcagaggcacgaacaagcatgtatgtgtacgtgctacacgcgcacatgagatgcatgcgacgaatcaagcaagtaaatatgcaaagtaaacaaacaaaaactacgggctgcatgcaaattaattggtgtattgggcatgtgcttggtcaaaagcattgattacgtggcttgggtgcagtacgcatgcaagcacgagctgatacggacttgcatacagcaaggcagcaagccgtagatgggagagactttgcaacgaggagacatcacagagattaatgaccgtgcaaaagttgtttacgagctagtcagacttgagtttgggtgctgtttggagaggagtccgtaacagattcttcatcgtagtacacgatatatacatgttagtacacgatatatacaatggcggagccagaaattatataagactagagttaagatatggctcgactaattgagtattagttttctgaaaaaattacatggtgaatcaacaaaatttaagcaagtttttagaggcaggcctagggctcaagccaggggcggatcaacagtatagtcatcggtgtcaggcgacactgacgaatttcaataaaacctatagcaaaactacttattcatatattacaacatcatattctaagcataattagtgtactatgacaccgatagacacgttatgacaccaatgaatcaattttctggatccgccactggctcgagctctagctgccctaggcatgtctccgcccctgatatatacgaggtgacaagggagaagtcggttgcatattcaactcggactttggacgtagaaggatcaaggaaacgagacagcgcacgacagcaagggcactcaacgtcggcaacttttggcacgcaggcttaaatcatattgctggtcgtcgagacagaaggcttggttgaagcgtgtaacagaggtgcgtgtatatcggttggatcgggccggcagggtggtcagacccagtggcggagccaggatttcaaagttgggtattcccgtctaagcactgagccgttgcctgtccttgcccctcgcggccgctggccacccaaccgacctgaccgccttagcttggcggagtgtcgggcgccgcccgccgtggcaatggcctccccctccgcggtagcacggtccagctcccgctgccgattgccgtcttgccgcaccgccacctagggtttgcaaatggggagtggcgcgagggagccgagccagggagggatgggtcaaggagggagagcgagagggggctgtctggaagagtggtggctaagtgggtcaactgatgtctgatgggtcatgacggagtgggtcgggttggttgaaggcatcgtaagagacaagttgggctgtgtttggatcaaaaaattgagaatttaggtgtacaaatatgtgtacatgtgtatatactagaagtatacttgtttttttataaaaaacgttgggtattcccaggaatacccgagaatcatggtgggtccgccactggtcagaccgacggactggttaggctgtggagttcggacggttagaccgagttcaacagacaggtggttcgttgcaggaacttgttaacgaatccggaagaaggacaagacggttctacaaatggatagtttgcaagtttaaagggtgagtagactggtagcaataggctggtcaggtcacatatgaagttatctgacataaacaggatatatccgggactcgacgaggagttgagatatatggagttaagccag

SEQ ID NO: 46412 - DNA, 1266 bp, Oryza sativa
tggttggtgaagattttatatggcatacgatggaggtattgtgtgcgtataggatgcggagtcgaatttgaaggagtccaaatttggtatgattggttatgtaaagtttgtttcttgtacgagaaggtttcctatggggattaggacttctagtatgagtttagttcgtggctttaggctgcctacctcatgtataaatagagagggagcgtgaggcttcccggtatcgcttttgagagcattgagttgctagtttagttagggtttcgagtttagttgagatttttgtaagaagtgctgttggtgcactttgtaaacacagagagaagcaataaagttgtcatctacttaaagagtttttcgatttgtgttttctcgggtgcagcggtccaaccggcaggacacctgcggtcagaccggtggcatcgaggtcagaccggcggagcaacggtggtcagaccggtggcagcgacaggagctggcaggcaatctcggcggttcgaccgatcgatctatatcggtcagatcgacgttcttcaggtggtcagaccggcgctgctactttggtcagaccgcgatccttcgaatttgagggtaacttttaatttcgcaaaaagtttgggtttttgggcataccaaccattcaccccccctctggttggcttagttcttgtgattcgatcctacatatactagtcctatttggttacagttggatttaaagttgtaataggtgttagcggtggagttagagtcccacaatgtaaccatggcgactacaatgtagcgtagacacgcagggagataatggaggcgtggccatagactcgtagctgctaggtgctatattggttgggaggagcgcccataatcagagccccgaggatgtaggcttcggctgaacctcgttaacaaatatcgtgtgttcttgtgtcgtcatctggtgtgtcttgggtgatcaatgactaaagcgatcagaaaggttagtcgtcgttccactatatcgaccaacttttataatagtaaatgagaagatgttgcttgagatgttcaaacaagatttttttaaaaaaactgcatcattcgttgcatgcgaaaaaatgtgcaaagtatttccatcacccagctctttctgagcgctggcacaagagatgacaggaaaagattctctgaagtgtaaagtaagaaatacagaacaatgaagcagaaaaacactcggtcaaaaattggaatttcttatctatctttctttacccatacataaaa

SEQ ID NO: 46413 - DNA, 2584 bp, Oryza sativa
ggatctctcagggcagagtgagtatcaatatacctttctttaagacccatagagggcttaggcagggggaccctttgtcccctctgttattcaatctggtgggtgatgctttggcagctgtccttgaaagtgcaaaaacaaatggggttttagaaggtttggtgtctaatctagtgcctaggggtttaactcattttcaatatgctgatgatactatttttttttatcaagaatgaggagtacaacattagggtgctgaaatttctattgttttgttttgagaaaatgtttgggatgaaaattaactatcaaaagagtgaggtttatgttctgggagttagtaaggaggaggaattgagagttgctaatatgctgaattataaagtgggtagtttaccttttacttacttggggcttcctatggtggttgagaagatatgaatgaaagatttgtgttacattactcagaaagttgataagaggttgtagtcctggaaaagtggttacctttcttatggaggaagagaaattaaaattaactcttgcctgtcaagtgcccctatgtatgcaatgggtttttaccatctacctgagaagtttcataagataatggactctataagaagtaggttctactagtagggtttggggaaaaaaagaagtaccatatgctgaaatggaaagctctaatcagaccaaaggagtttgggggtttcggttttctagatactagggtgatgaatctgtgtttgctaagcaaatggatcatgagaattgagaatggagatcatgatatgtgtttacaagttctgagaaggaaatacatggtccagcctagtttttttttagagttctcctgggggggagggggttccagttttcgaagggtttgcatgactataagggttggctggaaaggttagtggttaaaaaagttcatcagggagggtgtgtgaaattctggagggatgtttggctgggtcaggtacccttgaaagttgctttccttgagttgtttgacataagttatcatcaagaagcgactgtgagtgaattatgggagaatgggacttggaatttggagtttagaaggaatctagatgataacagtggtcaagatttaattaggttgagaggccttttaaatgaatataatctggatggtagagcagatagagtggtttggcctaacaccagcaacaagatctttaatgtgagatcgatgtatagattgatcacttttgggggtgttaaagattctgaaatgatgagtatttggaagagtaaaattcctcaaaagatcaagcatttcttgtatatggcaggaaaagggagactaccatgttctactcaattggttaaaaggaagtggagagggggagatgagttgtgtaagctatgtggtaaaaaagaaacctcgaaccatatcctctttatgtgccctttagctagttttacttggtgtgtcattagggatgctcttggcttggacaaaagaccaagtaatatcagtgagggtttggatttggttaaggggaagaaaatgaatagggtttggggtggtgcttctggctactgtgtgttgggcgttgtggttggttaggaacgattgggtttttgaaaatgtgttgattaaatcccctttgcatattgtttacaaaactctttcttttgttcagaaatggtgtatcatgctaaaaggggaggagcaaggtatcttggaaggatggtgtgatcgtctgctggaaaaaatgggacaactgaagacaaatcgattgcctgaagatttgtaactgtgtagttcagttggcccttacctacgcctcatgggaaagacagcctgtgtgctgaactgtgtttttctgttttttaataagactgtttgtctgttgggctttctttcaaagccaggtcaatataattgatctgtttcaaaaaaaaaacaagaagacgcagcacctgccgcgcgagggaggtgccatccgccgtggcgcacgcctcctcctccaagtcatcacagattccctcaagcttggcatcgtcgacggcggagacatcggttgcggtggcggggaacgtcatcttcttccgtgcagtgtcctcgagccctaacgagacatctcggagcataatcccaagcgggcgtgccctcacaagggcccgagcatccactgcatgatgcgccagttgatgtccactgcctccgtcaaggcggagaggatgcgtccggcctcgtcctgacggttgagagatcggacctcgacatcaacgccgccgacggccgcaaggtccgccatggcattctcaacctgctccagcgatgacactagtacagtagataccaacacggaggtgggagaggccgaggaaccgaggctcgaggccgacaacgaggagacagaggcagaggcagaggtagaggcaaagtgcaccgcggagattggggttgaggagctcgccgtggcggcagtgtcaaggagtgcgcctaggaaggcgaaccggtgggaatcgaggcggaggcagagttcgccaaggctgtcagggtagcaaagctcaccacggcgatcgcggtagtggagcgcat

SEQ ID NO: 46414 - DNA, 3316 bp, Oryza sativa
ctaatatgactctaactaccatatactcgaacatccccccgcagtccatgcatgagcagcgcggacacttggactgaagaaaaaaccagcaagaatactcaacacgatgatagccctttatgccatagtcgatgtagataaagcaaaggagccgagagagccgtggtcgatgaagccgtgcgtagactagccgtggtcgatgtagccgaagtagggaagccgatgatgtcgaggtagccgagccgtggggcgcgcatggggcgctgtagagtggttgtaaacgcacgggagggcatcatggaccaatggtgcgcgaggacgtgctggagatgaagacggtgatacaatcacgatgatcgtggaggaatatgacgccgaagagccgatgtagtcgaaccgtgaagtacgagacgtcacgccgggtttgccagacccagggacaactcgggacgaacacgcgcaacggtgttgccaataccgcgtagacgaggtagggaaccaccatgaatcatacgccaatgtcggaggagactagcagagaaggccttcgagacggtcgcggcgcgagaacggcgtagaggcagaattgccgaagtagcacccgcagttgccggagaagagcgaagtgtagtcgaggaagatacggcgatgctggcaatgagacatgctggatgaagaagatggtgaagtagcaggaccaacggcctggacagcaacgtcggtagccatgtagaggtagctggaccaccggcctagaacggcgatgatggcaacttgcagacgcagcggcaatgctctaagtagacgaagaagaacccgagtggctgacgatgaccagtgcggatgatgaggttgtcgatgcgcgaacggtgagaaagaagacgaaagcggcgaaactgcggtccgagaggacaacacagctgcagctccatatcgatgcaacggcaagaactaaatcgacggtgaggccacgctgagaagggcctctcagcgttgcaacagccagtggacggggaccatgggcagcggcactgcggcccgagggaacaacgtagtggcaaccagaagattgatggcgtagtacacgtgctcgaagacgatagcagcagtgtgtcgtagccgggcgcataaacgggtgatcaagccaaaattgcatgaggctaggcgacgaagaggaagccggagttgatgccgatgttcgagatgtgcaaatgtcgacgaggcaatggacgacgcaaacccaatctctgatcgggggaaaaacacacacacacacacaaatacaagcagcaacagcatgtagcagggtagcaatccacacgctcgacgacagtccaagctgaacgcagcacagtccttcatcaagtcaacaagctaacctctctgtacgtacatatccacgtgacctctctcctcccttgcatgtagagctacgcaagttcatagcagaagggtacagatacagcagagagagggcggcctatggactagcggcgacccgttggcttggcaggggctgggccggctgggcgcaggtcgacggcggcgactggctgtggagcggagcagagaccggtggacagtgtcggctccaggaatgaatcgttgggtggtcctacttggcatcccaaattgtcacgatgttacaaaatcaagtcaaatatgtcaaatatagtggaaatataattcaaatattgcaatatagctcaaaacatcacaaattgattaaaaccaacatttaagccacactacaagaaaaatactctgtatagacatttttctagtactgtagaggcacttatcaaatacctttacaacaatatagaagcattttaaaaaatgtctaataagtgtcttatggtgaattgtctctacagacgaagagacattttataaaatgtctataagatggtagaggcattttttagagacactaaattgtaccgcaaacatataaaaccagtccaaaaaagagaataaaatagtttccttgcttttgataagtcttgaactcgtgatcttttggttaaatcattctaatctttgatacactaaccaactcaactccatgtcattacttgtatacttgttcctttagttacttatatttaatcctttagtacacattatcattctaaaaatgtctctacatagtttaaaatgtctcaacaaaatgcctttatatattagacgcattttatagtgccgaaagaatgcctctacgagataaaatctaacaaaatgatataaaaatgtctctagagtaaaagttttctaggcaatttttaaagtgcctctataaagtgtctctacactataaaacttctgattttagaagcaatttacaaaatgcctctacaaaagtgcctctatacgaggtttttgttgtagtgccaatcccatctcttgatttaatcgaatcccactttctatttcacccaattcaagtgcttccataatcttatgaacaaaacaaaattgaagtggcgcttcttaccataaatttccttgactgggaaatcatgtggataacattggtttggacctttcagaatatatgcacgctgaactgcgtcttgttcattgacattatagctcgcaataggggacctcagtcctggatcatattgaagatgattagcatcatactttggaggtgcatcttgctattcatttgttgcctcaacaactagagttggctcaggctgtggctcaactagtggcggctcatcttcttcaatttgagcttcctcatcaataagatctgccctcttcttcgcctttgcttcatgtttccgaaaaagcgatgcaatgtctccattccttttcatgtctcactgtaatttgcattacaaattaatgagatactaagttataatgttatattgactactaactaagttgttgctaaaagaaaattccaagtttcagttttcaatcacattttttcatccacatttttcattcatcgatgaccgatctattcaaagtatatactaaagacaaatgagtaactcgccatctcggtcttcacagaggggcagggagcagcaggggagtagggcactggaggccggagagtcgtcgactcgttgagtaggagggagagggacccgactccggtgcaccgtcgccgccgtgaggggcagcgggggcaaaatcgtggccggctggccgccgccggctgggatggtgctgcacgcccgtgccgggcccgggcggccgacggacgacggctgccgcctgcaagcgcaatggccgccgacgctggcacctggcgcagagcgagagtaggaggaggcaaggagcggggagt

SEQ ID NO: 46415 - DNA, 2080 bp, Oryza sativa
caagatcctatcggtcgcagagcccggtagaggtcgacggaccgtcggtggaggaagtcggccggcaacggggttatccgtggtgtcgtcggtggcaggcaacgaaggcggaggtcggttgcagagcccggcggatgtcgacgcaccgtcggtggaggaagtcggccggcagcagggttgtccgtggcgtcgtcggtggcaggcgacggaggtggaggtcgaaggcgtcggcccacgcagtcacgtcgaagtcgagggagcccggcatagcctgtgaagtggagtcgcggaaagccggcggggcggacgacgtcgccgccagtcctgcgtgggaggcttgggtggcatcggcggcgaccgaggctacacgacggcggtggaggcagcgaccggcgaggatggctcgacgaggaccatggccgtgacatggccgcgacgaccggtagattcatgcgacgacattacagctgctgatgcttgaattgatgacgacgtgaggagaagatgcaggactcctggaaatcgatctctccaactcaacgatgacaacgaacgaaaaagatgaggccgccagaggggatcgggatcgatcttctcggcgacgaaccacgaacgaccaatctgggaactgaaccagatcgatctgatgcgaagacgaaaaaggaaaaaaaaggggtgaccgcccccgggagatcgctactcccggcggcggcggaggcggaagcagagagagggatgctagatcgcccgctctgataccatgttggatagtatagggagaggggaatactgcgtaaagtggattgattgtattgagcctcagggggccggtatatataagagtacatggggaggagataaggaaggattacagatatggaaggagttcacacaaatctgtcatatcctaatatgactttaactaccctatactctactccatccgtttcacaatgtaagactttctagcattgcccacatttataaagatgctaatgaatctagacattattatatatatagattcattagcatctatatgaatgtgaacaatgttagaaagtcttacattgtgaaacgaaggaagtaacactcacctctagctaagagtggtaatgggtcgagagactcatgaatgctttacaaccctatgtaaccctcatatattttaggtgaaaatgtataaaaaaaataattccatcatgctttagatccaatctttaaatttttcaggataaaaaaactcaagacaatcaccacacctacctgcggccatcgatgcatcccaaacaaggtaagtcgataatgcgccatggcgcacccttcctcattaacatttatagcctccgtcagggatctcccattagccacgtccacttcactgccgctcatggctcaccagatcctcctctgcaccggaacctagatgccccaccactttgtccgataattgatttattacaagtttaattctagattgttttaaagataattttaaaaggaatgaaattgattggcattgaaattaggagtagggtggtcgggtggagcttcatcaagatcaaagagtgtcatggcctcctccagctttaggatgttacattgaaatcccctctctttcagtgaagaaaaaaattgtattatagcaaaaaacaaaatgtataatagcctttgtttgaaaacacttttacacattagcccctcaggattgtagtgaagctcagccactgattagaagatttggaaaattcaaccataaaacaaagttaaatcagctgacgatccaaaaagaaaacattcgtcgacgatctttagggtctgttcggcaactacaaatataaaatactgttcttgttggctgcagtacagtaaaaaaaaatcgggattgctatatgtcattcgaataaaatttagggaagaaatcttacagattttggaccactgcatccatgccaagattcgtgcgtcggcttctctcctccaactccagcgggctccccttcttctccagcgccggcgacaccccaactccggcgggttagggtttggggttggggtgagagtaggaggggggttggga

SEQ ID NO: 46416 - DNA, 10508 bp, Oryza sativa
cctcgcaggtgccgttgaccccttccggctagccggcgaggcgggcggcggcgcggtggggtggtggcggcggggatcgcgcgaggacggggtggcggcggcgtgcgatatgaatcggtggggaggaggagaggagttaggttaaaagggtctgcacgaatcttaaagcatatccaatggtccaaaattcgaatgatatggggtgggattttctgtcacaatatgtataaacagcccaaaaaaaatagcagccgaacagaagcttaatttaaaacaaaagaatgcaactacgtggcgctcgttaaattcttagcatacatgagttctggaggaaaacaacaccaaaaacactattcatctcttaaggaagtaatttgataatttctatgttttttcgcatggagctagcatccaaatagttgttcattgtttgctatcggtcgggcgcctacaatattgcaatttgtcagtctatcatcgttggatacgcatcaagatccatgcacaaaaccaggcttggcctgatgcaatgagtaacgggctgcatctgccctggcccgttaagccgtgggccatcaatttttttggataatggatttttcattaatttggcctctatatccatatatatccgtaaagaatatacatagccaaaaacatacacaagggcaatacacacaaacacacacaaaaaaaaaaaagctagaagacttagcttcaaccttcatcgatgacttattctattcatcccagcatgagaggggtatgaggagaaacaaaactagtttgtgctactcgtcgccgcaccatctccacctctatggaactcaaccataaactgctgcaaactgctatgtccgctttccaccgtcgccatccaaaaacccccttatgcagttgttgcattttgaacgcctatagagtaccacgaagccgcttgccgtcccaccaccatcttccgtggactatcaaactcaccgtagctcctagagcatcatggaaccatccagcatgatatacaccttgtctttactgtcatgagctttgccgaagatgcaccgctaccattcacatctatccgcagccagaccttgacgccgtcactcacatgacagctgctgcctctaggattactccgtcaagagcctccattgccatcatccttatatgcatcaggaaagtcgacggccatcgcacaccatcagcccagccatcgacgaccatcgtccactgccctcgcctgaccgtggtcagaacggggcactggagctcacctaagtcgtcggtgcctctaggacgttaccattgagaaccttcgccgccatcgtctcaacttgtcatggttgaaccaacaatcaacaagaaccttcgccgccatcgtctcaatctgtcatggctgaaccaaccaaccgtcgacagtcatcaccatgctattgtcccaccatcacaggtggagggctagatccctccactgttgttatcgccggtggcagagccgtcactgcccaacaccaccaccagcgcgctccctaccgcctagcaggttgccagcgtgcgctgccgctgccaccaccgcctggccggctgccagcatgtgccgtcaatgaggtatgcacactcagatgtggcaagaaatttgagattaagccatcgtccaaaacaggtttcgtcaaaatgccatcgtctaaaacgggtttcaccaaaatgcaatcctgcacgtaatttggtttcatccaaataccattctcaaacaggccacacgctaatgtcatttctcccttttattgattgttcgcccatcatgcagaacatataaattccttatcactatgtaggaaaattgaactgtatgctaagtagcaataaaatgtggcatgaagcatgtcagaacttcaaataggtttccatcacttgaacagatgaagttacaacattgttgaaacgcaggcatacatgagagcaatggtatttgcaactggcagaaacaacactttctacacacaaaatcattagcttctagtttcagtgtggcagttactgcagggctcaataacctttaagctaacactcgagggtactctcccctcaacatagatcctaatagcgaggagagccttctcagcttccaagagagcttccttgctcatttgtaaacattgacatgggtcaatcttgtcatttctcctgtcatagccacgggtggtgtccaatgtaaggtactctagagacgaagccttctcgagaatgtggttggcaagatcgatcatgctctttgcagaggaaaaaccggttatcatcatgttcttgagattgtcatggcggtattctgaagcacgcattggatgcatggagtcaccactcaatgcttcaaggatcgaatcatgtcttttagctggccgttcaatctgcaaaggattacgtcaatgtctgctttttttttaatgagcaaaaggtactgaataaaagttagccatattaattctctccctcttttatttagctactactttataggaataggatagtgatcaaggcaagtaatttagttgcaaagtttatcaaggccatcaatagtgtcaatatttattactagagttgcaacgtttttatttttttaaagaaagctcatcacatatattttaaagcccataaaaattatattatcatcatgccaattttgctgccactttgtaggtgtcagttgagttagccataggggtcagataaagatagggatgcaagcggggcgggcaagcgggtgtttttagcccgcttatctcacttgtagttcattttttcttctaaattttgtgctaccatatgaaaaatgaagtagtaagcgggtttttatgcgggtagtgagactacccacttgcatccctagacaaagtcttgtctgattgttcgtggaccacatggtaattgggtggcaaccaccaccagtaagcgtcttttaagatagtacatatgagatcagttgcatcatttgcagaacaaagaaatgttacatttgtccaattcaagaaataacaaaaaacatttgcatgaaacatcataacaaataattctttaagagaaaacaataaaatcttgaacataagtggtacctgataaatgatagatagctttgacatataaataataacttacacgcaggataaaagtctccaaggcaggagaagcatcaatgaaggaaaccagagaacaaaaatcatagcccggggacaaatctggtgtaagcagcagtatctccaagcacttgagctgcaggaatttgccaagtacctttggtgtattgactgtctgaagaaaaagaggccgcaaaaattaattgagtacagtagtatacagtgcaaatctagtgatatactccctccgtttctaaatatttgatgccgttgacttttttaaatatgtttgaccgttcgtcttattcaaaaaaattaagtaattattaatttttttctatcatttgattcattgttaaatatacttatatgtatacatatagttttacatattttttaaaagtttttaaataaaacgaacggtcaaacatgtgcttaaaaagccaacggtgtcaaatatttagaaacggaggaagtaacatgctattattatggtgtgttgagtgacaagtgcaattgagctaataagtaaggctaaaaccgacctcattacgtgttgatagataaagcttctgtatgtttggcgcaatggatggaagcttcttgctaccataatgtagcgcgtcagggcttccgtcacaaaacatttgcattttcttcacttgtaataatgcttctccaagtgagatttgtattggggggccagcatagatgaaagtagagagctttggagcactactgtcaatcacctccaattttctaaaatgcaacacttccaggtaattaagctccagcagatgggggatcttcaggacaacaatattatggcagtctgaaagtaacaatcgctgcaaagcacaggatttggatagaaagccgcataattcctcctcagtaatttttactgatcttaaacgcaaacttgtcaaggtactcatctgaccaatttgtatgccagggtggaaagaacagccaccaagtaaaaaagactgaattgagcttgctacccttgatagaagtgagcatgggaaatcataatccatcttgctaactcgggtcatttctagttcaaattctttgattcctggtgcaaacgcaatttgaagccagcggtcaacataactaggatgcagactgaaacaagggtgggttgtaagtttaaacatcttcactcctgtgccagcatgattcagcataatggggtcgactctactgatgaaatcaattgttagtttatcattgctaggtgctctcttatctatgcgtagtgtattaacattaagattgagcctggggtagaatctccaagaacgcagaaaacaacgagatgcacaggcggcacgagctgcatcctgcataggcatgagagtgtgtatgtgataaaggatgtcctgcacaagccaacaggagaggataaaaacattagaaaatgttttattaccactataataataactggcatactgctttttgggaatgaatagtagaggaaactatcaatatgctaaaagaacattttcaaattgaacatggatgcactgctgagttccgtacctctggaagctgcatcttggattccactgtactggcagattgagaatcatcgccacattgacaaggggagttgtctatttcagaagctgaagaagtagctccattacctgcaactaactaggtcatgatgcagaagggagcattttgtttgcacgcatataccaaagatggatagttggacataatttaaagataactataatacaacaaagacatatttttgtgcttgagattactaaatatgaagattaagtacgggcacttaaaacaagaaaaccattagctcatgattaattaagttttaattattttaaaattaaaaaaatatttatctgatattaatgcaacttctattctgcataaaaagtttcagtacgaaatataatagtttgaaaagcgtgcccaacggaaatatcttaatcggaaaaagaaggagaagggacctaattaaataagggttttcaactaacatagaaaatcagagaatcatcattgaaatcaaaatttgagcaaagtcacttgagatttaggccacctgatgatgcagagaagtgcagaacaaatgtgcacttgagatttgaacctagctagttagaagaatccgccgaagcggctgaatccaaccagtttgattgattttacccaccagggaagccgtgggagcccttccaaaggaacaacaggtaatcgaacctaaatctagcgggtgatttgatcagctacgaggggtgggggacaggaggaggcttacctattcgcggcggcggctggacgggcacctccagtatctccatatggccgctgcttagtacaaaacgatgaatctcccaagagggggaaggagcctggggcgatcgaggctctcgagaagtatcaggcgcgacgttcgccgggaacggcgggagcggcggcgcgcgagatcggcggcggcgtcggcggcggcggcgcggggaaattaagatcgcagagccgagacggatcggaggaggagcggctaaaggctaaagtgctaaacccaccgctcgtttgttttaagtgggtcccaccgagtccgactgttcttcgtacgagttcaccggattacggaaaacccaagagaaaaaggtaaaacccgatgaattttcaatcaataccatacagaaaccgactaataccagttaccgtacagtaacacatgtattataagatgttttgactttagccaaaatcaaatagcttcaagtttgactaacaccgtgtttagttccaaactttttttttcaaactttcaacttttccatcacatcaaaacttttctacacacataaacttccaactttttcatcacatcgttccaatttcaatcaaacttccaattttagcgtgaactaattacacccttaagtttataaaaaaaatagtaatattttcgacctaagataaatttattataaaaatatatttaattattaatctctatctctatctctactattataaaaattgaaaatgtttttgccagtactttggtaagtcatccgtgtatgagtcagtttttaaattcgatcgcttttggaaatacatagtgtatttaaataggtttttaagttcgttcgcttttgaaaatatagtaagagccgtataagaattctctttaaaaaaaactcgcatgctaacttaagacgatcggacttctaattatagctcatgatttacattattgtatttgtatataaacttagctaaacttaaagcaatttgactttaaccaaagtcaaaacatcttataacctgaaacagagggagtggtacgtattggtctcgcttttacaaaattcaaagactcttatcacattatcccatatcatattattggacttgtttggtgtgacataaattggccataccaatatttggcaattttaatagtgttttgtgggtgtggctatttggcgcgcgcactagctctccctccacgtgttttttttttccattttttcgctttttctttttttatccccctcctccccttgcgcgtttccttttttcatgttttttcccaatctttttaatcgttagcacatgtattttcaaaatatttgagtcgaaagttttcaaattttaatttgaaagtttttcaatctaaagaaacttttcaaatcttgacttgaaagttttcaaatctcgagtttaaagttttcaaatgtgagtcgaaagtttttaaatccaagttaaaagttttcaaaatttatcttacaaatttaaattttaagtttaaatttttcaaagtttgagttgaaagtttttaaatttgacttcaaagtttaaatcttagtcaaaagttttcaaatttaacttgaaagtttaaattttaagttgaaaatttaaaaattgagtttagagtttcaaattctgagttgaaagttttaaattctacgtatggcttttaatttttcgatagaaagtttaaaattttacatgaaagtttcttttagatatagatttctatcaatatgttagtaaaaaaaactaaggaaaaaaaggaaaacattcccttaattatcgtcattatcctaaactaactcggttagttatgggagaagataaaacgcgcgccgccactcgctttctcagtgttttgtgtcttttggtttgaagccaacttttgataagcctagaaaaatagaccatttcaatagttaacttaagctattttgggttttttttttttgcagggaggctattttggttttaatccagacacaatattgccttatcaagattagccatgctaaaactagacaaaatttagtgttgacaaaattggtaagatcaagttagactacaaaccaaaccagccctataattcataagccgaagaaaatttcacaagggaaaaatggaagataaaggtaccagcacattgctactccagcttgctaccagacttttaagagaagtcaagattcaagaataatataaaagagagaacacaaaagaaacacgtaagagagataagaaaacatagaaaataagcaaaaatcctgccatctaaggctaataataggcttttgctagagaatgcatatgctacagtctcatgcctgagtttacaggaagcagatttcatctgaacacaactgatttctgatctgacactcacagaaggttatccacggcaaaagaggtgagaaaatttacttaatataatctcagaaaagctgagagttcgacgcaattatgcctcaatatatttatctgtcttcctgtttgtacatttcatggcctgcaccacatctttacttgattacttctcactgtgcagaatcgaccaatctgcaatagaatagaacaattagcaggagtggtggaatagattagagagtcaaggtttcgcttcatttcatcatgccatctcatgctgcaagagacatccctgatccatatagctgacttatttgaatgcatgctttgcttatgatgatcagtgagcaaagctggaggcttccagaggacagcgtttcccacagcacagatgtggaatagatggagggaaggcattaaagcaaatggtgcttggggaccagttaaagtcatgcaattgcaagcagcatttagcaccgaggacatccttctattataggagacaacaatactaacacttgctatctaatggtaaccatttataaagcactaatagaacttaactaacgtggctaaaccaccaaccaacccaggatacttatgacattatagtagtcaataattaaagagacaaggagtcatgaatttgattatcagtgttaattacactatattaattcaaaagtaaaaatcagatagcatcggttagacatcagacaagttaactgacatcagagcagctcttctagcatgtctttgtgcccccctaaaggagcttaagttgtatgaaaacatttgccatacatagcttttgcaatcagttctggtggagagaatgttagacttctcccagttcctatatgttcaggacataaagtaagttccaaaatgataaaacttgaattgtccatggcattgctccatttcaccagcaaggtgctacagacaagcaatggcatggtgtacaacaaactagcaggccaatgttggactcagtacatgtgccaccaaggtacttcatgccataggctctgttgtttaactcaacatggaactaaaaaggaattgtgtagaaatattaactggcacaatgtacatggttgcccgtcatccaagccaactctatgtgctcgaaatgtgctcctgtattgtgacagccctcctgtattgtgacagctctaacacatgttgcatatcgtctatcatcctgtttgtgataaaatatcagtaattgctcgagtttggaggttttatacaacaggtcatttgatttcacaattttctcctttaaaccagtgaaatacataatttaggacaaaaatacatgctggaattcaaggaactccaaaactaaacatatgtttgaactctagataacacgtaagatcctagtccctagaaatgcaaattcacatttcctttgctaaacttggccttgctgaggattatggacttagattacaatgaggcaacgtgtatacgaggcaactatacaaaatatgcagaaaccatcctatattacgaggacacaaacacaggtagataaggcctctagcaggtgccacagaagaactccagaagggtaattttaccatcctttataaagtacctagaggtaccatattttctagtgtaaaaatttggtacctctaggtactaagtacctcaatgtaccaaaaagtttagtgtaaaatttaggtaccttaaggtactttatcaaggactgtaaaattcctcactccagaaacactagagcaaccataaaaagagtatgggaaaaaataacagtatttgtgcagcttaacaataaatttcggactatcttaaatcaccgtactacatgattgcatcatgtgacaagttgagcatagaactacagctcaaattcccaatttccattaaccataatcctgtgataattacattggcaaaaaaagatcctaattaaccatgtcagaacatatcacagtatcagtgaactacagtcacaagacaactccattcccactgcagattaaatggatcgagtgtgattgtggcaagttacctgggctggaaagcaccgccaaaaggcattggggaatggggacagcgtgatatcatgccttctccaggacaaggcagcatgaattcccagtggcaaatccaacggtcaacctttgcgctgagtcaaaatggtcatccagtggcttaattgaacagcctttagcccacaaaatcagaagattttcatttatggtaaaggattcctcactgtcatgttgtctgttgatgaatggagtccttaccttcaaatcagggtattcactatcaaaactggccatcaaaaaattttataacttaagagatcaggttcttcactctgaacttcaatgcaaagcaaggactaaatattggctttcagaacaagttccagtacaggaaagccctgattcctatctagagttggtcatttgttagtggtccatgcagtctctataatgcaaccagtttggattcaggaaatatccaatccctatggggtggatctgcatgctcagcagtactacatcagttggcaattgttggtattcatgacaagggatatattctcaaggatgctctcattcagttcaaaggaatatactggaatggtgccaatgattctcctcagacttaatctacttcatacttcctctgtttcacaatgtaagtcattctagc

SEQ ID NO: 46417 - DNA, 46541 bp, Oryza sativa
  unsure (1)..(46541): unsure at all n locations
ttcattaatatcaatatgaatgtgggaaatgctagaatgacttacattgtgaaacggagggagtacctttcactcttcccctattggtggtcatcaggtcttcaggcaacatttcagagaatcaagttatttgcttgtaaaggcttaaaaatgaatgttgaaagttgaaacctatgacaatcagtgcaatatttgccaacaaactaaacacagaaattgtaagttacctggacttctcacccttccaccagtcactgaaggttcttcactgcttggtaagatttatccatgaattttatagagggcttgcctcacattgagggatatactgcaattttggtagtggtagattgtttcactgaacatgcccaattttaccctctgaagcatccaatttcagcagtcatagtagcagaatttgtcatggataatgttgctaaaactcatggtattcctacattaatagttactgatcaggatatatagattactcaccagtaattttggaacgacttgcttgcgaagcttgatactcaattgaacctagtaccgcactccatccacagcctgatggacagacagagcggattaatcagtaccttgaaatatacctacaaagcacactccatgaaacgccaaggaagtggccctcttggtttcccattgctgaattctggtacaatacaagtttccacactaccttgggtagctcccctcacaaggcattgtttggcactgaacctagttgcttcagctgataatgaagccactgatatgctgacaacaagggctgcttattctgaatttttgaagaatcagttggctagagaacatttgagaatgaagaatattgctgataaaagcagatatctgctggagtttcctgtgggtgacaaagaatatctgaagctgcaaccttatactgaatcgccagtgtatatctgaggctggcaagctgcaaccttatactcaatcttcagttgtcaatatgtcatatcttaagtgggtctataaattctcggcccctatgatgttcttgctcgaaatggtccaaatgcatacaaattacaacatccagagggcagcctgatgcatccaatctttcatacttgtcagttgaagccacatatacctgatcacacacaccaatctttttatctctctcggatataattgaatttgatgctgaaaaggttcaagtggaacaaattttgtgcaggaaactagttaagaaaggtaatgctgctcgccttcaagtgcttatcaaatatcaagtggacctcattagctattttagcagcaaggagaattatgatgtccttgtgacaagatttcctgcagcatcagcttggggacaagctgagtctcacggcagtgttgcagctatactagaggcaatgggccagcaaggaggacgcaaggtaggcaggacattgaatgaagagttgaagacatataactgagagtgcgggtggagggccagtgagccttgtaatatgtgagaggtgctcaggccaagtctagctaactactagctggaatagactataaggacagcatgctgtatcacgtacgctgttaagcaatgaatgagggaattagctgttcttctctgcctcttccttcttcttcctcctgctaatccatggggatgtacagagcaggcactgaaaaacagatatgataatgaggtaaatcatcatttctaattagaaaacagatgttaagaaagcgatccacatccattacaggggaagggaactggctccaatcagtgctagagtggggacacatacacacacaaaaaatatgtaaaccaacctgaccaatttttgttgtttgggatggacacgctattttgagcctgactcattgaagagatcaaatcccaaaagaagacatcaaatatgaataagaatattcttgagagctcacttgtgtatagccaattgataatctcatcgcatagtcatttgtgatatgttgcttctctgttcctgtaacagcatcatggtgctgagcaagagctagagcatcagctaaagtatctgttgtgagatttaatttgctttccccttaaaagaattccagaagccaagatgcctgaaaagtgaaaagaaataagatattaagcatatggcaccacaaagtaccaagggaacaagaaaatatatcacatttaaattggacatgtgaaagccagaataatgaaaagggtggtaaaaccaccaatcatagcacggactgttgttttaaggaaggtcttcttgtgaaggaaccagtccaggcattcgggttgtccgcataccaggtgtaagaaatacagtcaaatgcatgtgaaagaaacaaagtgaaattacccataccaattatgaatatgaaaatagaacatacaggtagaaatcatttgtcttgagaggccatggctcatttaagcatattttgcatcagtataaatggaagacatggaatagagagcattggcatggccaattaagggaatggaataaacacgttgaaatcatcatatcacaagttcaagatatctgcattatgtaatgccatgactgcaacttcatggtgaaaccaaaacaaagaaactaaacaatagtcagtattagtaatattaatgatcatctttaaccttattgacataatgaattagtttgtccatcattctgaaccaactttatccataatgataaatcataattgaattttgaagtctgtatccattgtaatcatggcatggtttgtcgtcataatatttgcctagagaaaagaaggaaaaaacatgaattaggatgaatcattcattcctaagcagatcgatagcttcaagttaaaatgttgatattcagaaataacttttgagtattaaaagcacaaaggtcgatgtatcatggaatacagaacagcaaagatgcattctcatcttctgacaaacacatatcactacaacatccggaaaatccagtgtacattcaataaatagtttgcagttgcatcaatccatatgagactaatggatttacatgaaacgcacataagagagtgtacattggcatgaagaaaagcgagaatatttttggagtctaatgtacctgtgctagagctgcaacaaagtcgttcacccattgttcaacattataacaaaaaaagagggcatccagcatagaggcaagcaatgtagaataagttcaatgtagtatgtgttaactagagttctcattaaattacctggaagacaaggtaattatcatcaacttcgaaataaaactcactaggagatggttcataaatttttgggaagatatcagcaaaggatgtgtaagaaaatgtgcatatttcatatgaaatatggattcctagacttaataatataaaattgaggtgtaacatttactatcaaaaaaagagagaaggtttacttaaatcagctgacgagccgagagtcttggagcccctctcacaacctcgagttcttctgttccctttccgcgtatcactatcttggtaatcaacccggagaaaaaaaatcatcaattcctgcatgaaacataacaacatgtttgctgaaccatcccttttctattaagttcaatatgttagtcaaaacactggatgggcaactgttattccaattaacgaatgggttgtgttagactcaatagctatgttgtgtggtcaatgaaagggctctcggtggcgtcactctttaggggatagcaaggtacatatactgacattattatatctcaacataataaatatctatgacgggcaataagtgataacatagttactgttgtaacagcacagcagagttcaaagtttgtcttatcttgcaaactagctatatgatgaagtagcagtgcatcatatacaatatttgcgttagtttctgcccatgaaagaatttgactcgcattaactctcaaagcatagaagtgcatcatatacgacatttgcattagcttctgccatgaaataatttaattcacaactctgaaagtgaaagcatgatcacacaaatgggtttggcacattacttacgcacctaggcagtaatcctgaattgcagagtgcgaaattggatcaatctgccaaccaatccttggaatctgacccccaactactccttgatgaacctgtgccaaatcatagattcatagtcggtatatatatcatgttaatgtagcagtgcacagccgcctcagcatgcatgcacatagccccattcttcaacttcacaagaagcactgtgttcgctatagaatacagacatgagtggcaatgctaacatatagagtaaccaatggggcatgaaaggccacacattagttccagccatccagtgctgatgagcccctccaccgtatccttaatcatgggctatctccaccatttctgaaattgcctagaaccaatgaaaccattggtcaagaaaactcattatgtctacaagtagatgcacattgcttcctacccaaccaaaaaaatgccccccacactgcagcactaaccattttgggatttagtttcagtaacttcaaatcttagaactggtagccaggaaatggctgtagaaacatcaggaaaatagtagtactgcgctttctacacccaaattccaattacaaacagccggtgcaaattttacgagaagaaatcatgcccaacagaactaaactagcttcgctaaacccgtcaaaaacttctccacccaaaaatggggaaagaaatccaaggaccgcgcagcacgggcctgcacattctgcaagcaagccccctgaaccaaaaacacccagaaacaagaatcaaaacaatcaaccgaaactatgaggagaaccagatgattcgtttccaaagttcaggtaaaatttgacggggagaaaccatcaatcgtgcgtaagctagcttccccaaacccttcgaaacttctccccaaaaaacaaacaaagacgggggaaaatcgcggaaaattccaagaactgcatcgcgcagctcgctcgaaccaagtactgacctcctggatggagttgttcgaactgacgtggtagtactacgtcgtcgcggccttgcgggtgtggagcttccccttcaccacccctgccgacgtatggtagggatgtacacgcactccccccgggtggtgggcggcggcggagacgaggcagaagcggcggcggcggcggcggcgcgaggacggtggcggcgctccatccgaagcttctagaatactagtactactttagtggaggctttggggattggatatccgaggccgtcgatgacgtggagtgcgccacaagaagcagccgtggcatgggccccacctgtcggtgactgcgtgggtcccacctgtcggtgacgcgaaaagcccgcttataaatttacgacttcaccccccccgacctctctctccctccctttccctccatccgcaacggctaccaaagccagagcccagaagccacgaacgaaatcccctttccgctcgaatccccccgccgcagcggcggatcggggaagccacggctccttctccggccggccgtcgcctcgcccggatcccctccgccggccggaagccacggctcctctcccggcttcgcagcccctccctccgcctccgcctccggtgaccgcccggtgatcgatcggggactactccatcaactcgacgcgcttcgccttcctcgccgtcgaagcggagatggagccgatcaatatcacctcggttcgcgagttggaggaggctataggcaagtacggcgccggggagagcgtacgggtcaccatcaacgtggccaacgttttcgaggccgatgagctgcttcggctcatcggcgatcgggagctcgaggttcgttgggagctgagtcccgggggcatggatatgctgagatccgcggcggactactacctcaatctcgacctcctctacgagttcatggaccttatgcggctggatctgcgcgacggcgtccctgtcaagaaatcgttgttcgattggatccggaccgcctccacggatgtgcttacttcttctcacccatcgtcgactcgtcgcatcctggaacaaatcacgctggaggcacagctaatcgggcgagtggccaagggattgggcttcggggcggatgacgtgcagcagtatctcatcaccccgcacgaaatgtcatggtatctggaagaggatgcagttgcggtaagaaagaggagagcaagtttgagttcgggtgatgccgccacgagtgatgttgctgcgggagcgagtgatcctgtggagttgctcaaaaaccacaagcagaggctgctggacaaggttgcgcatctgcaacaggtgatatcttcatcgaaatctgccccttacatctcacagttagagcagtagaaatcacaagaactagaatgcatttcaaagagtctcacatggcatggtacgcataggccattagaagtagagctctgagtacaccaggatcaggatgcacttgcaagacttccacatgacacagcagaaatcaactagtagtacggctttacttcagtgtggagttgcagtttttcgtttgacttgactattgtaaacagctggtttatgtcaacaaataagaccaccagtttctggttttacttgcagaagaaagtattgtgcactgataccatcaagtattacattccctctgcatgtttatagttttggatacagaattagccacggaataaaaataaaaccatgaaacagatacagggaaaccttcttttcttgcatgcacattacatgtttacaacctggtcttagaatgacagtattgattgttgaagcgcctatcgtgtgaagccaatacatagcatcttgatacttgattgttgaagcgaggccaatagtagctgtagaatacagtggaaggacaaatgcataagtaaacacaatgaagtatcaggcaagacaaagatctgtagaaagctattctaggatcagaaattccattggcttggtgattgaatggtgaaccaatgaataacgatggcttatgtctgaaagattatttaaactcaggctcaccattcacaggtattaatccaaaccataaattatactgaggttttccgagaagaaatttacatggctatggcttagtgatccaacgattgaagaatttaatagtctttacttggaagcaggatataaagggaggaattcaagaggctcgccaagctgcttcactctcagcaagtaaaaaccatgtagtaaaaatgtaatctgtgaaaacaaaaacacaaggaactcttgagagctaaagaaaaacattttttccctacagagtacagacaacaaacagattgtactgaagcatatttctaaatattgtcacacatcttagcataatctcccaatattaagtatacatgacaatcatgtagcaaatgcagcaagataatacatctttacctatgggtgtacttaaaaaaggtcactagaagaactcatcatgataatgtatacaacatctgaaattttcatgtaatctccatgaaatgtgcataggataataatggattcttgaaataaatatgttacaaaatgttaaatagcagaagtatgcttgtcaaagctggatgaaaaatgtagcccacttttcccctagcaaatgcattgtatggtgtaacttcagttggaaagtatacccatgtatcataaaaatattagcatgtgatttcccagaaatgaaaacacaaatcaaattcaggaactaagtcgtcagaactgttttagatcagcaaaagaaactttgcctttctttactgagcaccctgagcttcaaaacatgaatggggaaaactattagcaactgacaaaaacacttactagctaattaaaggtaccagtaataatgcataagtacatcccttgccattgttgtttggtggaatgatattattcagttgaggacatagcacaaaggaactgatggctccaacaactgtaactttgacacatatcgtattctaaaagtcgccttaggcgttaggagctgggtagccaccatgattagaaattacctggtgcattaggcacataatctgccttgagggttcttgagtgtacactgaagactctgagagtgtgtatacaatgaagtatgtcctgcacaggccaagatgagagcgtacaaacaatggagcatgttttactaatattacggtacgatgcattctgggaacagatagtagaagcaaactattaatttgctaagaaaatatttaagaacatgggactcattgttcattgctgtttgctgaaatatagctccagaaaatgcatcagtagtaatgatgacgattttttctgttcacgtagtttcatcaatagattgttttttttttctctcttttgtactactccatacctcttgaggatatggatatcaaattctgctctactacattattcagaatcatcaccaccacatcaaaaaaaaaaaaggtgagttctttattccagtaggtgaaatagctagtacgtgtacgcccattacctgagattttcactaaaacgaacgatttggtattgatttaagatccctagcactagcagcagaagcatggagatgaagggatgaggtgggcacctgcctccaatgtccccatgggcgaccaaccaaccggcggtgatgactcccctctcaagagacgaacctccgacgaaaagaggggcgctgaagaagccgaccgaacacctcctcggacgtcgttgaggcggaggatgggagaggattgcggcggcgctgcggaggagtcgagaaacggcggcgccgccacacagcggccatcggcggcggcgattaattccacggatcccccaaccagcctccgctgctgtgtggccttcgtcttcgtaggtttttgaggtctttgggctggctaactgtaactgggctacttcggtttacatgggacgatccgtgggttttcgttgtgatttggctcaccacaactatttttttttcttttaatatttacagaaataatctatcgacgcaaaaaattacaaaaatagaccctgccgccctaatggagggtggcaagctgatgtggcagacggcgccatctgccgccgtctgcgaaaattgcatttagccccctaaagagcatttggctggtacttttttgcatctggaccccttgccgccctggcccagatgcaaaaagtaccagccaaaaagtaccaggcccgggctggcttttttgcatagaggccctgagggcggcaaggattgtcgtgcaaaaaaaccctccctctcctgtctgccgtcaccgtccgtccctcccctgtttgccacgtcagcttgccgccctctactagggcggcagggtttatttttgtaattttttgcgccgatggattatttctgtaaatattaaaagaaaaaaatataaaaatgaaaaaaaatccaactagtgtgagtggatcgatctataataataaatctatttatagattaaaattattaggttatctactcgtgggttggcccgcttacatatttaggtctgtctacgtaaaaatgtaagaatcaataacaaaatttgtgacacctaaatattcagtctcaattggttcggtgaaacatattgtgtgctagctaggccattggtcgattgaatatcaattcaacaactaggggtcaggtatatagcaaatgtgctcattttaatataccacgcaacacactcataaaaaccgaaaaacacttgacagacaccgcgagtgacccacatctttactaacacagctggccggtccaccaagcctaaacatcatcgagtaaccgaccacatgtgtccgactaaagaatcgtcatcaccaatactggcatagactatacctccgtcgcttcctccgtgacaactgacaaacacgccacattaacagtcaatagagtatatatgtggtagttataagaacaggattgatttgtttaaattcttcttcttctatatattcttattacattccttatctttacccaagagtactttaatgtatataatgtttctaaggctcaatacaatcgtttaattatgcagtagtatttcggtatcagagcagcaacctagggtcaccgttactttatgctttttcattgttgcccttagaagggaccgtatcatctgccattccagttccaactggaatggcagagggctacagtgatccatgctattggccacttacatccgtcggatcaagcgtggacgtacgagacccgtcgctacagtaattctaataaagtaaccgattgtccgatgtttctactgttcctctttgccatttaccccctaatggcagaggatgcgaacccatctccctcggggcaaccacttgtttagtcttcggctttttcttgtgtcattgtgcatcgccgccagattgatctagatcccctcggacgagtcttctcattcgtttatcacgacttcgttagcatattcaagcaaacaacaattgccatccatcctcgttcttgtcattgcattgaatgaggcatggtgccatggggtgggagcgacgctagggtgcactgcgataaatgcaaccaagggctcgatgtcattgttggagtagctacatagattcttagggcgggtttggttgcctacatcaagcttggcccgcatctgtagatgcaacttcctcttgtttggttgcctgtgcggccttctcagcctggccccgctgatgcaaaaagggcttcccagccaggctgaggagaaacgctcgattcgagcttccgagcgcagccaggcccggtggctacagcgggttgcatccgcgggtgcaaggtatttctaagtggtaatatcaaaaaagaaaaagtatccaaagctgcaaaccatgcaaccaaccaaacaaaatgtattccaaactgtacatttcatgcaatcaaccaaacagaatctcctgctagccaggctaaactgatgcaaacaaccaaacaaccgcaagtgcatctcctcggtcaggccaaacttagcctggatggaagagatgggccaagatgaggggatgcaagtaaccaaacacaccttgtacccacggccggggactcgcctgctgctttcaactatggctttatggtgccgcttgctaaatctagctatattcatggagaagatgagatgaaggaaaaaatacatgaacaatttggtctaatatatactccagtgttaaaatataagttataatgttcagtttcataggtatatatggtgttaaatttagtaatagatagctacgtgttaaaacggaaggagtatggactaaccatgaaaatataaaattataatggcatgacttgaataataatgatatcttttaaatggctgatattttttaaaacttaaaacttataatggcatcaatataattaactcaaccagatgaccaacctacggattatctacttaaggtcaagcctcattgctctctgggaccgacaggtgggtcccgatgaccattgaccactggcccacatgccagtgagtgtgtgcttctggtttcccattttccacttcgtcgcttcgccccaccctgactccgctccagatctccccgtcgcgctccgctccgcctcctccgcgtcgccgtcgtcttcctcctctccagccgatgcctcctcccaaaccctagccacctcgcaaaaccctagatcccctcccccccgccccaccacgccgccatggatccctccggatccggccctcgccatgaccgcctcctcatctccccgtcgctctcctccccgtctgtagagatggtcgcgattcctccgatcgcacgagggtagggggaagaggcgagcgctgccaggggaaaggggacggtgaagaggactgctcagcggactccatttgttaatccgatctctaatttgaaagaactgtatcttttccgattaccggttttctgttccaggtgcaattctaatttgttttatctgaattatcacatggaatcgattccttaatgaactttccaactgaaactaactgctgctctgagcaatcaataatttagttactactaccaatcaggttatatatataccatggcattcttgttttggttaacgatctctagctgacaagattctgtcgttgtgattcccgtgattttctccaagtcgaaggtggttaattactgtatcgacttgggcagtaatctgcaaaattacaattttaccccgccctcatattttttttttgacaattatagccctccacttttctactgctgttaagtgaggtggtactataaaccggtggtagtataaaccgatctaaactcttgaataaaactagatgtgtggtttagattgttttctactgctagcagagagcaccgtagtgggactctaattcataggctaaagaaaatttcacaagagaaaaatgcaagaaataaaggtatcgtgcacatttctactccagcttgctacctccattcctaatagagcacaatggtgtattttcaacacatacatcacgatgttgtatcaacacccagataaacaagtcacttgcaagttcaattaaaagtttattcattcaaaattcataactttttaccaatacaacaaagaaatcagctttacacattgatggaaatgatagatatagaattttactctgcctaatatatgtaagctcctaaacaaaagctaggacataagttaagtacatgccatcacaagagagaaaatagcatacaccacagttgaacagtttgaagttgagtatatgataacaagtgacattatgcatactatagcctagggcctcttgatgtttccacaataactcgtttcctgcaaggctcaataacctcgaaattaacagttgaagggactttcccttcgatatatcttctaataacttgtggagccctatatgcttctattagatctgaatcagacatgagcaactctctgtctaactcagattccatccgatcgtccgtagtcatcataatgccacagtcccaggatatgaatctcctaatttcgtatttgaaaccatatattctagtgtccagcgtaaggaactcgagtgaaggcgtgttgtcaagaatgtgacttatcaactcaactagggtctttgatgacatcagtccagtgatctttacattcttcaggttactgtagttgcatttaggaagcttcctcaattccgaggaatcttcaagaatgcgatcattcttagtcccgacagagtccaactgcataaaaatattgatgtaacaataccacaggtaaataaggttttgaaagtatcagttccaaaaaaagccttgttgcagttgtgatatatcaaacagttaaccatatcagtctatgttggtaaaggttatgttttcctaagtttgagctaatgcttttaacctttcactgtagctagctttgagacataacaataaacaatgacttacatgtaagacaaaagtttccaaggctggggaagcgtcaagaaaaaaaacaagagaaaaaaaatcatagcaggggggtgattcctttctcggtccaataaacaccatctccaagtacctgaggtagagaaatttattaggcaccatgggtgtgttgacatcctacagaaaatacatacagaaaaaaaattagtatcatatgaaggaatgacaatgatatgcctacatcattctccaataatttgaacataaaaagtactattaactagttggcacatagaagctcaaacaaacctcatcacgagtcattagaaacagattttcaacattacgggcaatggttggaagcttggtacgggcataatggaacatgcggtgccaagggtagagcaatagatttacatcccttaattgtactgcatctccgagtgatattactgtcagtggccctcgataatgaaaactagagagcattggagcatttatctctatcatatctaacctatggctatgctgcacacgcagacagttgagcttttgcagcacacttgttgtcttgaggaaaccaatcttgcaacaggaagagatttccaaactctccaaatgaaagaattggagatgaagcatgccaattcctccccagtaatgtccacccaactcaaatgcacactcttcaagcttctcaagcactcaaactgaagtgttggatggagcgtgcaggaagataggtggaaagattgaactgaatttcctctacggttatcagaaagcaaatgtgaatatgggaaggtgtattctgtcttgttgcgtaggggaagctcaaaggcgaattccttgattttgagtgtgctagcagccttaagccagcgatcaagatgcgagggatgcactgcatagccaggaccaagttcaagcttgaatatcttcacaccaacgcccgagtggtttcgcataatgttgtccactatggcgatgaaatccacaggtgtctcattgtcattaacaccttttcggtttagcgctaggttttctgcattgaagatgaggtttggatagcatctccaggaatgtagaaatgcatgagatacgcatgcagcacgggcagcgtctcgcattggcacatgggaaagtatcatcagcaggagatcctgtgcaggcatgggaaatatatatctttgatattagaatgatagtagctcttgttgtaaaacaatgttaccagtaatggtcactttttttggaacaaacaaacagtgcatacaagtgtggagtcaaacatggaatataaatagagcagatgtagcttgaaactgcaaatccaagactcagcaggactattggcatattgtattttgtcgaattagtggcttattcattacagctaaagtgattccacattttgttatatcattgatggcttccattgaaacaaataaacattacgccaatcataaaggtgtggagtcaaagatggcatataaacagagcacaaaaacataactagtaaaaaccacaaatcttatgcaacacaagacttaacaagactatttgcatattacttttgtcagattaccagtggcatcatcaaatattttattgtacaaagaaagtgtctaatctgtctaaaattcgaaatgtgcaggcaaacatgaaactatcatataggtatttaattaatttccctgttggacacttctgttgttaatactttgtacctctggaagggaaggaatatctagtttcgttgttttgtcacatggggaagaatcatctcgttggagaggaaactcctttctcttggttgcaacctttctttcagcttgtgaagtgctcgacccgcctgcaattcagttatgtcataatcagcgatccaaatactggtggtgaccaacaggtaaccaatctgaactcggtgactggtaccggaacaaaccagccaatttgaatataaattttaaaatctaaactatataccatcatattgttatagtctcatgcatcatattccgtatattatgcctcatgtccctcatcagtctattcaacataagctggtgatactattttgttaaaaaaaaagaaaagaaaggtgccatcccgaaaattttggccaaatttctgaatatcacttttgtgaagatataaagaacgaaaacctaagaggtcacaaaaatagttgggatttcggccaataaacaattaatctaagtttgtgatcttgaatgttgtagcactttgccctaattgtccgctaaatcaaataactggaagtgtaggtcgaagggatcagaaaccacacagagagagaggcagaggcatacctacccgcggccgccaccgccgccgctgtggcgtggataggtctatcatccccactccccaggcgaggagtatctcctcctccggatgaatctttgcgagagaagatgacgagaaggaaggctctgatctgatgaatccattccggatcccatccccacccagtcccaggattgaccacggtcactgcaggtgggccatggagtctgggcccactagtacacgcgtggcctcttctactaggaatttttttcgtttttagattttttttttaatatttacagaaataatctatcggcgagaaaatttgcaaaaatagaccctgccgctccaatggtgggcggcaagctgacgtggcaaacgggggaggaacgggcggtgacggagggtgggtattttgcatgaaaacccttgccgccctctggtggggcggcaaggggtccgaatgcaaaaagagccgcagggggccggccattttgcaggcggccccttgccgcccactagccgggcggcaggcctcgctgcctataaaaggcctgccgcccagcccccagccctcatttctcacctctcaactccagtgaaaaaaaagaagagaggggaggagaagagaagaaggggcgaagccctgccggattcagacgccgatttcaggtaatattcgtatatcctatatgtgactattgagttaaatagtgtgtatttttaaaaaatttgtttgaataaatgcattatatttttatggttttagttgtactaatttagaagtgtgtattgtagatatcggaacaacgtagatctgctagtttggaatcaatactttaccgttgcattggcttacacaagaagatattacgttgtagatgtttattgcatgaaagagtaatatgatctagttaattcgttgacagatatgtcgaacaaaccaatattccaagtttaccatagaccaggaaacgtccgttacgggccaactggggtagatctgtcagattttattgtatcagaaaggggaattgagagaccggctgagaggagtgtaccttctataaaaggatggttaatgaggggcttgaaagttgatccacagacaagtgacataacaatcaatgttatagtaagtcgggcaactgagggtttttattgggaactaatgccagttcaaaactctcaagtgtggagatggtatgtggaaaatgcaatgcaacgtgggtggcctctagctttggttccgtttgtgcacccgaaggatccaggtgtgcagatgaacatggatgatggcgagggaccaagcgctgaagtaaatgagacttctgtggaggaggtcaacgcaggagtggacaggggcgtagtagctccagtgggcattcaaccaggtggagtggccgacgagggggagactgtcgcagccattgtggatgaaatggagagggaggattctgacaacaagcgtgtagaggaaggtgattcgtcagatgaggagacggatattaatccagcagaatgggctagtcaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgttcagaaataccacaggaacattacatgtgcatttgtcgcatctgagatgtatgcgcatgtcatcgataatctcacatacgaaccaaggtcaataatccgacacatcgaggagacatacaagtatactattagctatgccaaggcctggagggccaaacagaaaataatagagatgagatttggaacatacgaagcctcgtatgacaatttgccacgcctgcttggtgttatcgaggaaagaaaccctgggagctcttacgaagtgaagaaattcccatcaattgaacatcctggcaagagtgtgctgtaaagggcgttcttagctctacatgcatgcaagatggcattcgtgaactgtcgtccagttctctgcattgatgggacattcttgacaggaaagtatcggggccagatactgacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacactggcattctgcgagcgatagaagagttgcagtttgggagcatggaacgaggataccctggtgtttgggacgatgtacagagtaggtggtgcatgcgtcatatgggagctaatttcttcaagcaattcaagaacaaggagctcatgaacatgttcaagaggctgtgtaatcagaaccaggagaaaaaattcaatgagctttggaagagattagatgagttgacagccaaatgcagtgatcagcgtgcagcggctccatcgactgccgttgatgaccctcctcaagctcttggacctctcccaacggatagtccaactttggttagaagaactggattggagattcagaaattttctcagtggattctgcatgaaccaaaagagaaatgggctaaggtgtatgacaccggtggtgctagatatagaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacaacattttgtttggaactttcatgcagaaaaagctagaggagttgcgtaaaaaggccatgaaacatcgagctctagtgcaaggtacccaacaacataggttcgagatactatgtcaagataaggcaggcaggggtatctaccgcaagagagtgaagcaggagtgtgttctcaaagccgacggcacatgtcattgctcttgttcaaagccgaagctgctccacaggccatgcacccatgtcattgctgccgcagcggagtgtggcataccagatgcagtatatgtgtcgcagtacttcagtaagcaagcaatatatcatacatggagcggcgagatttacgggttcggcatagctggggagttcacagagactaacgatgaagtactcaatattcctgacccatcgaagctccgaggcaaggctggaaggaggaggactcgtcgcatccgcaacaatatggacgagtcggaggctggcagggtaaagcgttgcagcaaatgcgatgaacgtgggcacacctataagcattgtcctaaagacaaggagaaaccaagtgcggcggaggcaggactatcaggatcagcagtagatggagctcgccctacgggtgaaggcactacctccactcgaccacgtcctaggcgtcgtcgtgccacgtctggctacgtggtgtagttcttatgttctatgttggcatgtgggtttgcttgtaatttgtttcgaacttatcgatgtgtttatgtttcgtcgtgtaatttcagacttcggcttgtcatgtctttaggtctcgtgatgtaacgtcagactaaggcacgtagtgtctttaggtatgctgatgtatgtcggacttcgacacgtaatgttatgttatgttatattatcgaactctacatatatgttaaattgcacgtcatcgttatgtaccattagtaatgtttgctttatttaaataggctgtactcttattgtacgtaattattctcatgatttttttactatttcattaatttgcgagtcatcttttgttttacattactactttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgatcgatggaggccagagacgcacacttttcacttgccgtgcggtgaggtagcccctaccctacaggacgtatcgtacttgttggggctaccgctcgcaggagacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattatatatttagtccgcagttaaggtgcctaacattttatcgacggcttgcaggttgagcagctacaggcggaggccgacgagtactcctacagccgatgtttggaggcgtacttgctctggctttttggctgggtgatgttctgtggcagtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtaatgcggcagttcggcttccgtcagccctttccagtatcgtttccaaccaccgtcccagctgctgttcaccggtaagatcttgcactacgctttccgttgttgcattaaaatctgcctgttcacaataatttgtaacatctgtcgtttcacactaatattacacattaatttgcaggtactcgcgcaagggtcagcatttagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctacgccaggcaccgcgactaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccatccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatttcttagcttacaagggtcccgttgtcgatgtgtaggtttcgcccagttcgctatgacgcaggccgcccacttctcccaggctgcagggtcagcgtctcaggcagctgcgtctcaggcagctgtgtcgacctcgcactcagcgcagttctggcagtacaccgggacttcgtcacaggtagccggcacgtcgagtcagggtccaccactggaccatgctgggacctcgtcggaccgcttgctgccttccaccttcctcttcgacatcactgacttcgacttcgcttcaggctcgacaaaggacgtcatcggcccctcacagctgggaggcgcaccgccggtgcagacgcaggaccaggcgcaggccactcctccgcgggacactcgtgctacccgtgctgtgccaccggatcgtttcaccttctcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcactgatgcagcctcctttattcgcgtgtgatacgagtatttgcccgccatttggcgcatacgaccaatgtaactttcggcgccgatcatgcatgtatctttcggcgccaatcaagtgtaaccaccataccccaccacgttcacatgtcaggggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctaggtcccttgccaccctctattggggcggcaagggacccagatgaaaaagtacggccgcaagctctttatgggcggccaaaattgcaattagccccttgccgccctctgtatgggcggcaagggcctaatcgcaattttggccgacggcggcagacggcgcggtcgacccaccgtctgccacgtcagcttgccgcccaccatttgggtggcaggggctatttctgcaatttttttggtcgatagattatttatgtaaatattaaaaaaaaatctaaaaacgaaaaaaattccttctactagtactaacaggtgggccgtgggccttgagcactggagtactatactgctccggtctgcgggccccacctccatccgtccgtccggccggtgacaatgcctcccaaaccggcagtgtttggctaatgggatagggaaaatgatttcccacccaccaaaagacatctttaaattctaaccattcatttctccttttccatttaatcttaaccattcatttatttcccaatcccaataccaccacccatttcccattatctaaacacaccctagaatctagatccacagccacggcgcggccttcctcatcgatgttgccgtgactcctcgctctagcagcggccaaggttacaggtgttgtagccatcggataccctgttatggcgtgttgccgtttgcgtgatagcaatatctttctttttttttcttcttcttctttttcttcttcccaaatttatcatcaatttagcagtactgacaaagctcgttttttgctttatattgaactagcagcatatatgaagtatagtgaaccaaaggctttgccttggaataatcctgatggtctatgctattatagcactctgtaaatttgtttgctaccctgctagttgcttctgtacagttgttcagactttttagtgaactctacctgaaaatcaatgtcagtactagtaataaattggtggaggggattattctcgaatttttatttttcacatgcttttagctatctgtcgaccttattcattatcccatttgttgtgaggtgatacttggccattttataattgatttcattctgttcatgcattcacttggtatttggtatgaatgatctaacttcttatcttgaattggttatgatcttccctccataagtttgaatagaattgggaaatcattgggtaacaatagtctttcaaaagtttctataggaagtattgttagcaatacctcaatcaccattaactgttgaaatggtgataccaatatttcaatcagcattaattctggtgttgtgatctcctgtgaatggtctccaactatgtaattcgttttgacctgactttatgcaaaatacaatgatgtttcagttacatcagggtttcatagtatgacatgttttctgaaatctgaactgaaaatagagctttgtagatctgaaaatagggtttacatcagggtttcatagtatgacatagtattgtaaatcatatccatctgttggatttggtgttaggttttagaaatcatagcagagtttggaaatcatagcagtgtttccttttaaaaaggttttagaattgaatctacttgtaatttatattatcatgtactacatgatactaaaatttattttagactgcccttctattctgtttgcacgggctgccctgcttcaagtgccattagttactgacaatgaacttatagatttatttctgaagttttcaaatataatggttggatcctcatggttaattttgcttcccttagtacatgtctgaaattgtcattttaattaatattttcatcaacgaaagtatcatcttagttatttttcatcaatgaaaggatcattttagttattcacaagtgttttactattcacacccccccccccccaaaatcccaacataagttttgggatggaaggtgtagctgtttagcataaaacaccttcgtaattaaatatttaaatccaacgacttggatatctgttcttttttcttcagtcagactatttgttctgttgcttatgtttaggtattgaatttattgcatgtcaaccttgcatgttattttggagctggcagtgtttcagtgtgggctgcgctagcggtaacaaattgaggcaaactctggatagttctaccaaaaataacagggatcaaggtcgatggggagataagctttatcttcgagagcgaaaaagcctagatcaggcccttaatgactgttcagtggtaagagaggtggggatgcaaagacagccagtaggtttgctagcattgattctttttattatttgtctgcgatcagcagaaagattcctggtgcttgactgcttgttgtggccagagggcttcttttttgttattgtgcagccacctattaaactttcatcggtatagcggtcagaatttcacaacagcagttctatgggtcagagtatcacaacagcagatatatctgttggctacacttcaatgtatggttttatagcatccaacccacatgaccattatggctgctcattgcaacggtggtgcttatgttaacaccagttacataagttatccctgtgaagtatgttgtcgagttgctggcttcttatgcattgggggttggagtttacacttggcatctccatatctgtttcagtacttcatccaggcagttgttccatatcctcatcttgttgcaacaatcgtctctgctgctgtctttctcttttagtattcacacatctgccatctgggtccagcacaatggttttccatgtgtgttctcttcttgatagcatcgtttccagtcacatcttcttaaaggacatctaagagcaaagagttttgcgggtgatcatgaagcaaagaagttcaccaatatgttggctatagaagaggtcaaaatgtcagtgtttggtctctatgctgctgtaagtttcaactatggagtgtggactaggtgttatgcatggtgcacctggtcacagcttggcttttccaccaaaaacaagaggtcatgagcagaggtagcttgaatgcctgcgattcgtaacttttctattgtattatgtatcgtctgccttattctcagtataactcttgctagtggctcagaccatgctgtttttttccctggtacctttccttctgcttctgaaccaggattgcggacttctttgcagggtttgatgctgtcagcattcctgttaacagcattgtatataggatatggagacctaagactagcaatggagggtgggcacttgatattgggggtcctaggctggctggctctttgctatgacaaacattgcccttctcatgctgccgttacctaatgctaatgtacatttcgattgcttcatttgagattttatatatgtcaggcagacagatgcgaattgtgaagttacttctgatgctggctttcaacaatgccgccagttataatgccacaaacatactatgcaggtaataggatttttaattaggtgctctttattctctagcatcactatatcgtggtgggtaggagtttctgggataaaatacatttaaactaggagatgcaagttcagaggtatgtatattttgtcacaattgttgtgaatagaatctctagcttcctgaacaactgaaccaaaaaaattcggtgctttcttgcaggctttcagtcatacaacagtgattgctttcttaggttctggcagcatgaagtcatcttttaccgtgagttgggagcagaattgtgcaacaatcgccaattgtcatcacttttgtactagatgatctttctactggactagtggtaatctaaggtgttgacgtgttgtgtagcatattatatccctaaaatggtaccgaactcaactcatacagcacatcaccttggacttgtgaccagacaacatcgtgtcgatatgttctttattataagcctcaccaggaactgaccatgcgaatctgcattggtttgttgtcaaagtgactagtaattccgaaatgcagtgtaatgttctccaggtccaggagaccactttttgcttcagaaactaacccagattgggaggacatgtcgtcggtagtaaaattcgactcccaactaatagacccactaaaattcaacgaactggaacaacaatcggtagctgcacagattcgactcccaactaaaattgaacgaactggaacagcaatcggtagtgaacagaaatcgggatcagagcttacttcaagtctgacaagaccaccttgtcgtggagagtggcctcgacatcatggatgagcgcctccaggtaccaacgtacagcagtggcgcggaggtgggcgttgcgcgcgtcccaggacacgcgattcgccaaggagaccagatcgcggaactcctcggcggtgacggcgcgccccgcggctgggagaggttcgccgaagcgcgcctcgagcagctccagcccgcgcgcgtggctgacgaggtcggaggggagcacggcggcggcggcagtgacgcggtcgaggatccgcttgaactggagcttccgcttgttgaggtccttggacatgtccgacgccttgccgagcttgtccatgccgacgatcacccagcccatcctgcccctcgcgtacccaagggaagacatccgaggcgtcgacgaggcggtcgagctcctggacgacgacgcgggccaagggcggcgggtggtggccgaagacgtcctccagcgccaggacgtccaccatggaggtgacgaggaagtcgttgggaccaggtgccgccatggccgctctccttgctcgctgctcgggctcggatagaaggcgaggggaaggggagggctcgggctgagagggaggcaattggggcgatttgaattttcggtttcgactcgccgcctctaccttttataaagtacagtagtacacgatcgaggtggagaaaactgtggcggattcgattatctttttttagtggaatggcttaggtggtgtttgcataaaaggacttaacgcatttagatattaatttagagtctacttacaaaactaattacataaatgaaaaactgcttttgtaattacataaataaaagctaatttgcgagacaaatttttttaagcctattaatccataattagagaatgtttactgtcgcatcacatagactaatcatagattaattaggctcaatagattcgtgagagagaatgtttactgtcgcatcacatagactaatcatagattaattaggctcaatagattcgtctcgtgaattagtccaagattatggatgggttttattaatagtctacgtttaatatttataattagtgtccaaacatccgatgtgatagagacttaaaagttttaattacatctaaacagagtcttatactactcattaaggctatgtttaaggtttccttcaaatttccaaaaattccgtcacatcaaatgtttgggcacatgcatgaagcattaaatattttcgggaaaaaaaaccaattgcacagtttacatgtaaattgcgagataaatctttgagcctaattacgctatgatttgacaatgtggtgctacactaaacatttgttaatgacggattaattaggcttaatagatttgtctcgcagtttataggtggaatctataatttattttgttattagtctatgtttaatacttcaatgtgtattagtatacttaaaaatttttacacctcaacaactaaacacggcctaaattagggcatgttttgatcccctggcaacattttttaccctgtcatatcgaatgtttggacacatgcatagattattaaatataaaagaaaaaataactaattacacagattgcgtgtaaattgcgagatgaatcttttaagcctaattgctccatgatttgacaatgtagtgctagagtaaacatttggtaatgatggattaaatttttttaatgccgtaatgatggattaattattttttttagggaatgacggattaattaggcttaataaatttgtctcacaatttacaggcggaatatgtaatttgttttattattcatctacgtttaatactttaaatgtgtatccgtatatccgatgtgacatgccaaaacttttcacccctatatttaaacaacccaacccagatcatcaatttactgtttaaaaaaaacaggagtacaatatattccaagcagcaaaaccaactcatgcgtgaagacatcacaatatatatcacccaatttgagatgttagagtatatgatagttagagtcatattaggataggattgatttgggtggcctccttctatatttgtaatccttccttttctccttctcatgtactcctatatataccggcccttgaacctcaatacaatcgtaccacgttacgcagtatacctctccttctatactatccaacatgatatcagagcgggcaacctatagctgccgctcacgcttctgctgccatcgcccccggttctggtctcccgggggtggccaccgttttttttttcttctctcgtcgagtcgtcatcctgagagatcgatctctcaggcatttgcgtagtcatcaagcagcaatagtagcgtctccggtcgtcgtcgttctgcccgtcaccccttccgcgttcggcctcgggactgtacccgtcacagatctgtgccgcgcatgtcgtccgccagcgtccaccaaatccaagccgtcgtcgacgtgcggaacttgctccggcgtgacttgttgacggtcgttatccataagtttcgatcgtcaatattaccaaaatagaggagaactagtgatacttgcaatgcatatgtttgttagaataataatattccactagtattaggtatactaaccttttgcagagaatgacaataaagtggaggagaatcgacatcagctcaaacgataaattaatcggacgatgtcgagaaccagacttaagtatgaatgggccaagaactcagaattgacgtgacaaactgggtcagaattcacaagtctgcagagaagaacaacagagtaggtcaccagccgaaattgggctggattgggccggccccaggttcggctgaaccagggggttcggccgaaccctcctcagcgccatccgatccagggcttcgcctgaacggtgtggattagcccccaatggcggttggagggaatttccgaccattccaaccgtcacaaccgtcattgggaggctataaaaggagtttctcattctcacttcactcacacacctcaagcaatagctctctcatttctttcaagcttagtttagtagtatctatctggtggaataggaatagagtagaaatcaggagtccgaaagccttcgggagagttcgggtatggctctagtagcttttctcttctcttttgtaagctttgtatttttattagaatactcttctaaatacatttatggtattgaaatactttccgagtatatgaatgtctactttacattatgttcatgttatacttaatatatggctagcttatctaggaaatactttggtgcgggtataatgtttgcttatgcaattactctatgtcatgacaatgatattagagtagtatctggtagtttaggcgtggtgtctagattacgggatatcattatttagggttatatattacggatgagaggtgggccgctgatgctgacaactcagtacgggtattccttcgccccggtatataatcctaagttaattctctggggaggatattcctccatatttagccccggttgtatggtcatgacggactgtcgtaaggaactcggcagtcaggggtggcttctcgaagtaccaggagggcatcggatagagggtattagctagtatgtcagttaactagaatgtatgtatactatgtatattacaagtataggaatatatttttttcctcttttctttccacttagcttagatgatttattatgagaatgagtagttaaagcttgtgtctcactctactcttgaattatcttaacccctgcttagaatatgattatcacaagtaatatataaactattagttgagttctctctacatgatcttcccgcaggataaaaaaaatacgatacccttggaatactctcgggtgaaatgctacaatggtatatccgtgcgcttgcggatgaactctgtaactataatatactagaagtatttctgcgccattgctgggaattatatttctagtaatgtcgttaagaaataccaacagcgacgccgccggcaccatccgccagcatggcgctgggggacgaggtccctcctccgtcttccgccgcccccgacaccgacctgcacccgccgccatccaggccgacggggccccgcttcctgccatctgccagggagccggcctcggcgccccccaccggccggtcaccgcccgtcgacttcgcccgccgccggccaccgcctcccgccggccgaatgacgtcacaccgtcctcctgccctctgcatatacgccattggtcaccacgtcagcccttgtcgtctcttggagctcatgcgctctctctagtggtaaattattaagcgcgaacctaagaggggcatttggataattgccgaacctaaaagtggcaaatagttaaattccccccttgtcaagagcagagaagggataaagcgttttgaccaggaggacgtggacttggtctatggaccattggcattggactttgctggactgctactgattgctgctcgtgctgttattttccttttacgatcagagatcggtttgcgtcgcccatgccatcgtttcactgagatcaaggatgttgttgttttgctgtcccaggctacaacgacattgtccaacatcgtcgtcnnnnnnnnnnnnnnnnnnnnnnnncgccgtggtcaccatagtgttttttttaatttctttttctttatatttttttcttttggtcgtcgtgtttgttggctcactacaaaaaaaatatgaccttttatgatgaattcctcgtgacgtcagagctattcatcattagcatattccattttatgacgattagtatgagatgtagtggcttagtgacgaaaaaaaagtgtttgtcgttaataccaactggaaatcgtcataaagtatttcaatgggacattgtgatgaatattaatttttcataaggggcaaaaagcaaacgtcatagatttatataatgcatttctagaaaaatatattaaaagttgaagcaatttaatcaagtgaattaataaggaaacaaaaattttcctttaaaaatcatggccggaaatatttttttaatatactaagtagtctaaattattctctgtaattttccgtgaattttcgaagctcaataactaattttaataccacaaagtttatttaacctattaaaataaataaaaaacaaattaaaatcactctctctgtccttgggcctttttcggccaagtgttactctctccctctctcagtccacaacctctctctccctccttggtggcttcctcttcccctcctccctcctcgggccgctggcctagtccttttgctcctccctcaccgagaagtctatttttcctcccttctctcaattccaatattttttcgggtagtaaatgatttcaaatgaaaaaattttcaataacaaagttttataacttatcaagatttacaacttttgttttggtcattttgctatatgactttgtttcaataatttgaatttgaatttcaaattatgacaacttcaaacaacattttcaaatactaaatgatttcaaatgaaaaaagacatcaacaacaaagttttgtaactcatcaatatctacaacttttttttggtcattttgatatatgacttgtttcaataatttgaatttaaatttcaaattatggcaacttcaaacaacattttcaaatactaaatgatttcaactgaaaaaaatcataaccaacaaagttgaataactcatcaatatctataacttttattttggtcatttcttcatccgacaaagtgatactaacattgttcacaaaacttacatatctctcttatagtttataaactactagaaaaaatgcctgtgcgttgcaacaggtgaagtctattttaatcttattattgttatatgatttagttaagatgaaattcaccgtgggatttcgcttggatatatatatttttagaaaattatgagctacagttaggaatctgatcgtctcaagttagcatgtgagttttttttaaatatatatttcttatatgattccttctttattaccaaaagtgaacgatcttaaaaaccgactcaaatacgaatatgtatttttaaaagtaaacgaacttaaaaaccgactcatacacggatgtcgtaccaaaatactagcaaaaaacattttcaatttttataatagtagagagaagatatagattaaaaccaaaacataaaattaaaaccgactcgaatatggatgacgaaccatggaaacattttcaatttttataaccgactcaaacacggatgacggaccgcgaataacatcttcaattttataatagtaatagatataagagatatgtatattttgcgaacaatttacaaatcacttatttacaaatcactttggcggatcaagaaatgaccccaaataaaaagttataattcttaatgagttatagcgctttgttattgatgacttcttcagttgaaatcatctggtactcgtaaatgttgtttgaagttgttataattttaaattcaaattcaaactgttcaaacaaagtcatatagaaaaatgaccaaaacaaaagatgtagatattgataagttatacaaatttgttgttgacaactttcccatatgaaatcatttactaccccaaaaaattatttaaatttcttatattctaaaattcaaattttatatagttcaatcaaactcggatggagaaataaccacaagaaaattggtagatctcagtaagttctacaactttggttttgacaactttttcacttaagttcatttagtatgataaaatttgattctaagttttaatactttgaaattaattttttccctccttacttcaaattttttcatcttctctcttgcctcctctcctgatattttttcatttcctctcctcgagaaaattgcatatgtaccactcataaaaactggcttcgctataatgccaccctcaagataggattcgcccaaacaccactcttaacacgtgggtattcgctggaatgccactttcgggcttttttccatttcggaaatacttttcatcaatttcattttttcttggactattatgcccctgagtcaactgattcggtcggactctttcttctcttcgtttcaatctagcgagcgagcgcgagaagtcgagaagagaagtggcaacgacatcggcgctgcccaccaaactgcatcgccgacgctgcctctctattccagccgccgcggcgcgcctcaccggtcccgccccccaacagttgtgccgccgcctctccccggcgagtctcctccccagccgcgccgcctatcctcagcgaagccctaggccgagccggccgcatcgacgcgtacggccgtgccgtgtctgccggcgaggtgctggcggcgcaccccaaccacgtgctgagccggcagtgctcgtcgcagcagggggcggtgggccggatacacatcgtgtcgccggagtcgaagctggagccggcgagatctacttcctcatcccggccgcctccgtccccgatgccaagaggaggacgagcaccggcggcgccaccggccgagggcaccacgtccgcagcaagtcggagggcagtgccgccgtcgccgattggttgggcagcctgggcaacgcgtcgccggagacgacaagggtgatgagggcgcataagcagcaccaccaccaacaccggcggcgcatgagcaccgggagcctgcctcgccgtggcagcgcacatcttgtgcatcactgatgacccctgagcttagcttttgttttttttcttctcttctctgaatttatagtggttttcttgtctcctgtgtaatttcctctggtgcccggtaaatatttttttcactttttgtgtcagtgatgtgccaattttacattctgaaatcaacaactgtgtataattttcaagcacaaagcgacttctattctagtagtatcttcttgtatcttcgaaaaacattttgcaacttctttttaaagttcgtttgggttaaccaaagcgaacgaacttgctcatacaaaattaaacaagtcggcagctctgcttgatgcgaaattaaatgaaaattaaacctcttgcaagttatatatatgaactcatgaagtgaggttgtgtgtcatggactcatggtgtatgtcaccgaggaggcggcacaactgcgcgcggaccaggaggaggcgaggagcggcacagctggagaggacatcggcgcggcggctggagcagaggtagcggtggcgcagtggtggtgggcggcgccggtgtcactgccgcttctcttctcgccttctcacgctcgctagattgaaccgaggagaagaatgagtctcaggggcataatagtccgagaaaaattgaaattgatgaaaaatattttcgaaatggaagaaagcctgaaagtggcattccagcgaatgcccacatgttatgagtggcgtttgggtgaatctcatcttgagagtggcattatagcgaagccagttcttatgagtgtagggatgaaaacggagcggatagtttccgtccgctccggataaaaacgaatacggatacatctcggatcggataattctcggatagttcggatacggatacgaatacagatattttctcttgggtacgaatacgaatatggtatcagggtttccgtcggatacggataataattcggatatccggtgaacagtgctattcagatatccgcagaagccacaagacataccccatttctctataactctagtagtttatctcttaacactagtccacattattaatattatttaaaattttaaaattatttataaattatactacattttatataaaatgagctaattatatatgttgatatttgtttctattagaagttgaattggttttcgtgttccgagaaaaatttgtttccgtattcgtgtccgatcatattcgattcttattcgtattcgagatagtccgtatttgttttcgtattcgagctatccgtattcgtttccatatccggtaaaaaatatgaaaataaatatgatatgagcattatcggtcccgctccgttttcatccctatatgagtgtggtacatatgcaattttctccctctcctctcctctcctgtcagcctctcactctttctcctctcccctctctctctctcaccgacggcgaggacgggagctgcgcggcgcggcagcggcgggctcggcaccggcggcggcggcggcctcccttccccgacggcggcgggcggcgggcacggcgacggccggcggcggcagatctgcacggcgacgggctgggctcggtgcagtcgaccgcgagcgatgggcgctgcccccagccaccccgcgggcgcacaaggtgccgtctcctggcggcacgcgcgagggagacaaacaacgcctgcgcgagggagtcaatgcgagggggttcaggcgaggctggcggcgaggctcgcaccgcggcggctcctctcctccggtggcaaggtgctcggcgaggaggagaaggctgccgagaacatctacatcaaggtatgtccaccctgttcgcttcccaaatcttccttccctcgtgattcttgctgttcttgctgcggtagatgggctccagatgcaactagagatgtattggtgtgctgtgtagaggtttatggtgccaagtggtgtgtatgtgtgtgcgtgtgttgcggtgggggtcgattcctcttcgcttcttgctccgtcgcttcagggattttggctgatgggacacgtgaaccgtacggtttttttggtagtattgtgggtgcgcatcattttgttgagcggtatggttcggggaaatggatgtgctcctaattgaaatgaggctgtttttcctatgcgaattgctgagtttgcttcaactttcatctgttcatccatccttgtgctgttgtgcacctgttcaaatcaaatttcttaggatgacatattggtctgtgtactgctataataatagattacaagagcagtgtgcaaataagatcacaatttgatgatatattatatatatactgatgcaaacaattaatcagcaacaatttacaggttttgaagttgcatagagcatttaacaaacaagattgatgaattagatttcataaatacatatgagttttacgtttgggtctgcaatttctgcagagataaggtaattgatctgtcgtcagaagtagttaattcaccatgctatctgtacaggttgagactgaacattgtgcttgtagctaggtggagtactactcaaatgtttctaattaagaaacaccccctttaggatatgaaactcctgtttttatagagaaataaaaaaaatagctctaaaaacgccgcctcaacattagcttttcttgtagcgaaaacatctaaattcacagtgcaactgttgagttcaagatttcgtctacttccatctaaacatgtgaagcataatgccccattattcatgcatctgaactactacgtcagtggccaatgcaaatgccatcacctaaaaagaatcatgatcaggagtagggccagaagttgttgtcaagccatggcatgtttggtgaactagcacggccaagagatgctacaacaccggcaaatggtggcgtcatgggcatggggttcacttaagcataatgcatacactcatggacaatttagggaaggaattgaagaataatcagtccatcaatcaatcagcatccttttcttagatcatgcttggtaaatgtgaagttctcttgtttgtttgtttatggtaggtgttgttttgagtaagctgggtaggagtacttgtttttggtgactctcactcattgacctgagctggtggtgattagttaaaaaaaaatggaaatgggaggaagtactacatcagtacatgcatatacattgcaaaccaccacaaggaatcaggcatcagcatcagcatcagtcatcacttggatttgtctgcgtttgtgtgtgtgtgcatcttttgtgcatgcatatatgggtgctagtataactttatataggaggcatttacacacagccacagcagcagtgtactgctctgaagatctgcaatatatgttgcttggtgttgccgaaaaggagaaagtccttcacatctatcactgtctaactctccaccagaagcaatttgcattttttgcattcctcacctcacctcacagtaacatagttcttgacttgtattcaaattgaaggcttgtttgttaatctcatcagaattcagaaaccatccaattcatctttcagaagaaagtatatatatatatatatatatatatatatatcgttttgcctgatctctgagcatgcttagtttctttgttacaaaatgctgaaccgagctgaactgaaaatttcagaaatgtgtgatgtgcaggtggagataacatgcagagggagacagctcctcccgatcctgacattgcagcatgtccgtgacatcagtaactgcttggatattttttattcatctattatactgcttgaacagtagaagaaactaggatgatatggcagttactgatgttttatcttgtgcatatgcagtgctgctaagctcacttagaagatcttggtcacgcggcatccggtgaaattttggttgctgtgattgtatttggaatgtggctggatttggctgttaactgtgttgtaaattttgtgttgtattggatgtttgtcgggttgtgttgatgctaattgggctgtaacatttatgctatatgggtttttattgtgtttgattgttgggcctatatgggcctagcccacttgttatttgatactaatataaatgaatataatatggcgggctgaaaaatgatgtggtataatgtttgggtctatatgggcttttgtactggacttggcccatttattatttaagcaaatggatataatataattgggttaaaaatatgctatatcatagatgggtcaggctaaaatctagtcgggcttgccattgggctaagctcataaacaaggtactcaatacatgaattttaatgggccactagatattttatgacttttttagactagataatgacgaatatgagcatcataaagttactttatgacgacagaaggatcgtcactagattaatgatgaaaaaataaggtttcgtcatagaacgcctttagtgacgcatgataggtgacgggaattttcgtcacgcgagtgtcacagattacgaaacgtgacgaaaattttaatgtttgtgacgtaaatgaagcgctatctatcataagatctcttatagtggcttcttgcctgcacctgcgcactcttgcgcctggcgccacaatccatgccacgaaccgcaaccgcacactattgggtgacttgtgctatattgatattggcgataactggctactacgactacgacaactttatctcggctacatcgactacggcacaaaaggctatcatcgtgttgggtacttttgccggttttttctccagtccaagtgtccgcactgctcacgcttggactgcgggggatgttaaagtatatggtagttagagtcatattagaatatgattgatttgggtggactcattccatatatgtaatcctttcttatcctccccatgtacacctatatataccgccccctgagactcaatacaatagttttatgttacgcagtatacctctcctcctataatatccaacatgacaatccaaagcaaattaatattaggagacttgcaatacctttcgacgtgatcactgcaaaatcagtgtgttctaaagatcaaaattcatacagcaggtgatgatcgagcatattgacaaatgacgaatacaagaacgagagtgtatccacgcaaaaaccacgagccgcttctccgtcgatcgagatagtacgctatgtcaccacgagccgcttctccgtcgatcgagatagcacgctatgtctccagggacgctgcctccgtgtcgagctcagccgcgcgcctctccagcgcagaggcccagtcacgcgagcggatcgtgtcaagcaactcgctggcctggagaatcggctcggagaagcgcttgatcgagaggtaatcgaggcaggccgaatcgagagcgcggaaatcatcgtggtcgatgtggctgaggtgaagccataccttctccatctccttgccatgacggatcctggcacgagctacctcctgtgcggaggctatctcgtcgtcgtccagcgacaccaagtcccacaactcggaggggatccgcttgccatcgaccatgacctcgtcctgcttcccctcaacctcctccccctccccctgctcctgggccatcgcggcgtcctcgacgatctccccctcctccaggtccatcccggcgtcctcgacgatcctatccgtcgcatcggaggaggccccctcgccgccgcccacgaactcctcctcctcctgctccatcgcggcgtcgtcgactatccagtcggtggagtccgaggcgcccttgccgccgcccacgaacccctcctgctcctcctcctcctcctccccggcaacatccctggcgcggcgacggaaaaaactcgtacatggcgttctgctccactaagatgcgcagcagattgcgggccacgtcgcgcgtgatgccttcctccggctcatcatccacgacgagcagctcgcgaagcttctccgcgcggttgcggaactccgcggcgcgcgcacgaagggcggaggctgtcgtggtcgcatccgccgccatggcgtatgcgtgggcgtgcgcgtggcgtgagagagagaggagaggggtcacaggtgggaccgtgggaggagagagaggaagagaggaggaggctgagctggaggaggggaatacgatttttactttatggtttggactatttatagcccagcttaaagcaagcaatcagatgatatttcttttttttggtatttacagaggctatgtgtattgaacatatttgacatcaattccaactggaatgcccgttgctcactacgaaaaacagttccaaacctattttgcttcaagcatgcatgtgacatacatgaacaatgggagcaatgatatacatagattttttttctatcttcttactttcactctccagtctccatggcaaacaaatacaaccaaattcgccataactaaagccttttgagacaccatgacagactaactaacggatgaaacaaaattgcgtaatcctaaccaacctaatcacaatcaagaacttgagccggtcgttgagcttcttccggcgacgggcgctccgccatgttcttggccgggatcccctccgctggcgttgcgacggatggagctcgcgctcattgggggaaacgagagctcgcgctcattgggggagacgatcgtcagaggcccagcatcacggccttgccgcgtccacatttgcagagaacgtgtagtggtcacgggcacagaagaagcggcggcgctccgggcacgcccactgcgtcgaacaagttgaagccggtgaggccaccgaactccggcattttagccggatgccgacgcggtgccaatcgaagccgacgaacaccgccgcgttccccagcgccaagaaacgccacccggagacgtcgaatgatccggctgttccggccgctcgccgtgttgaatgatcccggacgcggaggcggagcccccatgaatagatggaaccagcgccagccatcgacccccgtgcgagccggcgacggcgccgacccccgccgcattgtagtaccagtcttcatcagccagcccggcgcgcggaaccccatgtcatgcctccggcagcggccacggccaggaggtgtgctggtcgcgcgcggtggctccctgcatcctgcgccgacgacgccgtcaccacatcaacccctgcggtggctgcgccgcgctgctcgactgctcgcgcccatatttccacttgtgacttgtgccactgctgctgcgagacagccagatagagtatgtgtggaattactgctaaaagcccaatttggaacaaaagaaaaggcatatactataagttttaaaggattcctatcttgtgagaagtaattatatgcagcattttgaaacaaaaagggttaatccctatcaatgccgttaaaaatttggctgtgtacatctgattggatgttgagactgggtttatcccattttctaaaaaaaataccgttaaaaatattatgaaatgggctggaattttggaggaaaacaagcatggtatatctcaccttatgttttttttgcacgtttgtgacttgagtttttgaattatatcacgataaaaagaaccaacatttcttcttcagctttcaatgtcgttgccatggtctcactctcacgaacttatcctattgttaagcaccacgggaattttccttgttttgacatcgagttggcccaccctgattgctccatcgaatcccctacttctatttcgacatatcaacgccgttggctcatttcaccattcactgatttatccccatctttattgtaaatgatctgaacataggttgcactttccaatatgttaattcactaggccatggttaacgtccgtagcgcctatggttcattccttatagtccattgctcctcttggatttagggcctacttaagttaagggaacttctaataaccatggctactttaagaagctccacaccaacttctcaaatactttagattctcaccctacattttaagagtagttgtagagtcgatgaactagtagacattcttttccaccaagaagatactcgtgaagtacttttcacagtctctaactctacaaacaaagtatgacttgttcatgatttaaacttttagattaattacggacatggccacataattattccatcctaattgctccaccgattgccatagttaagtcgaatgatttagcccataaaagttttatctttacatttaaccttgtgaaagcctttctcggagtttattcttacacacgacatttgtgtaagaataatataggtccgatccgtcgttgattaaaagctaactccaagttaccttgtaaaacagaccaatctaaatttatgcacatattattcacatcttaactactcctttcgtccataaatataaaatagttttatctttttatccatccaaaaatataagatatttgattttttttatttgtagacaaatatatgaaatattaagatctcgaggacatcaccttagttatccattcaatctctcagcctaccttttttttttctttatttctgttaaatatgtcaaaaaaaaataacaaacataatctcatttatacctttttgttgctatcttaagttttatactagaaaattggtataatcccttaaataggtagcaatgtaaaatgagttagaaataaacaagattaccaaccaacgtttatctacttaaggccaagcccattgctctctgagaccgacaggtgggccccgatgaccattgaccactggcccatatgtcagtgagcgtgtgctgctggtttcccattttccacttcgtcgcttcgcgtcgccccactcgattccgctccagatctccccgtcgcgctccgctccgcctcctccgcgtcgccgtcgtcttcctcctctccggccgatgcctcctcccaaaccctagcccacctcgcaaaaccctagatcccgcgcacacccccaacgacgccatggatccctccggatccggccctcgccacggccgcctcctcatctccccgtcgctctcctccccgaccttctccaccagctccccctcccggtcccccgcaccgcaccacgaccgccgcaactccacctcctcgccgcagccgctcctccccttcccttccgcttcttcctccaggtccggtggcggcggtggagcagccgggggcccgcgcgccgcgggggcgttgtcctccgcgtcgcagccggcgttcgcgcacaacgcgcgggtggcggccgcgctggcccccgccgcggcgttcctgctcgacctcggcgggctcccggtgttcgccgtcctcgccgtcggcctcgccgccgcgtacctcctcgacgcgctccgacagcggcagggggccttcttcaccgtctgggccgcgctcatcgccgccgacgtggcgttcttcttctcggcctcgctctcgtcggccgcgtccgcctcggtgccgctcaccgtgctcgcgctcctcctctgcgccgagacgtccttcctcatcggcgtctgggcgtcgctccagttccgctggatccagctggagaacccgaccatcgtcgccgcgctcgagcggctcctcttcgcgtgcgtgcccatcgcggcgcctgcgatcttcacgtgggctgttgtgtccgcggtcggcatggccaacgcctcctactaccttgccacattctccatggtgttctactggttgttctccataccacggccgtccagcttcaagaaccgaaagcaggatgctccgtggcaggataccgatggcattcttggccccttggagagctgcgtgcatgctttgtacctgttgttcgtgccagtgttgttccatgctgcatcgcaccatgctacgctcttcgcgtcatgggccaatgtgtgtgatctgctgctgctgttctttataccgttcttgttccaactctatgcctctacacgaggtgccttgtggtggattaccagagatgtgcgcacaatggatcagataaggatggcgaatggcttggttgcgctggttgtagtggtgctttgccttgaggttcgagttgtatttcactcgtttggaaggtatattcatgctccaccacctctgaactacctgcttgtaacggtcacgatgcttggcggtgctttgggtatggcagcacatgctgcgggcaaggttggagatgctgttagctcggtagcctttaccgggttggcagtgcttgtcagtggagcaggtgctatagtcatcggattccctgttatggtacgttgcagtcttatggtatcctcttgtagtacttgcaaatttatcatcgaattttgttttttcttatgcttgtagctgtatgttaatcttagtcactgaccaatgtgtttcaaggtgacacttggataatttacagttgactttattctattcatgtatttgcttggtcttttggtatggatgatctaagttctcagaagtcgttggttctggtgttctatctgttaaattgattagaatttgagaactcattgcataacaacaatcttttaaaagctactatgggaagttattgtagctgtatctcaatcattgttaactgtggaaacagtgttaccaatgtctcaattaacattaattgtggtgttgtgatctcatattgattctctagtacatggcaatagctggctgtgcatgctctccaactatatactcctttctgagttgatattgttctccctgaatttgtctactcaagctggtgtgattttagtttttatacagaaatgctgtacccaaatccatatattcctattgtgacactcctcaccactactgcctacaaaccttgggtaactttgctcctaagtataccatgattgtgaatttgtgatgattctcttgagtccttagctatttgttaagatttagtcagtatttctatttcagggtaattctagcaagctttgcatgttcatagttgcccatgcttgaaaaggaaacttgcatacacacacatgagcgtagtcttatttaacatcataaaaatgatgttcttgc

SEQ ID NO: 46418 - DNA, 29545 bp, Oryza sativa
ttctgattgttgtagaatagctgtctcacttccctttgaccgactgtggtcttgaggcagtagtctgcccatagattttcttctattgtggttgtcctaccataccctcgaatatgcagcatcagcataaaaagttattacgtagcatttttatttttgatcactctatacttatttctgtgaattaatcttcttgcagttccttccacttccaatgatttctggctattatgcggcaaggttctttactaagaaaagcttatcatcatacttcacctttgtagcaatagcaagcatgatggtcctttggtttgtagtccataattattgggatctgaatatatggattgctggcatgccattgaagtcattcaccaagtatgttgttgcagccgtaatcatggcaatgactgttcctggtttggcgcttctcccaacgaaactgcggtttcttgtagaacttggtcttactggtcatgcattattgatatgctacatcgagaaccgattgttcaactatgctacgatgtactactttggatttgaagatgatgtcatgtatcctagctatatggttttgtttacaacctttctcggattggctctggtaaggagattatctgttgatcagagagttgggccaaaagctgcttggatcttgacttgtctttattcttcaaaattatcaatgttatttatcacatcaagatcggtgctatgggtttcagcggttttgctactcgctgtcactccccccttgcttctttacaggtataccacagcatcatgttctaattgagtgttttgacttctttatataacattcttccctgtaccttccagagacaagtccaaaggggcttcaaggatgaaagtctggcaagcttatttccatgcatctgtagtagccttttctgcatggctctgccgggaaacaatcttcgaagctttacagtggtggaatggaaggcctccttcagatggcctacttttgggttcctatattctgttgacaggtcttgcttgcataccaatagtcgctctccacttccctcatgctcaggtatttgacgcttacccctctgttgtaaaaatatcgatcttctcataatcatatttgttattatctgttcgtgatctgctctgtacttttgcactaaaattcttcaagtttgccttctcaacaaattccctagtgagggtttgcttcccagtggttatagatggaccactgacttaaaacactttgaggttgaggttctgtggaattttaaatgatgacatcaattgtcagctccagcttatttaccttcttgagggtatcatgttggttgacattgctttggggacactacttgctaaagaacattagatgcaaacattagatgatgatatgtccaatacatgctacacactggtaggattcaagctaaccttttttggttggacgttaccttgattttggtaaagttttattaagttccatatgttggatttcattttaggttatctttttaaagagtttttgaagtgatcctactcgtaagttttattatcatgcccataatgttaaaagttattttagattggtctaaggctttgcttgcacggaatgcactgtttgaagcacttttacttactgaatactgatcactagctaaatgcctatgcttctctatggataaaagaaaatatgccatagtattgcctaaaataaatgtattctttttttgcttcaggcatgttactcgcttgtttgctataggctgtgctcaccttgatcatatatatgtggcaacccatttatttataactattctgtaatagaaaaaagagtatcagggcgcaattataaaagctggagaggatagatgtatggatgaactttgaaaggagtatagatgaacttactccctctgatcccccccccccaaaaaaaaagaaagaaaaaaaccaacctagtatgggatggggcataatctagtacaacgatgtagacacgctcctgtccagattcattatgttctatctcgtactaggttgggtttttttgggacggagggagtacaggtttatacccgaagttatgatgatgcttggatcctcatgtgttagttttgcttttctcatatgtgtagtcggtattattcatattagaaagcatattattcagtgtttacagtatctgtttagcaggaagcaccttcattttgaaatatttaaattcaacattttgctgcccctatatttgttacttgttcttttcctttctcatgttgaagtgtcaaacttttggtaatgtgaacgttacaaggtattttggagctgctacaattgattctatgttacgatttgtttgcagtcagccaagagattcctagtgcttgttgtggctacagggcttctttttgttatcatgcaaccacctattaaactttcatgggtataccggtcagagtttatcaaagctgcacatctatctgatgatgacacttcaatatatggttttatagcatccaagcccacatggccatcatggctgctgattgcaacagtggtactgacattagcagcagttacatccattatccctgtgaagtatgttgttgagttgagggctttgtatgcattgggggttggaattacccttggcatctacatatctgttcagtacttcttccaggcagttgttctgtatcctcttcttgttgcaacaattgtcttggctgctgtctttatagtattcactcatctgccatctgaatccagcacaagggttttgccatgggtgttctctttcttggtagttctatttccaatcacatatcttcttgaagggcatctaagagctaaaaattttgtggatgatgaggaagcagagaacttcaccaacatgttggctatagaaggggccagaatgtcacttttgggtctatatgctgccattttcatgattattgcattagaaattaagtttgaactggctttgctattgcgtgagaaagctgcagacaaaggtgtaacacatggtccacctggtcggagttctgcctttccaccaaaggcaaggctacttcagcagcgaagagctcatgctgcgccaactttcactatcaagagattggcagcagaagcagcttggatgcctgcaattggcaacttttcaactgtgctgtgcttcatcatctgccttattctcaacgttactcttaccggtggctcaaatcgtgctattttcttcctggcacctatccttctgctcttgaaccaggattcagatatcattgcaggatttggtgacaggcaacgttacttccctgtaacaatctccatttctgtttatttagtattgacagcattgtatcgtttatgggaggagacttggcctggcagtggcgggtgggcacttgatattgggggcccaggctggttctttgctgtgaaaaatgttgcccttctcatgatgacattacctaatcacatactcttcaatcgcttcatgtgggattatgtcaggcagacagatgcgaagctacttctgacgctgcccctcaacttgccgtcaattataatgacagacatacttactgtgcgggtactaggactgttaggtgctatttattctctatcacagtatgttatatcaaggcggataagacttgctgggatgaaatacatttaaactaggacatgcaacttcttttgaggtaaatcttgtatgccctgcgtcaatggttgtgaataagagtctccagcttctgatgctaatatttcggtgcttgcttgcaggctttcaaccatatacgacggcgattgctttcaaaggctcttgcttgaagtcacatttgtctggtgaactgtgaacaaaattgcgccttgaagtagagaaacaatggtcagtagtcaccagttttgcccttagatgatctttatactggtaacctaaggtgttgtagtataaatgttactgaactcagctcgtacagcacatcaccttgggtcctcagaacctgtgaccatacagcattttgtgtcagatactttcttatataagcctcaccagaactgacatatgctgagtctgcatagattcttttgttgtccaagtgactaattctgaatggcaatgttctccacggagctgtctggttctgtttgcttcctatattaataccttttcaatgtacattatatatgatagggtatatgctgaggtcttggagagttggagtgactgatcttctgtttgtcagtaatcagtcagttttttcccaaaaaaacttttgatttcatgagatagttttaggatctgctttctgacttgtgaggctgttctttggtactacatgaagatttgcttcgtattcggaagtgcacgagtttcttcaggtcgcagtgatagacacgggatattctaaactaccatgtttgatgtttcatcagaacattgtctatgcaattttccgcttcaatgcatttacttatctcgaaaattggacctgttgtcagtcatcacaattaaaagtttttcttttttgaaataagaagggtgtttctcctgtggtatttttgttccgttgaaaacgtaatatgaaaacccgcttccttggtcacaaagcgaccgacgaatgaccggacgcgctgcacatggcccagacgctgccacggttgccaccgagccgcaccgctcttggtgggtcccaccagccaagcccgaatttaacgaggaggcgatggggcccaccagtcagccacacgtctcccaccacctccgcgatcccctctcctctcacctcgcctcccatggcggccgcgctcctccgccgcgcgctccacctcacctccacctccgccgcgcgctcccctcccctccccgcgccggcgcgctcctcctccccgccgccgcttcctcccccgcccaccgcttcctctccggcttcaccaccaccacccagcagaacagcgcctccaccaccaccatcgacctctcctccgacgagagccgccgccgcctcatcaacaggtgcgccgcccatcccgcttctctctatccttttcctttccccgcgatacctcgtcgccggcggcggttgttgacgttgtgttgggggtgggtgctggcgcaggctggtgtacaggagcaagcagcgggggttcttggagctggacctggtgctcgggacctgggtcgagcagcacatccactccatggacgaggccaacatccgcgccctgctccaagtcctcgacctcgtaagatatctttggctctttgcctgtctcccctcttatttcgtcatgtacaactattcatccgagtaaacctgttgccttgctgtaacagtagataaatcagctagttgaaactgttcccaatgaacccattgtatatggtctcagttatattttactgtttatttttccctggccttgggtcaatttgtaatttataagtatttgtttgggggtttagcctccattctctaaggctgattcgtagttgtgtgcttttgtaaagagctatggttgaacacctttaagagaatgtaaagcatcttgatgagtactgctcggtagattcagaagggccatgaggttttttgggaactagaaattattggttctgattgttgatgctgaagagttctgactatccacgtgggttagttttcttgttcaacaaagtcaggaaatagtttcagcccatcagaagtttgcattctagccatcctctgagtatcctctgagtagttgcaatgaatacatgggaatttgattgggcaattcagcaattgtggatcctagatccaagataaacatccagactgtacattcatggataaagagagtataaatccaggcagtggcttttgtgactgaaaaattcatagcataaagtggtataactgtaagtcatttgaccagacaaatttggtaacctatgagtctggttttcctttgaaccatttatctgcctcagagccttcaaattgtttttttttgggttgaccagaaatgtcttcttaaacaaacaagaataccaatcacattttagaatgtttagaatgtctatgcatcatctctcatgcttaacaacgttttatataacatgcttcatactgctcataacttcttggaaggcaagtgccatgatccattggacagccagtgcatcaaagtatccatttattcttgtgttgaacttgtagattggctctaagctctaatttatggcttttcaggaaaacccagatttgtggaagtggcttactagtcaggaacaaccacccgaggcagtgaactctaatcctgtatgtcatatcacagaactcttctatctttcttctatccttctgaatctctggttgcttctgtactcaacgggttttgtccaaacaggtatttatcgctgttaaatcgaaggtcacggacaacctgagcaagcactcttctcctgagaccagatcagcacctggtcagccatgggtgagagggtgggatgacaagcgaggcattgaaggaccaaagtatggaaatcagtgatgagatatgcttcagagaatggtagcggttttatgcctaagtataatcctgttttgttgcccctatagtttggtgcttgtgtagaataaattaaatcatggtatccaatgatttggaaatttggagtgtcaccatgaatttggattgacaaataatgctctgtacaagtttcaaacactttctggttgaagacaaagcagtgtggtggtaacaacttaacatgtaaatcaaaagctcttgtgtttagcattttctcgtttatgaaataatgatggaaaataatactctaaattgcaatgcacagacctatatattgcaaccaacaccttaagaggagggcctacccaattaatagaaggtcaatactaattgtaagttaaatgatgagagacatctgatcatcacggggcccctcatttcactacgaatcatagaactggtgtatatatctttgcaagatttgaaagaaaaaaaaacattgccaaggcacgaataattgttatactgaaattgcaatgttcattttgtggtgtatacaccatctttgccacactgaaaaatgaaatatatcgctcttatttacagaataaatgaaagaacgaaataataagatggaattatttttgacattatcgtacatcacagaactgcacagagaaaaaaaaactatcgtttgagaatatcacaattaatttcatcttcatataaagaaacgaagatcacttcaacagtatgcagaatctatgaaccggttgaagcttgttgagctcgcatcaccatttcttcagtagtttgccctataatgtcatttgcacgcttcaatggaacacatacaattctcccgattgaatcctgagcagacaaattttctgtcagaattaaaaaaaaacctcgaaatggattggtaacttttgataaaaacaagttagagctagatcttgaaatataaggattgttcaatgaaatttgaggtactttggtcactttctgcgctgcaattacatgtgcgtctgctaggacgagaatcaaatatttttacttggagttacttgaatgaatctcgttcgtaatcttacccgagatacaattccaagcttttctagcttcttcacagcatcaacaacgtcaaaattgcactccacaccaaattcttccttgatgagctgttcgcagcgtaaatcgagatcctgtaacgggcaataaacttcagaaagtccatatatatgtgaataagtcttaagggcataaaagtgaatatgattacatcctccatactctccatttatatgatgaacttgatgccacagaaactaatgtcagaaaacagagagagatgtgtaactagtgtacagaaaaattatggttgtgtgggcacaataaaaactgcaaaagcagataatgaatgcagaatacgtgtggaaacatttttttttcatttttgaaaagcatttattcaaatgggaagcaagtagggaaggaaaattagttatgggcagctgaaatatattgcataaacgtcatttcgggccttcagggagaggtatgattactcacttgtacagttgcctttccttgctccatcaaaatatagtaagaaacaatgacctctttaacctgcaaacccattttatatgtcagtggcatatacaaagacaagttatatatatcaaagagaaatcccccatggttccatacttcttgctggatcacatcatcacacaaatgcagaagtgttcctttcccactgtcaagctgtttatcatacatcgattttgtaatcaaattctggtaagacaccatattggcctgaaatctgtttgacaagagataaaaattctcggtaagcataacatcgtgtaatagaccatgtcggtatacaactgatatataccgaactgaatctaatgtttaagaaataattgtactatgataagtttaaccacttacgtaaagtagatcttagcacagtatccaattaaaccagacaagattgctatgacaacccatatatcagcctttggcatctcaagagaacctattagagtaacctgaaaagaaaatggctatttagatgctcaaagattaacttaccatcatggttggacatttagagcattaggcacataccaaacctaacacagcagaaataagaaatttcacccaatccattggagtcaaactagggttcttcttctctggctaaatcatagaaatactaatatcaggtacacacaagaagaacagaaggaaccagagaggaaaatgatataaaaaacatcacatatgaagcacgcttctatattaccagaactaattccatatcagccattggaatgttcttgaaatgctttacaaatattcctcgatccggcttggcttctgtgcttgatttccttttaatttacaatcgaaacaagaaagtattcagtgtgccaagccagaagatttaaaaatgttacattacttaggatggttagatgaatacatgtataacagagcgatacctatataccacaatcatcctttcaaatgtaggttcttgaattgtcatttgacttagtagattctttatgctgccaatgccacaaggaaaatatgcacatcagatataagttcacttttagtgccaaaagtttacatgtaaacactaatcaacaacctcagctccatcttttctaggcgaatgcgctcaacagaaaattcttgttcttctacttcttcattaacttcatcagtcttctttgggtcctttttggccctcaattgctttttcttagagaagagtctgtcaatcctgttgtaaaaccaacaccatcgttttaaagtaaatgattatcttccaatcttgaagtatgaaaaagaaatgatgttattgaaccacattatcatactttgtaactcttagcaatgatctccacacccgtgatattattacatccactttctccatgaagaagtaatcagttgtccggtcgattccaatgccccgccgaaatataatgtactgcaagcatggttgatgtgataattagttatgcaatatattatgtagaactgaaaaaaatgcatttatcatcaaatgtatgccatcatcatgaggtatcaatagaaagaaagaaagccatttagaacaaagaagactgttttttttttgttgcattcattcttttttcgtccaaactgttgcttatgctcttgaaagtaaaagaatgataccttatcaacggatgctggtagattatcatgtggatgtgctttgaagtaccttgtcaacaacttcttgtctacctaggatggttaaaaaaaacagttaagcaagtgaaatagatcatctgtttgcatgcatgtttatggcccttgattgaaaatattacagaagtaggttcagaccttggattcatcaactttgattggtaggttcagaagatactgaccagactgggctacatcatattcttcatcagataacaacttgaagttgctcttttccattatctagttagtatcatgagtattttttttagaacaaagggagtatgagttattgtcaaatctcacagaccacatatattttagctataacgaagtgtatatatagtggcttaacctgaaacatataagttaagaaattgagttcaagcgtttcaatctcatctggtgtcaggctttgctgctccaaactcttcacgccattaacaggatcaaatagggcatataattgctgaaccacggcacaaaattcagacaattgaaacttgatcaactgaagggagaactatgaaataataaaggagggggaaaaaagaggaagtggcctagataccattaggtcctcaaattgcagaagataccaagcacggatagtgtactccaccctcctacatagcttcaagaactcgccacgatccttatcttgctctgaagattaaacccaaaaaatgtgtggattatgacaatgtagataaatcataaaatttcaagtgcacagttccaaataacagaaattctgattcacacatggagaagagtaaaactagttgagagtttcagaaatgtcaggttgtttactccaaaagaaatttcagaaactcagaaatgtcaggttgtttattcccaaagaaatttcagaaatggattgccaatatactgaaatggagtaaaatatgcaatattcaccaacaactgagctagaaggacatattttttatccagataaagaacatcatcgcatttgagatcactgggaaacataaaaagtgatcaaaatccacatgcaaaggtttgaaacagattgcaaagtactccttcatgtcagacagataatgtaaatgtaatataggaccagtaactgtaatcacgggaactcccaagtatataacatgaatctttcgaatcgcagcatggtttcctcgtcagcaattaatcgactgtgcaacacatactccaaaagagcaagacagttcccagttcctatttgaaagaacccattcaaatcaacccatctaggacttgttagtttgtcataattcaaatcaacatgagtcgttcgtcgtagcaatcatgaatcgtgagatgaacaatttgatcaatcgttcgtaacccataaatttcaccaggagaaattaacttaaaaaaaaaaaagaacagacatgttcttgtccctcccatttccaagaaccgcggattcttgtggcaatgcgcggccaaccgatcgaccgatcgatcaaaacccaaagaaatcaaaaaggaagaggcgggcatgggcgggcgtgtaccgacgaggtaggcgagcttcatgatgagcttaggcttgaggatggggatgacggactccctctccagccgtatcacctccttcaccaccccgtccttcttctccctcctcatcctctccgcctccgcctccgccgccgcttgctccatcgatcgatcgccgcccggagcaacgtatataccctacacctatccgaccctgatctcgcagccgcagccgtggaatcggggcaagggatggcgtcgcgccgcgggaagaagacgatgccgccgcgagagagattagagaggtaattaattaagaattaattactttattagtgattgattaattaggagttgggaagaaaagaaggaaagataccaaaagtagtaaacacgtgagggtgtgtgcacggggcaaaagcttccggaatcgagggcctgttcacttcgatgccaaaaaaaaccttaccaaattttggcattaccaaaattttggcaattttggcaactagccgaaattttggcaggatttcttatatagttaccaaaatttggcatgaaactaaatgtagtcatttttttggtaactttaccaaaatttggtaaggttgaaatggcataaaagtgaacaggccctgatttggtccacggaaaaggctcatcatgggctggaccgggccgggccgaagtgaaagcccagtatggcccatggtatttcggcccatattcagccggaaaaaagttcactgactctgtcaaatatacgtgtaatctgattcgtatgtttcaacagtattagatatcttgatcctcaaactattaaaacggatgcaaaacgactgcctcggtagttcattaaatcttgcttcgatggagttcattgtagattgatatgcataatgctgtttttttttatatgaagtgaaactgaaagcattgcagaatttgcagttcgttctgagcaaaatctaactgtattcatgactactaattataaaatcttaggggaaaagagaaggatgatcttggcaatcgtttctcatttttcttatacctcaaaatacatggcactttgggcaaatgtagccatcaatctagaaaaaatatggtggattgataatactaaataggcagtttggcctcctttcaagtttgagtttgcatcttttggtatcacaaggttgtgcttttcatcgtaggatgatcaaacaggctttaatttgccgacgatgcggcacaatgagaagtcaatttgttgtcaataatataggggatggatatcttcacccctaaaaaagtgtagtttcttctctaagatacagaaacttgccatggatttcctagaagcatataacagcacgtttgaaaagaaggcaaaatttaaaactctttgatgcttttcccccactgcagtggatcgatcatctcgtatgtttctccatctagtagacactgttcaagtagaagaacaagccggccaatgcaagtatcccgacggcgataccgataggcaacgcttgcctgcaaattgatcaacaaagttttttgttaacttaattaaatcattcaccatgaatcaagggcttgtttggaatgcaggatatttgacgaatgtaggtgaaatgggactagtttctgtggagtttgtgcgttcaaatttgtctacctaaggaaaattgaaagcagctcaaatttaatttaacaacttgtaatctttcttctgtatctatgaaaatttctgattacccgacggcttcgtcctttttcagctgctccttcctagccttgcgggcatcggtggcgttggcgttcttggccaccttaggctcgtacggcttgaaccttctctttggtgctccacaaactgcatcagcaatgcagggacagaagaaattcagtaatgcagaccaaacctcataatgtgattgtcccgaaatcatgccagtatgccactcaatgatccaattaaattgtttactaaaattccctatatttttcttgtttgattccccttaattaaaacagggtaaatatgctgccagctgcaaactctgggtgggtctctctcttccgattatggaacacagactgatacagaatgtcagctggtaatttcagtttaagctgtacaaagcctcacctcacacatcgaaaaccaacatatattctagttaaaactgtttattttgggtgagaaatcatgtcttaaaatctgttctcttttgaatgaaaaaccttgtaaaatcgctgatttttgcacatgttgaattcaccaaaaaaattgcgagctgttcttaccggggcagaagtacttgtcgggaagcttgtcgaagggggtcctgtcgctgtagatgtacctgcaaacgagcacaaagtcgtcaccaaattttgcacagcatcaagcagaacaagacgagatcgagtcgttcgacgcggccgcggcgaggcagtggcagaggcagagcggctggctggctggctcacccgcagtcgcggcagatgtaggcctgcttggacgcgacgccgaagcgcatcgtgatcctcgccgacgccgtcgacgccctggcgccgcgccgcggcggcgccggcgccggcagcgacagcggcgtgcagaacgatgacgaccggagcggcgccgcggcggcggcgggcgcgcgcagcgcctgcagctgcagggcggccatcaccaccgctcaccgcagcacaagaaacaggcgcgtggcgagctcgagatccgaggagagaagaagagaaggtaggaaagcaatgtggggggactggaggaagaagaagcggtggaagagaggggaggataagagggagcgggagatgattggcgcgcgcgcctgcaacgcaagcgctcgctctccttttcttttctccctcgctttttcgcgcgcgtggcgtggcgtggcgtggcgtggagccgggagctccgagggggcgagtgtggattggagaaggtgcgtgcgtggcggccatggcgtcccttcgcgcgctatccctttccactggacgggagcgccacttgccgccaattgcaagggctcttctcctgtaccgtttgccagggacgaaaacggtaggaaatggttggaaatggtatcattattttattatttttttaaaacgatcggaaacggtcggaaaattttcatatttatgaattcatctatttagtgtcaatttcaatgccacgctgatagaaattaaaaaaactaaattttaaaaagggtaaccatcagtaaaaatattattattgtactacctctgtttttttaatagatgacgccgttgactttttctcacatgtttgaccattcgtcttattcaattttttttacaaatgtataagatataaatcacacttaaaatattgtgagtgataaaataactcataaaaaataaattataattacgtaaattttttaaataagacaaacggtcaaacatgtgagaaaaaatcaacggcgtcatctattaaaaaacggagggagtattagttttgcgaaaacagtatcggtacggtcgggaaatttccatgccgctttcacccctaccgtttgctaatcccttcgttttaaaacataacaaatacttgttggattaaacatatcttagtacttcgtattataaatctggataaattttgtagcaccgagatgtgtttgtgctcaattcattcacattattgctatatttcaggacggatgaagtaggagggaagaaagaattgtcatttgtctatgggggtttaatttgacgcctaaattaaccgtattaaattttggtgttacaatgttttgtgaggttaagatggatagagtacgtgtagtggatgccatttaggataatctttgcaccattaccttgctaaattttagtaaatgcaaagatttgctggggtatgtttttgacaacaaaggggacaagctagaacaacttgtactctacacatatttacgcttcactgatatggtattttgccacttcacaaaatatatttcgatggtttgtcatcttggccaactatgataatgcatttttaaagcccaacacctgttcaatcggacgtacacgtcggaccgaacttgtggctcaacaagcaaaaaccaagaccagtgcaaactttgtgagccagtgagctggttgaaccgattggtttttaacatgaactgggcattaatccgcaatggttagatccgttgggcatatgaaaatgtggatttttttattttacttttttattaaattatttaaaaataattttctatttcaacatttaaaaagtgcttcatccgtttcatattataagattttctagcgttgcctcattaacatctactccctccgtcctaaaatataacacccttagatttgtcctaaaatataacaacttcaccacctcttcccaaccaattacaactttccaccattcacttttctcacctaccttcgctactaatccaatcacaatcctcagcattcacttatatctactttcttaataaccgtgtccaactctaaaacttcaacggaggaagtatataaatgtagacaatgctagaaagtattgattcataaagaacactgctcgtattaggttgaccaacaatttaacgatggagtcaatgacaacgtttgacattacacaattacaggctatgcatgcatggccctaattaacaattaatgatcaataatctcaaaatgtaaatctgaacacgtacagaattaattaattaagtgattaaacacggagagcgacgacacacttaccctctaattaaattaaacatcatcgatcgatcaggcacatacacaatgatcaattttaattatctacttgcattttgtgattttactcctccaaccttctatctctcccatttcactggtcgctgccggtggcgggggcggcggcggcgccgtcgaccttgaggggctcccagtgcgggacggcgtcgctgaagaagcggccgacgacgcgctgctcgaggacggcgatggcgtcggggtgcttgatgcaccgcggcgtcttgtactggttcaccgacgagccgtgcgacacgcacatgtccatgagcgcgtcgaacgcccccggcgccacgacacggatctccagcggcccgatcgacctgtcccggctcctgcaccgccggtacaccgagtccagcccggcctccacggcggcgcagcacgccgccatgacgtgtgccaccttgtccttgtcctcgccgatgtcggctgcgtcgtcggcgtcgtcatggcatggcggcggcggtggcgagggagagggggtgagctcccagaagaggacgtagtggccggggatggaggaggtgtcggcgtaggcggtgtactccgcgaggacgcaggagagggggtcgaggaggggcttcgcagcggtgacggcgcggaggaggtcgtcctcggaggtcttgtcggtgtcgacgctgaggacgacgttgcgccggtgcacgaaccggaattgcggcgccgcgttgtgaaacccggccacctgcaggatgtcccccaccctgtaccggtacaaccctgcacacaattaattattaacccaattatttattattggattattaaaacgaattatttgggggaatgatatagtacggtattccgtttaaagggatgatattctagaagtatcgtctgatacctggcaggtatcgcttataccccatttgaacaggatgatacctcagaggcatcacctgatatctggtaggtatcagctgatccccaggtgatacctccgatgtatcatcatgtccgaacggggtatgttatatagcatttttcattatttgctccatcctttaaaaagtatgtttcctcagaaaaaaagagagtttctaatgcattgtttatactgcttgttctaaactattggttaagtttgtttatcaaaatatttaattcatccctagtaagtacaatccatgatggcgatccgctaaatattaaaattcaaaatgggcctcacattacaaactaagtacctatatgccttttttttttggaacacgtgattttttttggtaggtgattgttgtggcattttttaagtgattttttttatgtgaggagtgtgatagttgttagtaaaatgcttggaaaacaaaatatactaagtattccgacaatgtaagtaggggagtaagaagttgttgggccaaagaaaatgccagcacggccttttcagcccactgaggatacctgtcctttttggtgcagaggctctgtgtttttagcctgggccctctaaaagaacacctttctatctaaatttcttttaagtgacatactatcttttgggataatgaaactacataaacatttcaatccgtgaaatttactgagataaagaggcacataaattatactaactccgttcttttttgtttaacattggttactgcaaatttgcattaaccaacgtcaaacattgagagatgtaggtagtactttgacaagaagtcagtttcagtgttgcttaattaagttctggcaaaaaaaaaaattctcccactgaagtaataactatattttattcttattactcaaaataaaataaatatgcttcaagataattagcaactatttaatctacctagccttttttttgcggaggactttataaattttaatactgaattaaattgctgaaatattttggtacacatcactggccatgcatatgctacaataattggcactttgactttgtgccaggtcacacacttgtgtagggcttttccacgtgcaattgctatctatttgattcagtattgcattaaacaacttttatttaggagcatagtttatgtatggcggatccatcagatgatgtgcacagtccattttttttatggaaatgcaaatttataataaatttattcagctggtagtgcagggttgagagaggaaggtcaaagaaatcggatattgttttaatatgtcacatctcgatcaacttttttttgtgtcatctatcattgattcttccatgcataatatatcattgttttcagatgatgcacatatatcattttgatttgggtggaattaatgaatccttgagtaaatttaatcaagctaggagataatgcagtggaagtcaagcactctacgcactgcattaatcaaatgaggtatatgtcatatatcaaccatgcagcttctctagtgatctgtacaactgaactttctcaatgaaaagctagacgtatcattttttatcttttctttagctaataccatttttcgtgtagtagtagatagcatcatacatatataatgtttatgttgtcaaatatttttttaattttcctgcaactatttttgttttacccctcttaataattaagtatgcaatgaactatatattgtgactacatcctttcttgtgataactactggttcgtaattagatagtatgttaattatcaagatatttttcaaatattctagtgatatatataatttccatcacccaatatataaattatatacatattacacagagggagcaagtagttgataccaacgtctccatgtcgggttaaagtaagtataattaagtgcagacatgaaaggctataggcaagctaggagataatgcagtgggagtcaagcactctacacactataccccgttggcctagtagggaatcccaagctataacttaattatttggtcaaactctgaaaaaaatctactcaaataatcaagttaccaatattttaatcttgccacatctcatcacaagaaacataagcaactaaacaagtgtgctctttacttattccttcaatataaaagaaatggaaagtacagtaagctaataaaaatctattttatgttaacacccatgcattgccttggattaattagattaatttgaaaaatggtacctaagaaaataattctctgactccccaaccaatcgacttgcagttagcttatagcttatactacttgctagtaactcttatttctcgatgaaattaaattaaaccttcttttagatattaagtagctagcctcaagggaaaagatgtgtgatgttacttctgttgtaaactaaaaatcgagcttgtgtactgtggcttagggaagcagaattcattagtgtgtgactgtatccaccattagaggaacaacagggagaccacaaaaaccaaaacaaaaatctaaacaagttaaaagatagaacaggtgactcataaccttttcgtctaaaggacacctgcacttatctttcgaatagaccacaatgcatgccaggaatggtatcacatcgcaaaaaagtttcattttattgttttggtacgtgccaccgcaaaaaacacggagctgaaaaataccatcattttagcatcgacttgtagaacaggtcctacatgtcattctcatgtacgatgtcattttgcaattcgcgtatcttagtaaaggtggaacttacatgatgattttttttctcaaggtgcatgattattatcttcattatggaacattagaaaaacgttttcactaattcatttcttcttttctgggaaagggacttcacccctcctatttcgaggagatataaataagatttgcccaatttggatcgctaatcctctcctataggggcacttcatcttagctatgattttctgaataatggttcctacatgctgtgtgtattgttgctacagtttccgtgccgtctttgcgacagttaattagttgatcaataattaagtaactgtgctacatgttaatatttttatgttttattcactttaaacttaaaattacccacccgaaaatggtaaaagaaaattcgaggaacagtacttggaaaaataatattacctctgtttttacgcatgacgctgttagacttttccatagcgtttgacttcgtttattaaaaaaataatataaataaatatttaaaaatatatcttaatattatggttcctttgttgaaacaagtcacaacaaaataaataacattttatatacttttttaaataagttaaatggttaaatgttggcgtcataccatggaggtagtattaacgtgagacgggctcaaccaatctcagccgttgattttgcgatcggacggcgttgataaacccatgcaggaggtgggaaagaaatcgaacgggctgcacacgcgctcacctgtgaaggtggtgacgacgagctcgtagtaggcgccgacctcgacgccgacgaggtccaccacctcgccgtcgcggaccttctcgccgtcgccgtccttctccaccttgatgaactcgtagtagcacatgttgggcagcagcgtgtacaccacctcctccggcgggtccagcggccggaggttgatgccgaagtaggactccgacgacgcgtacatcgtcgacaccagcggcagcccgccgccgtagaactccagcagcgggatgtactgcgccatggaccccgtcacgatcacgtcgatgtacttggtccgcggccacagccgccgcacgatgccccgccacgacgcgccgccacactcggcggcgatggcgtcggcgaggtcggggtcggcgcgggcggcgaggacggcgtcgacggcgccgcggcaggcggcgtcggtgacgacggccgggtcggcgcggccggcgcggatgtcggcgcagagggcgcgccagtggccctcgaggaacttgacggcgcggaggaaggcggaggcgaagacggcgccgacgcggagcacctcgccgcggcgggcgaggccgcagagcagctgcgcgtacatgctctggcggctgtccgggcagaggatcgccgcgtcggggctcgtgtaccgcgtgtacgggctgtccggccgccgccggaagtggcggctcttgtagtagctcgtcagcaccggcctcgccaccatccccgacgccgtcgtgatctccggcttcacgaacagcaggtacatccccctcccctcgtccagcccctccacgtacctgcacctccatgtcagcatccatggcgatcgatggcgaagccagcgagagagactcacttgttcatgacggggacgaggaggttgtagaggaaggtcttgcggtcgagctcctcctccgtcgccggcatcagctcggctgcccgcctgacgtgccggagctgcggcgcacatcgccatgatcgaccgagtgattgtgtcaaattgtgaggttagccatggcgagatcgagatcgatcgagcttgagcttacctcgtgaggagctcggtgatgggcttggaggagatgagcgacgacggggcgccgttggcgatgcgctcgatgtacggcttcacgtcctcgtactccaccaccggcacgcgctccttgaacgccgcggcgagctcgtcctcgccgccggcggcggcgacgacctcgtcgccgagaaaccggcggaggtagtcggtgccggtgttcatggcgaggacctcggcgaggacgcgccgctggacggcggcggcgcgcgtggtcagcacctcgatgagctccaggcacgccggcccgtcgtgcgggtcgcacgccgggatcatcggtggcagcgccgccgccgtcgccgtcgccggcgccggcgaagaggcgtcgtggtcgtggtcgtggtcgggcgcattttcagacgacgtggacgtcattgttagatgatccatgcatgcatgcactctggcctagttctcagcttattcagctttggtgtgtgtgtgtgtgtgttcttgtatgtgtgcaagctactgtttttgcagaggtgagctccttcttggtctctatgtgttatatacatctcatcataagcatgtggaaacttttttagtcggacaaagagagaaactttttagacaggggtgaggatcctctatcataatatcactaccattatagtcattggtatggtatgtgagtccaactctactattgtctcacacgtcagtgtctgtaatggtagattatggtagaggacgtgaaccctttagatagagaaatggagaaaaaaatttagggagagaaagaaagatttttttttgaggaaagagataaatgctttttatggagagaaagcttaagagagaatttgtttagaggaagacaaaaggagaaacttctttttagatatagagagaattttttttagggagagagaggggggagatgtggtgtggacttataggagtgtgaaatttttttgtgtgtggtgcaacaaaattatgggaaagagagcacaaggtagtgtgtgcatgttatatttgagagaagggcctacacacatgtgaccatgtcttggaccttgtgattagatgcagctattatgggtcaaagttcatattggttgcctgcatgcctctccttaattttagtgtctctttatgtttctgtcattctgtgatgactgtttctttttgatctcttggcaaatagagccaaagttcagttcttaccagatgactcacctgactttcttctgaattttgacagtccaaaggttattagcttagtcattgtaaactacagcagaaatgttcagactctgaactccagtatttagcatatatacatgcaaagggtagaagaaaatgaacttttttgagtttgacgaaaagctaggtcaacttgtcacttgggaaatggtttgcatttaaaagtgcatatgcatctgaagttctgaacttgctcttcttctacttcttcagccggcaatctgacaggctgcaggttctaccatataaaaaagaaaaggggagaaattaagaagatttcttttgatgccctttcaggtgtaaataaaatactggatatatatgagtccatttgattccttgaccaatctgaggcaggccgaaactgttgtaaaatatgggcaatattatttttctgctggatagccatgtcacctagaatgtactgttgatgctatttcagatttgtttatgtggtgccaaatattgtagacttcttttattcagtatttttttttctgttcctgctttttttaaattagtgatctgatgctcaatcaagtgcatacaagattggctttgacacaacagtctgaacttttgacagaaatattagcagacaaaaattaatctcatgccagtacaattttccagtgaccagctgttctccggaggttactttaatatctcgaatacgtctcttgttgctgatgcttttatgggtgcttatcaagggagcatttttagtggaatgttaagctgacttgttgggacaccttaatttcagtcaagagtataatgacacacacatgggaaaatctcttgatcccaagctgtctctcttttgctgctgcagctgcttctgcttctgaatccaatcatgcctgctgccaagaagtgcctacaaattcgacttgttttttataaaaaataagaacacaaaactgtcagtaggcgtaattgaattattcaggctcccctgcactgttgcatcacttgacaaccttgattggttttttaatcagccaatcttttaaatcagatgtgagatgatttagccagtcagtagaaagaagtaaaataagcttgggagagatcacaaggtcaggtctgcaccagctagctgtccagcttttggtctcttgctgccattagtataagatatgtcatagttgattgatttaattttgtcatgttgctctcatcaaattgacacacaatatgtgtcttattgcgtctctgttatttgttactacctcctcccaaaagtaatttatttttaacctattttgcgtataccaatataaaacaaaaatactaaaatatttttaacttgagtaaacttcaatgcacttgtccattacaaactacaaagcattgattgctctaaagatgaggttttcgtgagacaaataaaattaaggaaaaataaagttattttgggacggagagagtactgaactagcatttctctactagcttcaattatagcccctttcgataatggaaattaatccagctctccaattatggctaggtattctgttctcatagaccatagactgcaaagactgaacttctgcaacttgtacaaagtaagtgccagcttacttcagcaaactttctgctacttgtgtattctgcaacttgttgtttgaaagaacctagttattctgatcataatgcatcagtccttgtattaacaaataatttctatataaactaattaggaccatgttacagcgctgtgagctagctgcatctcagttgcagaacatgacagtgtgactgactatatatgccttgcattggaaagagagaaaactgatggagtcaatcaacacctaatagggtcagtaaataattgggcttgtctgcaaagaacaaatgctataaaaagaaactgttgttttattgtttgctagcaaaattcacacagtgttgggagaggataagcctgttgtttagtgaatatatcaattgaatggggatctgctagattcggttcttaaatttaagtaacagggaaaaatatgcaagatgcaggtgacaacagcttaattgtgcagggggcagaagacccttgaaaagggcaggaaaagaggaggaaaacaaggaagatcatgtcacttctggcacaagctggtttatatactaaaagccaaaagccattgcatactactcttctttcacactcacgctctgtaattctgcattatccaaaatgaaatgcagggatctgagatagacactaaaaggaaaataatataattaagtttaacaacgaggaacatgaatctcattgagaagagctgagttggtgagcaatgacacaaaaaaaatgacttagtcaacggtgtgaaaaaacaagtttggaggagtgccttgtctccactttgattcttttatcaaataaaggtggtgtttggatccttggacttaactttagtcttaatttagagtattaaatatagactacttacaaaaataattacataaatgaaagttaatttgtgagacaaattttttaagcctaattaatccataattagataatgtttactgtagcatcacataggcttaatcatggataaattaggctcaatagattcatctcgtgaattatccaagattataggtgggttttattaattgtctatgtttaatatttataattagtgtccaaatattcgatgtgatagggacttaaaagttttagtcccatctaaacagggtcaaaggtcagtgatgtttttttcacccatgtagataggatacaaataggcatcttggggaaataaagtttcaggaaagaagacagtgatttgattctgttcactttagattttcaatcaacccataactgccaaggtacaaattaacagatgcaactaaataatttgatcattatgttctacactaaataacagacaagcatattgaaattcaatcctaaagatccatcttcgtcataacaatatgcagttcctaacccaaaacaacataataatgttggaatgaacacaatttgccccactgtggagggaaatatgcattattcgagtgatgatcgattcatgtctcttagcaactacagtagttaattagaaaagttgaaatttggtaaactaattccttcgattttggtttaccaatggccttttaaaccaatatttcgtaaaacgatggcactcatcacttaacaaatgatcatctttttttgttgtggatctgctctacaatatataaattttgtatctttagcatttgaagttacctcaccaaacacaaaattacatagtaagcactacatcatcatttgccccgtcaacgacgactcgagtggatcaaatattaggcaaattaaataaaaaaaaatggtcgtttcggtgacccatagagctgctttgtgtcatgtcatctctccaatttatatacatatgttcaattagaataggaactctcaggaaaccacttggtactttcttgactagtgataacaatgttaacatcctccaaagatgcatagatagaccaaaggaccaccactagcactttttctagtttgaagagataatattatgtcaaagtacaagctcaaaatcttgtcctgaggaccacaaggcattagtgagatctcactattctcatgcttcccattaggatgcaattgtatgggtattaaccatactcaaagcttgatgaactaatgaaatgctagcaaagtacaactgactttttagttggaaaacttatcttgcacattatatgtatgttgtattacttttcaataactagctagtagctagggtcgctatagactgctaactgtaagatgttttatttcattaatccaacaggccaaataatatcattcctaataacatcatgatttcgaattttcaatatggtttacttgcttatgtagttatgtgcaacaaaaatccctattggaggattaattttcaaactaacgtactatgaagaaaacccattttccttgttattaacacgctccaaaattccaaaactaattagttttcaaaaattctgtgaaagccaacgaagcacagggacatatggctggttattacctagtctggtcctggtacacttcacacaacaacacagtcacactctagtcagtagttcagtattttttttcccctgaaacaagtgttgtctctgaatctaatcattttgacaggatgggcgcggcgaccgaagtgcagcagatccaagaaatgagtggtcctaagacaaaagaggagggggatagaaaaatatgaacaaggcacaacttgtgctttgtgaaaccttgcaagatcaccatgggagacaggccacatgaactcaagtgctgctctcaactgatggaataagccatcacatggcgcaatgccgataaactaaccatccctttgcatttctccaagcaagaaatggtcactattctagctcctgaaaccctcccttcaaggggctccacatgagctatgcacatggattattctttggtcagccatcactctttgcacagctagcatgatatatatgttattgcagctagctcacataactgtcttgcgctcaccgaccaaatcttcagttattgtgcttgatcagatgcagcatctgggataaatttagctgtgatctagccatctagaaaagaaaccatttcagatgcatgctttgattccaactgcctcatttttgaagctcctgatgattcccttctgaattgtctttctcctgcaactgcagattggcacatatgttcaggtgggtgagcaaaggccaggaggaatcctttgacccgaaagctttgtgtccagtgtgttgtgcctgtttggagctgaaaagtgtgcacaaataattatgcaggttatctgaaagtaactaattcaacacaagtatatataacaataaccagtttaattcctactgaaacagactggaatttttactggactatgccttgcggtaacacggtatcagaaaaaaaaagtatgttatcaaatatagacaatttccctctagatctgtctcgcatatgaagtagtttctgcaatacaagagcgtagatactcgggtaattgtttctttgtttattgagtcatattttgtgttttattttcaatattggaagatcatgtctttgtacactctagtaagtaatccactaataaatacatatatatgcaaatggtgacttggtgcaattgaatcctaaccactcagctcaggtggttgttagttgatactgttcttacatgcttgtctgtctgaaaaccatccaacaaaggcctataatctacttaattaaaaaaataaaggataaaacaaaaatggttaccccttttaaatacaggaataggaaaaccacaagaattaaatacataaacgcatattgaattcctataggaattaaaaatacagaaagttccaaaactaccgtttggttgacacatagaagaaacacatgaattaagatcagtcaaaggaagaagaaaacatgaggcacaaactataattattttcctccaaaatttttataggattatccgttccatatgaatttccatgattcaattctttgtttcaaaggttttcttaggaattttcctatagaatcgaaatccttcaaattcatatgtttttcctgcaatttatgttagaagctcacatcaggatttgccattcattcctctatcatttttaggatgacaaataattgccatattttaacctataaatcatagactaaacgaagggtagtagggaagtggcccttcatagggagatggagtcataagcattgatacacatattttcttgtacttgaaagaaaaattataagtttacggatttatttcaatctccattaatctgattggttagttaatttcaagatgttgtttcatcattaattttcaatgaatttcaatatattttgaatgaaattcaacaaatttcaaacaaaaccactcaagatgcacatgttgagccagctcgagatgttcaaaattcgtaaaatttgttagagattcgtcatgattgtgaaccctgagtgcaactgtgcctcctccttggaataaaaagtgcatgggaatacatactctaggaatgtggaacaaagccatggatgacgtatctgcaatcttgggctaaactttgggataggcagcgatggagccagtggtgtcgcgaagcctagacgactaatagtactttcagatagttgaccaattttttgggatgtcaacagctgtcaacagtggagacatcaatggcggagcctaggtggccacccgacctgcccggcagctagcttattagttatggcatatctcaaattttacaaaattataatggcatggttacaattttccctatcagttatggctattttagtgtcgtttttgctgtggataactggatatggcaccatatttttgctgtgatctcaggtcaattttctgactcgacaaactaaatgctctacacaaaattctataccatatttttgctgtgatctcaggtcaattttctgacccgataagattggatcgagacatcctggttggaaagggagattcttcacctcggcagggtgacaaactttggtctcttctgttctcagtgccatgccaactcatcaccttacagccatccaagctccaaaatgggtaattaaaagaatctatcgttttcgaagatctttcctttggaagggtgaggaccct

SEQ ID NO: 46419 - DNA, 1166 bp, Oryza sativa
gtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagag

SEQ ID NO: 46420 - DNA, 1492 bp, Oryza sativa
tttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaa

SEQ ID NO: 46421 - DNA, 9948 bp, Oryza sativa
  unsure (1)..(9948): unsure at all n locations
attactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcannnnnnnnnnnnnnnnnnnnnnnnnnnnnnnnnnnnnnnnnnnnaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaacccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagact

SEQ ID NO: 46422 - DNA, 1937 bp, Oryza sativa
agcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccttgaaaagcattggcgcacgtgtaaacgagttgctctaccgaactgagctatagcccttgtcagagatatcttaatatatagagaatttcttgtaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattag

SEQ ID NO: 46423 - DNA, 7939 bp, Oryza sativa
caatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtctttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattag

SEQ ID NO: 46424 - DNA, 1999 bp, Oryza sativa
ttaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattgggg

SEQ ID NO: 46425 - DNA, 4601 bp, Oryza sativa
tgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttat

SEQ ID NO: 46426 - DNA, 987 bp, Oryza sativa
tgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagtctccccatctgggagacttcttacttcaattagtccccggttcttcgaatggatctcttaattgttgagagggttgcccaaacgcggtatataaggcatacccagtaaagcttacaagtaaaccagatatggagatggcgactaaagttgctgtttccatttttatagaatttcaagat

SEQ ID NO: 46427 - DNA, 13394 bp, Oryza sativa
  unsure (1)..(13394): unsure at all n locations
acatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaatggttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46428 - DNA, 4911 bp, Oryza sativa
agtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttc

SEQ ID NO: 46429 - DNA, 1284 bp, Oryza sativa
cgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgg

SEQ ID NO: 46430 - DNA, 1609 bp, Oryza sativa
gtgcggctggatcacctccttttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggggatatagctcagttggtagagctccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtca

SEQ ID NO: 46431 - DNA, 2163 bp, Oryza sativa
agaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaatacccaatatcttgcttcagcaagatattgggtatttctagctttcctttcttcaaaaatgctatatgttagcagaaaagccttatccattaagagatggaacttcaagagcagctaggtctagagggaagttgtgagcattacgttcgtgcattacttccataccaagattagcacggttgatgatatcagcccaagtattaataacgcgaccttggctatcaactacagattggttgaaattgaatccgtttagattgaaagccatagtactaatacctaaagcagtgaaccaaatccctactacaggccaagcagccaagaagaagtgtaaagaacgagagttgttaaaactagcatattggaagattaatcggccaaaataaccatgagcggccacaatattataagtttcttcctcttgaccaaatctgtaaccctcattagcagattcgttttcagtggtttccctgatcaaactagaggttaccaaggaaccatgcatagcactgaatagggaaccgccgaatacaccagctacacctaacatgtgaaatggatgcataaggatgttatgctctgcctggaatacaatcataaagttgaaagtaccagatattcctaaaggcataccatcagagaacttccttgaccaatagggtaaatcaagaaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccaccattgtataaccactcatcaacagatgcagcttcccaaattgggtaaaagtgcaatccgatcgccgcagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcaactctctaaaattgcagtcatggtaagatcttggtttattcaaattgcaaggactcccaagcacacgtattaactagaaagataatagaaggcttgttatttaacagtataatatagactatataccaatgtcaaccaagccagccccgacagttgtatatccatacaacaaaatttaccaaaccaaaaaattttgtaaatgaagtgagtgaaaaatcaaaactcagattgctcctttctagtttccatatgggttgcccgggactcgaacccggaactagtcggatggagtagataattattccttgttacaatagagaaaaaacctctcccaaatcgtgcttgcatttttcattgcacacgactttccctatgtagaaataggctatttctattccg

SEQ ID NO: 46432 - DNA, 29999 bp, Oryza sativa
  unsure (1)..(29999): unsure at all n locations
gttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaaatctgggacggaaggatnnnnnnnnnnnnnnnnnnnnnnnnnntcgaacctccgagtaacgggaccaaaacccgctgccttaccacttggccacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttctgaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactataccggttttcaagaccggacctatcaaccactcatccatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaagttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagannnnnntacatatagttttttctaccacactttagagtctttctattatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttggttgtgtaggtggggacctggtattttcggaatccttatgtgaggaattacaaaagaaattttttcaacaaaaatgtgaattaggaaggattggtcacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcttgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagaagagaaaacgagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggtcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttt

SEQ ID NO: 46433 - DNA, 716 bp, Oryza sativa
ttcctgcaccaatgatgagagttgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcaaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagcccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcatgaaatattagtgagtcattagttatcccgaatgtgtgctaatgtttctaagcagggctaagcaattatatctaatatctagttgaaccaatataaataaagctcaactagtcaaattgtaataacccaaggtatcaaggaataaggtaatcaagtacaaaagggccataac

SEQ ID NO: 46434 - DNA, 3300 bp, Oryza sativa
  unsure (1)..(3300): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagaaccaacttggtaattgattgaatcagattatctttaacaaacacatcacacataagcgatgtattctaacgacttgatttgcaggtaggttggtgggtggggtacgctaaggataccgatgattcgatcgggagaatcgtacggataagccccggtgttgggagatatgtggctaagagcttcagcccaaggtgcgtttatgtctctttgcaacctatgctaaaaccaagtaacttttgtctaggtgatccataattaagtgcatctttcctgtaggcaattggttactgcatcgtcaggaactccattatttgaaattttccttgtcagagatgacgatgagacatatacaatgaaggtgcactgatgaaactgatattagtagtttgtattatagtcttcacgcagttcacaaaaaaaacaagaactctgttatgtctagttgtgatatttgtatttacgaaatttttagacaggttgtacacatgcgaccaacaaaaggcacttcaagtgcatcatccgtatcatcagcaactgcagaaagtccagctaaggaagagaatgaaagctcattggaaagtagtgctatatctgagggcattaccgatgaagcgaatacagatactacattaaagggagatgaagatgttgaggataaagaacaagatgttggtaacgccaaggatagtagtgttgaagggttgaaaagcgttctgaatttcttcaagtctcggattcctgaattcaaagttcaagtaataaatgtagatgtgtctgaggaagctgaattagcttcagattcgtcagaagaattagtgcaagatgatgtgaagagcacgtcagagaactcattggaagattctaccactgaggagcttcagcaggatgatgttccagatggagattcagactcagctgaagatagtaaaagtccagaaatgaagctcttcattagtggagtggttcataacaaggaggatgctggagcaaaatcatatgttcgagttccagctgaaatcaataatttggaaaaggattccttcgaactttacattcctggaaaaggttctgatcgagatctggctgatacaaaggctgcaaaacagaaagttgctgatatggctgccaaattggcatcagaacttatgccttctgatgttgcgaaggcattatggggaacgaccaagagttcttcgaaggtgagcataacacttggtttagctatatataagtctggagtttagagcatttagtgaggtatgctttggtttattgaagtcttcacaattagttgaatagtatcatgtctttcacaaagtaacatattagtatatgagcattgagaaatagtttgacccattctatctatcaagtctattcttgtttcatccacttgtagtggtaattgtcaactctccattgtccctactccctagtattctaggctgtatttctttcatgcaatcaagttaactgtgaaatgatggattcactgcagataaataaagaagtacaagagctcttaaagcttaccctcagcaaggctcgagtcaagctgactgagaatacaattttcaataggatcattactgacagtaacggctcagatccatttagtggtaatgtcttgtcagttaaacggacgccttgatattttctctgctttgactgatggattcttggtgtacatgtaggtctctatgtgggagcatttagtccatatggaccagaagttgtgcagctccgtcgaaagttcggccattggaacagcacagatgaagtggagtttttcgagtatgttgaagcagtaaagttgactggtgatctgagtgtccctgctggacaggtttgcaggcattttgtatatttcaacgaacaagctggtcatctttctaatgaataatgttcaatacagataacattccgtgctaagattgggaagggcaaacgtcttgagaaccgtggtgcataccctgaagaatttggtgtggtaatttctatttatacttctgtttatttaattgttgtttcgaattgttagactagactgtaatggcatgcagtctgcgatgattcaaagtgtatttgtttaagcaaattaacagcttcttctgggccgtgtgtaacatatatcattttccaattaacttttcgattttgcagattgctagctataaaggtcaagggagaattgcacagcctggcttcaaaaatccccggtgggtggatggtgagctattggtgctcaatggcaaggtaaaataattttctgcagttgcaatggccctgaaatatattaaaaaattatgaccataacattgcttaacaaggttttctttaaccctatttcatgtcttgagtgaaagaatggctcacagctgaacatgtcgtttattgttgtcaacactgaaatacctttttttttttctaaactttggaagttttaggatatgaaattataccaccatggcaaatttgatgcttgtggagtgaaagaaagttttgatttctgctgcatcttttgtgctatgaactttcttcaattttgttttgggtcttgatctggagttctggaatgactgacactggaggaaatttaacacgaagttacaagaaaagcgttccttttaaaaatattagagcgtctgttgttagcctaacgtcgattgtcttatcaggtcattagtggagaaaatggttcttgtcaccagatcgaagcttagggtgacacttctatgagtgacttccacagttgaaaaaagttagtggtccaggtaccgaggtttgtatacggtacctgagaagtccaacattataggtcattttcatttgcaaattataaactgggcagaaggtatttgcataacaaaatctctagaacttatcaatgcaatttacattattttactcacctacccaatcctgcccagaacaatgatttcgttgaagtactttttacaagatcatccttgataattggtgttaaattcatttgcagagcacgatcccacaccttggaggtgcggagcttggtttcctgtacagcgtgcctgagcagagtttcttggtactctttgaccggcttaaacttccagagtgatgagattatgctgaatcgagctgttctcacatgcaaattgcatgagtacagagagaagctgacacagtttcaagagaaacgtatagatgtcccgtcatcttcct

SEQ ID NO: 46435 - DNA, 49879 bp, Oryza sativa
  unsure (1)..(49879): unsure at all n locations
ccaaacagcgacacagatcacggaacaaagcaatagttgtcacggtattcatctctttcgtcttctctttttatcagtatcaccgattcatcggtacagtgtttccagttctcaacatctcaggcacacgcgacaaaaaagatgaattttagtatttgcaatcaatactactccaaaacacaacgaaaaattgtttaacaaaatacaaagaaagataaaaattcacgggacaccttatcttcagctgtggtcccaaaacactccgtttaactgttacaacccgttagattagaaaatcaacaaatgtgaaaatgacagctcctaaagcacaactaagctccactatgtcagggttcttctgttagaccaataatgtcaggaacacaattcagcgccttctcggatgaagaagctgcaggatcatactagaattcaaatcagaccacaatagctccttgctgctgatcagatgcaagtgctactctatttggatctgatttaccctgctataccaaattgaatgtaatatcatgtggaagatgtcatacttgatgggatttggatgccaaataaagtgcttctgcacccgttgaacattcgactgcatagccatgtattgatcatcaggaattgccaataagatctgcttcagtttgggtacatccttttccggtatgaccacagagaacgcactccaattaagtgcatcatcaaatggaagcacaaaattgtccgcaattatcaccggaacacactcataatagattgcctcaactattcttgggctgtttacctcgtatcccatgggacaaatacagtatttacttgatttcatatgctgaatataattcatcctcctagtgattctgtgtggcaaacggtcatatattctcatgtctgcatcctttcctccccaatactggaggaggacaggtcgaactcgtccatgcatctgtcctgcaaagaaggctaggatagatctctctgcagcaggttttccaccaatgcctcttaagggtcttcttggtgatctaagaaatgtttcaggaagggacacatctcttccatgaatgaaaactccttctgagagatctgcattacatagagctttaatggtgttttttctcaattcatcatgcaatttggtagtgtatggtccctgcaaggaagggccagaatcagaaacagcatgttagcttctttcttgattaagtttcagcctccattcaaatttgtatgcactaatattcttgttcaatatgaccattcaacaacgagaagtactcaaaggaagaatacatacccagtcatgacaagcgacaaaaaaatgatcagctccttttgtcctattccaataggggaacttggtggagataaaatctatgtatttctttacaaagatagacaatggctcaattgtatttgacccaggcacataaagattgtgctctagctgacgagagctatacggtagatagaataggtgagctctgtttggatctctcacaacaaaatgttggttcccttccatcagtttcataaaccacccctcagatgcataaatgcctttcaactctggtgaatggaaaataggttttgctccatcatggtatacaaaaactttaagaagtctttccatcagttcatagctcctggaagcatgagaaaaaaaaatttaaatagtcatcttctgaaatgcagaagccattgaacaatggaacaaacaagcaatggcatgataatttataaacatgaaggaaatttaagctatcattacagtttcctctattaacattttcaatcacacgctaccaaaatagaatgtgagaggaaaaaattacacttatttaaggcaaactagtgagcgccacatgtactgaaactactacgaataactaggtgtgggaaaagtaacatgccaaccatgggaatttgtcagaaagcggatgtatgcaacactaaaacattgcttatcttcatgataaaaaaaaaagcaacaaaaaagttgtttccctccctaaaaagtttgttcaacatatagttgggcatgcaagtccataatcccctgataagaataatgctactcacaaattgttagctaaataatatatatgaagttaaaccatagtcatacctcctaaagacagacacattgcggaacagtggtgcatgcagatcagggtcattggacaccagcggtgcaatagtgatctctttctttgcatagattagctcttcatcagctgctgttgaccaaagaggtataggcacctgctaagtttacaggccaagaaaaagatatttaacatttttttactccaaatacaaagagctcacatcacattgtaaaggtgcgtaaagcatcaacctctggtcttggaggaagcattgcatggtccttcatgtcatgtcccttattatagatatcagacctccttataggagaaccactggaaatgggcttcacaagtaaggaggttaaaaaccagaaattatattagttacaagtctatgtattcggcgcagatatgtacctcttggagaaaaggagctgattccgccggtggattttcctgaagttaagtaaaactttgattagatgctattagattagatatatggatatccatcgatcttgcatgatatagtgatgtaggacaagatgaaaacatttgtaatatgctactgtacctaagagaaatatagaatggaattgtatgtatgaaaaagagggattggtggggcaggtgaggtgagtacctttaaatctggagggtcagtttcctccatagaaccatcatctaagttttctgctggagaaggtgaagggaccaaaaacatggaggggactgttgtaaacccagatggcaaattagtctgcaaaacaaagcaaattccgccatttgatgcactctgatatccaataatcttgacatgttacaataacccaatgtattcgcaaaatcacgcacatttactatttacaaagaaagaaatgatgattcatgaagaaggagagccttggaaagcagaaatctttaggacagaaaaggagaggagacctggagctggaggatggaagtggaaggaagcggcggttgggaggcggccgcggagtcgggctggttgcttgtgttgttgtggaggagggaggcgaggagatacgggtgggtggggtcctcggtgggaggggtggccagcaaaaagagcgccgccgcggccgtgagtgcggcgacggcagcgcaggcggtgagcgcgcggcggcgagtgaggaggttgcacgggagaggcgaaggcatttcggagggcgacggccggccgccgcgccggagcccggaccagtacagacagagaagatcgaggacacagcggtggggagtcgaatttacgcctttgccctccggccccacacgccaatttcccatttgcatcaaacttttttccaagtacaggagggctcgtttggtttagtacatatcaaacattggtagtatactgacaaaatctaggcatgtttagcactaacaatattttagtaggatagaattctacgcattcggcagctagagattgggaggagatttgtctcgttttctacgtgcacacttcctgaactattaaacggtgtgtttttttttgcaaaaaatatatataggaaagttgctttaaaaatcatattaatccatttttaaaatttaaaatagttaatatttaattaatcatgcactaatggcttaactcgttttgcatatcttctcaatcttctcttttcctttcctctcaaacacaaactaagggtgtgtttagtttacggcaaaattgaaagttcggttgaaattggaacaatatgatggaaaagttggaagtttatgtgagtataaaagtttgatgtgatggaaaaaattgaaagtttgaagaaaaatttgggatctaaacacaatgtaagtaatgtatttggattgatattaattgggagccaaattttatattatggtgaggaaagttctagaaatataccaaattaaacatgggcattaccatccattctaaaccaaaacatcatatttactattcaaactactaaaaatttggcatcaatcaaagtggcccaaaattcactgctagtgctgatcttgtcaccaaaacgagtaaccaaagctggaggagtactataagtttcacacatctcatacaatagcttcttttgaaacgcaagaatttataagaatttcatcgtttttagttaaatcctctattagacttgagtttgtttgtacatgtttcaaacttatctctcgttttcaacccacatgctttttaaattactaaatagtatgtatttttttaaaaaatatatatatagaaaaattgcttgaaaaatcatattaagcatcttttaccttttttcactaatacgtaattaatcatgtactaacttgtcactctgttttccctcctaggatgtaaggttcccaatcctcactttacaacacagtttaagagtttgtcaaagacacaaaatgcttacttttttacatttatataatagatatagacgcacacaaacaactacacataaacactgcatccatacatgcaactgtgaatgcaccctctaaggcatgctcaaagagatggaaaccatcacatctctgaacacattaaatttctattgaaaactcactcatatggtgtatgtaatattcgtggtcatttgaatttaaacgagtaaaatcatacaccaacgattttaccatcacattgtcggtgctttcccagagaaactttaatttttgcctaccatcagagaaggatgtaaaaagtatttctttttttttaacactgatattatttccttcctccagtggagtatatgagtatatttgacgctgaaagtaatttgagaatatagcaatggtatattttacgcaatactcctatataagcgcttttttaaaaccttttttaaaaaattttgcaacctgtggttgtcacacgtactgtgacggtactgtctctatcagatcgatggtcttacatcctgattcgtacatacggagtggagtactaataaagacggacacgcagcagcataattagtcataattatactgagtaagtagtttaggtagtacgtgggagtaataattcgttattagtcggtggcgtcgaggcaccagcagtagtagtccgaggtggacagctggaggagctcctccggcgacatgcgctccagctcccgctgcctccacgccgggaacgcctccgccggcgttggcggcggcgcgtgcggccccacgccggcgtccctgcaggtgtgcggccgcgcgccacgcatccggcggtagaggcgcagcgcggcgacgcagtcgtcgtaggggtggtggtggcggccggcgatctggatgtggtagccgaggtaggcgagggtgaggtacttgagcgagttgctgaggcggctgttgctcgtcttcatcagcgccgggtacctcgccgtgtcccgcttcaggtactccgggtagtccatgcccagcgactcgaggtcgtggtccaggccgtggccgaccaggatccgggccctcccgcggctgctccgcgccttccacgccggctcgccgttgagcagcagctcctgcacccggcgcgccgcctgcttgggcgtcatggcgtcgcgcaggtgctcggggcggatgccggtggtgtcgtagcggtagtgcgtgacggggatgtgcggcttgacgaaggtgtccaacaccacgcgctcctgctcgtccaccacgcacacgcgggcgcacacgtccagggacccgtcgctgccggcgcccaccatcttgcaccccagggcgaggacgccgccgagcggtggcgcggccgcggggcaggagtgggcggcggcggtgggcgggaggactacgtggaggcagagggggcagccgcgggaggcgaaggcggcggcgcactccggcttggggagggcgccggtgaggtggtcgcggagggcgtcgagggagcggcagtgcttgccgcagacgccgcagcgagggtcgtgcgccgaatgcagcgacgtccgcatgtgctccaccaggtgctccttcttgttgaactccctatagcacgccgcgcacctcttcctcctattcatattttttatttaacttaatcaatttctttctttctttctttctttcttttcttcatatatatatatatatatataatcagaatgtagttagaacattggctaatacctctgagaatctgaagaattatccattctcgatctgaagactactgcaggagtgcaggtgagtggccactggtgtagttagttgttgtgctgattggtgattgctatctgcacttgtttccgatgcctatttatacgcaaatccaacggacagaatttgattcttgacagtgttgtcgatcgaatgtgatgtccctgctagatactccctccgtttttgacatatcctctactacgaatctggacaggctccgtatccagattcatagtatataatgtgtcacatttcttcaaaatggtttatattttcgaaccgatggagtagaaagcttcaccaatattctgctgcatgctttacacatcatcatcttctggttttgaggatattattcaggacatgctcatgcacaaaacagctttagaaccaacactgttaaagaatgttctgaatgcatccatcactatgctacatttcctttctttctgttagcatgcaaaaatatgaaaaatatctctgatgaatatcataatttgcctgcaaaatgctaaccaaccctgcagaacattccacttctcaaggatatactgccaatattaataaagctctagatagctaactgcaaactccatttccatttcgacccccttttctttatatgctgtctgtctgcaacgttgtgacagccattcgccttgcaaagataaataggatgctttgtaccccatatatagttcatttgcattgtgcaaaagcagtactagctcttttgctgaaactgcaattgctttctctcaacgagtgagaggctctcactgatggcatattgatcctcagtcctcacttacaactgaatttttcctctcttcaaaatcccttgtccataaacaaaatcaaagcagcaatccattgacgagtaatctcagtatgacatatataatctgcaagagagtaagaatcaagtaactgaaagtcaccttgttgctcagtgttcagatttatctgaagatagaatgccatgaaatgcaatggaatgaggagatttgtatcacatgtttttcttttctatcccttgattgtttcaggaaaaatcacgtgcagtgcttacatatgcatacatcattaatcatttatgtagaaaaaagagagaatacgggtagataccctagtcaaaaggaatggtttgaaaaagctaactattacgacgatgctgatggaaagattgaaggattcttatgctgtgacaaatcattgggtggatcttttcttcggtgacgatcaagctagccgtgccgtggtgtctgtactgtaagcatcttctgttgtttatgtgacttgatcgaggacattgatcgtgccttactcaatctcattcagttcatgaagtttagagctcttacattgtctaaaaaaaattaagattaatttgaagcttgcccggctagctcttgacaattgtcgaagttgattgagcacagtgaaatgaagtacacaggttaatttagcgcgcggtgaaaggtaggagatcgaagagattcagttcaagcttacgctatctttccatgctcaatgtgctagcttttcattgtgagaagcatatgcattggtgggtgttgttaatttagatgaggggataatgacctggctcggctcgttattagtagtatcatgactagccagctcggcttattaattaaccctaacgagctaaaagcgtggctcggcttagcttacgagttggcttgttaagctcgttagtaagttcaatcttatttatatcaactttaaaatttcaatatttaccaatttatcatatgttagtataatataagcaataactagtaaaatattcactaaatacaaatagttagtttgctagtaaattaaaggactaacactacaccatggtccacttttgctaacaaaagtcagttggaaaaaagactaaattttggaacaaattatgtgtaggcaaacatataaaagggctgcaacaccgactgctgaaaattctgttggcacaggctttgccgatactttcttagttgccaaacatgacttttgtctacacaatggacggacggtgaacgtgggtcattgtgtagtgtaagtactcacaacttaagaagcactaaatatgaaaatatatagtgacttttgtactaatgagtagctcgatcatgagctggctcgttaaattaacttactaaaaaatggtcgcgacacggttcattatgattacgagtttgagccaatcttagccataagcttttttcacccctaatttggatcaggtgcaaatgcaacagaagaacgggtagatgttccaaaggagaagtgcctgctgtgtctcaactctccactgccaaatactggcaatattaaagctatggctacctaactgcaaagttcatttccatttcacccctttcttctttttgttactgtttgaaaagttgtgacagccacccgctatctgaaactgcaagttctttctctgaacaaagctcttgtcctcactaataactagtgatcgagatctcagagaaaacatatcagggtagcaactgaaaatctgctagcttattgctcaggattcagatttcctcaagatacattgcgatgaaatgcaatacagcaatcatatgtttccgtatattttccagaggaaagcaccatatgtatacatcaatctctttatgtagatcaaaaggaattgtttgaaaaagcaaggtgatgctgatgtaaagattggaggattcagatgcaagtcccatccgaaaccgatgtgtcgtccgaaaagaagaaaagaaaaccacagatgaacatgagcctagctgtgagagcgtgtgacaaatcattggatggatctttttttggtttggaggcagcagctgaagaagaagcaccggatatgctgtgaacataccgtttaatcttgtgcttttcttctcattgggatattgttctgatggcctcatcatgtccaaaaagaaaaaaagaagcatcactgttcgatctcaatctcgatctcgatcacgatgcaaaggcaggccagccggttctccgcatatatatatttggctataggtagtggcagaccgttcatgtcgatggagggcagatgtgtatatgtggtgtgtagtggaatggaatagattcagaagagcaaaactaataaaattctgatatgatcgatatgacagcaacatggcatggcatgtactctggcctatattctcatctcgtcgattggaagcatccctgatcaaagatcgtttctgcatttgccatttctccttgttaaattcagttctcttactactaagtatcgtttcacaaaaaaaaaaaaaaggagaagaaaatctcttgttcagttcagtttggcgttcagatgatggagggatggacgatggtcatggtctcatgtatggttgcaggcaagggaattttttttaaaaataatattattttaatggaaaattgcaaaagtagaagctgatcggttaaaattacaagtttaatgccctgtcgaacatccatagttcgacaggggtacatatcgaacaaccacaattcgatagggtacctgtcgaattgcgattgttcgacagggtataaaaaataccctatcgaactgcccctgttcgacaggggataaaaaatgatagaaaaaaagaagatcaatcactatgagcactgtacaccactgtgcatgcagacctatcgaactttggatgttcgataggccccctgccatgctctttcttgtccttttctgtttttttaagtgaaccacaaccctgtcgaacaactgtagttcgacaggtacctgtcgaactgtggttgttcgacagggtatcaaacttgcaattttagctaatcagctactacttttgcaattttccattaaaataatattatttctaaaaaaaattccaggcaaggcagctcgatagatctgctcagacagagataggtacagttaatttgctactactaccattactctttttttttttagataatgtactactaccattactcttactcttgatcatgcaaggcatgggtgttaggagccatgtgggctgcaatatgggctgaatcagctactttccaagaagtccaagcaagcccaagagaccagatcattgtccaaagggcggcacggcgacctggaggcgggcttgcctccttgtcgatctctccttccctctcttcttcttcctaccaaccaatgtatcctcttactcactgattcattcagaatcttctaaatcttgctcctgttagttgttgttccttccagcccacctatatactcgtgatttgtattggagcttaaacaagtgggtctctaacaatgggccaccatttacttaggatgagatcgaaaccgagggcatgaaatggatggcaagacgaagaaagggacagagacagatacatggagcaggaaaaaacagcaaagcagcagcaggatgagaggaggacatggatggcaacatggagatccagatgcagtgcagcactgcaggcagcacgacactcacgaccacgacaactgctggctgcttctacgagttactccatctgtaaaaacaagtaaagtaagggaagtgcttctatgcttcttaaaaaaaaaactgcacgaaagttaaagcacgtcaatggtgaggattaaaagttgattaaccgagtaatcaccattagcaaggggcaatttcgtccagaagtaaaagcccatatccgtatccacatcccttctcatggattgattcgcggccagcgcgcggcagttctcacgacgcattccggtgaacagcgccgcacgcccgcaccctcatcctctaccccctgtaactgtaagagtgttttccccttccgctactaaccacgccgtcgctgcttccttcaccggcgagctctctccttcggggagctgtgtgttgacgtgttgtgtaggtggtgctcgtcgtcgtgctttcaggttcgtcaatattctcgtggttcaggaaacatggctggttggctgattcattgagcacaacaccctcactcaccattatcaacaccttattctgcttcttcgtgattctcggcagagattaccaaagcttccatgtccattttattcctcagtatatggtgatacctctgatatgcattcagaattgaactgaacttaacacaaggctgatcacaatcttttgaatttacatagaattggttgtatgcgctgatcctatccgtctcggactgttcgcggccgcgtgcctatatataaactgcgtcggcttcttaccggccgcacgaagaatcgatggcgatggagattatgcaacagctcgccgccgccgccacggcaacggccctgtgccctgaaccatctctgatggcgatgacgacggccggcgcaggtggaggccgccatcgcgacgctgcatggcaagaagcaacgcctccgcgaggcctgcgacagcctcgtcctccactcgcccatcctcctccccttccgctggtccgacctcgactcccacctctcctccctccagtcctccatccacgcccgcttcagctagctgcaggccctccaggcttcccgccccgcggcccccgccgccgccgggagccatggcgaggacgtccaggaacagggagaggacgaagtgatggcagcggcggcggcgaagatggtgcctccgtttacggtgctgcaggtcaaggagaggagcccgcggaggcgccggcatgcgcgagcatggacgccacaaggctgtcgtcgaatgccgccggcaagcgtgccggcgtcgggcaagatgggttcgttcgacccggtgggatggcggtgccggcggcggcggcgaagatggcgcctccgtcaaaggtgcaagtcaaggaggaaccagtcgattctgatatgcggacagggtgggctagatatggtcagctttttcttaggacaaaattacccctcgttaaaggggattactctgttaatcaacttttaatcctcaccgttgatgtgctttaattttcgtgcatgttttttttaaagaagcatagaagcacttcccgtaaagtaattaattctaaagattaatgatagttgtttattcaaattcatcttaaaaaaatagttattagtagaaagtagtacatctttcatcttaaaataagttcatttctcatctatctcacatatatcaatgcaaacaattattttctattttatctattcctgatacagttattttatacttttacaaacttcgatggaataattgctttaaaaaaattactttgagataaataaaatgagctaaaaataaaattattacgatagagggagtactagtcacattaattatggggattgatcgatcagatcagatgagcatggtacgttgttgttaggcagggtcgcccgtgaagtagtcacgagcgaattgaatttgcaatcgatgtatgcctactactagctgctacgtataccgaggtacgtacgttctagatgaatgctgtaattcgtacgtatacgtacattctgattaaacaaattcgcagtttactctggtccaaacaaacaatattaacaggaatgcttccaattgagggattatcctgtattgagggggaaaaaaatccacccatacatacgaattatcctgtattgaggctcccccgttttatccgtttttttaaaactttttatatttttttattttaaaaacgaaccccctctaagacttaatttttaatatctgaatgttttgacacatcagtcaggctagcgtgaggacggatccagcatggggttgataaggctctcaagcctccactatcgatgcaagatttttgtctctacaaatcaagataaacgaagatttcattcgattatatatgttgtacacatatatctcaattaaatgcatgcacacaccacactttgggtagctttcttgccgtctctccctgccgtccaccaccgccgaacccaataaggatccaactcattgtcaattcctaaaaaaaagaaaaaaaaatcattgcaagttaattaagaaatcgagtattatcgtaaccttttttttttccttgaagataaagatgttgaattaattacttcgggcttaggaagcatgcaataagcattttttatatcctattgatagcaaatcaatatgattcaaaaaggtgtaataggggagagagggaagttgttcatataggtggcacacggaggtaggtgctgaggattaggtttcgacaccactttatttgacgctgagaccattcaacttcagctccaaatacccttggcaccgagctatgtatctattttttttattaagttttagaaaggcttaattgtaaaataagttttttttaaaaaaaagaaattgaaaccagcaggtatgcacgtgaagatagtactcacatgctcactactttgggtccacgctgaggtaaagagaaatttcacggtctttaattaagagaaaaactttaagcgtaagatctagagcttatgtacatgtcttggtatttggtattaacaggtgctactaaattttacatgatgacttttagtaatttttcaagagctgtaaaattactcaaacataaatgaggttatgagggcacagttatgctgttagcattggggaactgtatattattagccgttaatctgaaataaaagtacggaccattactataaaatcctccgtaggtaccgactcatggttgtcggttcatttaaaatcgatatctattaacctttttcgtttctatgggataaaaaaaaaactgacacctttgagcaactatagacaccggttctaatataaagaccagcaccaataatactagtgcggatttttttcaaaagaatcggcacctatacttatattataggtgtcggttttataaaaagctagcccgagccaatagatcatgggatggtgattccttttaaccccaccgagtcaaccagcccctccttatccatcccccctctctctctctctcacacacacacacttatcccgccgcccctcaacttcacaacctcgtcgccgctgcattgtcctctcctccctctttctcctcctcactgcatacgtgcctcctcgctgttgtcgcccatcctcacagcttgtgaaccactagaccaagctgcctggagctcgcgtgccactgatctggcggcgtcgacctcgacgcggagagggctagcctacgacgacgacgccgtcggtagtcattgtctcccacgccgctcctccttgccataaaccgctagcggaacacggtggtgcagattggcgacgatgacattagtggctccgctaggactggagggaggggggtagtgggttcttgatctcgtgtagtccttcatcttcctggtgttgatatatgatggatggggaataataattgaatttcttgatcagtgtggatggggattgttgttgttgaatcaatatggagttctagccggcgtctatgtattttctttaaattgtggggagcccaaaaatatcaattctatcaagtcattggtgacgaatatataattgttgccgactataaaaccggcacctatccaggtttacaaccgggaatttttagatgttctgtagtagtagtgaacaattataatttatatccctatatgtttacttacaagagataggtatattgtactccctccgtttcgttttatttgacaccattgactttttagcacatgtttgaccgcttgtcttatttaaaaaatttaaataattattaattcttttcctatcatttgattcatcgttaaatatacttttatgcatacgtataattttacatatttcacaaaagtttttgaataagacgaatggtcaaacatgtgataaaaagtcaacggcgtcaaataaaacgaaacggagggaatacaatatatatctgctctccaaagaccaagctcgcatgacaaccagatgtttttacacaccttggcaacttgtaagaagaaaaaggatgcaacaaatactagctagcctagcgtatatgttcatatttgtagcagtacgtggtggtggtggtgagctataactcgaggatcagctctcttctctactcatggccaagcatatatgatgtaatcaattgcatatatatatgtttggctgtctctatatataggggacaaaaacagggatggaaagtgagccgatccaacggaactaaacacattttaggcgaataattagaagggtgaatggacagttaattaccatctctatccaagtgtgacagagttaaaagcaggtagctagctagctgccgaaaacactttggcaaagcagctaggaaagaagacaataatgcgttagctgtatgtatgtaagcatctttggcatgtgattggttggaggattgaagggcacatgatgatggagatcgatccatcgttgtgcagctggtagggatcggatagcgatatcgatcgatcgattcatacatgcattatgttcacttacatttcaattaattattgttctagcatttaatttttttattaagatagtacttgttgttcttacatttcaaaataattttggtgctattttttcccctacccttcatcaatacagccatactcatacttatattaattagaagcttctaaaaaaataaataactatacctcttgaaagatgattataatgtaatcaatagcaatgcaatttatcgtacctcctagttcagcgtgagaattagtagaacggtaagcaaaatggaagcgggagtgtgtttaatttgcaactgtgcgataacggagagaattgagaaagtatattaattaagcagcatggtagctagtattatttttccattatctaaaaaccagtgcaaattaagtgtattttaaggaagagtttagtctgaatgaataactttggtcgatgctggttttaattaagtagagcatatgcaatgcaaggctgatagtgggcgtggcggacaagacaagtagttgagttgcttccgtatacggatgggtgatacggccgtccttcaaccatcccccacaaccaagttgcataaatactgtaggagtacatatatgcagtggtcctcctcccatattgtacaataatactggagtatatccgatccacttgctctctctaatctaatggccacttgctaattaaataactcatcatcatcatgcatgcaaatatgcaatgccttgatgagtggcctacggtacatactcgatcgatcgacaacaatatatgatccatcatatatatatgcgctgatctctaactaactaacaaatctagatttttaattgatcctgtatagtatagctaggtaggtaagtaccataacccaaatgactggcaattctttctactcttgctccagtattcccaggtcgttgtaccactgccgcccctcgcgtacaattcctgctctatttcaaactctgcttgtacaagcacaccggcctgaccacgctgtctacttgtaaaaatatgatattttctaatccatttagattagaaaatatcatatctatctattattatataattaaaggaatagaaaaatgagcctccacgttcgctctcatggcctagaaattctcacattaatcggagaaaaagaaaaagcagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaatttggaattaaaaataaggaatattagaagtagagtatagagtccatgtagaaatacaattaggaaataactgaaattcggaattaaaaataaggaatattagaagtagagtatagagtctatatagaaacttaaaactaactaaaatttggaataaacataataaaattaaaagtagagtttagagtccgtataaaaatacaatttacaaatagttaaaattcgaaattaagaaaaaatgggaagaagagtttaatgctaatataggaatacaatttagaagtaactaaaattcgaaattaaaaattaaataatattgaaagatgagtttagagtccacatagaaatataattagaaataataaaatttcagaaataaaaataaataatattagaagaagaacatatagtctatatagaaatacaatttacagaaaaaagaaatattaaaagacgagtctagagtccatataggaatatatataatttacaaataactaaaattttatcttaaaaataattaataactaacacgtatataaaatgcaatatgaatattacacattagtagttttgtaaagttattgcaaaatttaaaattatgttgttattttaatatatttgaataatataatgagaaaacatatatgctattatatgagagaaaatataatgatgctagccgcgcaatctgcgcgggccatcatgctagttttttttaatttaggttaatatattttagaacgaatagagtactttctctgtaaaaatacatcaatttctgctttgaatttaaatatagcttatgtccagattgaaagctaggcgttggtttttgtaggatagatggtgtactccacttgtaaggaggttaacctgctgctataagtgaactgggatcaggcacagtttctataggaactgcatgttaagctataggagccatctactttgttgatgaacggaccagatcgtcagctacaagtagtggtgcaaagcgctttaaaaaaattgctacagtaagctacaatcctggacgtattttaaccattagaccaagatgcaggaagtattttattttttttacttgtgctgtgccgttacatatcaggcgaccgtgcgggcatctggttgatcacataaaacgctttcggtggcttattatttggctgcacaacttgtatctaagatgattcatatatacggtgtcaggtgtcgtttttattatttggaatacgcttgcgtatttacgagagagaagtgcaacagaatatacaacggcatttttttcaatgaacagaatacaacacaaaactaattatgcgaccttgggatctatactcagagttagatttaactaagggcacccgcaatggttatctataggctctctacaagagactcatgtcagcatattttcctacttggaagatattaaatgaagagagagcaaagctatctactaacttagagatagtctatagagaaaaacgagacaatgtatgagagagctatagatacctatatagacatactattgagatggtttactattaatctagtatattgttgagatatacatgttttatagagcaccttactttactatttcgtgtgctcgaatgaggaggaatcgaccgttctcacccacgtgcggtgatttgttcatgtctagtcggttgatccgttgatggatggatcgtgtagacgtgtagtcgtgtactgctccctgggaggctgggacatgatatactccctccgtttcgttttatttgacgccgttgactttttatcacatgtttgaccattcgtcttatttaaaaacttttgtgaaatatgtaaaattatacatatgcataaaagtatatttaacgatgaatcaaatgataggaaaaaaattaataattatttaaattttttgaataagacaagcggtcaaacatgtgctaaaaagtcaacggtgtcaaataaaacgaaacggagggagtatcaagttttgcaatacgaaatgttgggcatttcttcagagcttatcccgaatgcatggtctcccatggatggatgtcctgtgatttcttcctttcctacagaaaaagcagatctctttggcttggcagctcgctgtcctgtgattactgtactgtacttaaaagggaggaaggaaacatataaacgcgtcttctcttgagctaactaaaaagaaaagaaaagaaagagtgtcttctattgaggtgaggtcatctgtcgtggtgtcactcgacacttgcaatcaacagctgtttccgccaaaacaaacaaatctgttctaatctcggcacccctgaaccaccgaaaaagctcatcactctcttctcttcactaataacctgacgacctctgctggctgcacttgccacttcatcgtcgtcgtcttcttcttcttcttgttcgctttttacactctcatcaaaagaatcatctctctctctctctctctctttttcttgcttgccttgtttggatcgattcgattaggatgcgattgaatcgcccgtctcatcttcccagccacacccacaaataatgttgtctttccgcaaatcccctccgatatccgtgtcctgctctttttttttgttatcctctaccgaaaatcccgattttttcgctttgaatccgccttttatccttcctcccataaagctttgaatccccgcgagcgagagcgagattccaggcgccgattcgcttccacttccgcgagcgtttcgtgcattgattccaagaagatccaagcttatcgcggaaaagaaagaaagaaagaaaggaagaggagatgaaatgcttcaagcagcagcagcagcagggcggcggcaatggcggtgggcaggggaagaggctggagaggcggctgtcgctgggggagtacaagaaggcggtgtcgtggtccaagtacctggtggctccgccgggagccaagatccggggtggcggcgaggagctgtggagcgccgacctgtccaagctggagatccggaccaagttcgccaccggcaggcacagccgcgtctactccggccgctacgccgcccgcgacgttgccatcaagatggttagccagcctgaggaagacgccgccctcgccgccgagctcgagcgccagttcgcctccgaggtcgccctcctcctccgcctccgccaccccaacatcatctcggtacctttcttccttcttcttcgattcaatttcaatttctatttcttcttcttttctagtacctttattaataacttgttactattattatttcaattataatggattctgtcctgtgcatcttgtggggacttctccatcatttttgtgcacttccatccatcaagtccaatttaatttctagtgcgctcgtagatgtttactactaacacaagttgttgcgttttggtttggttggttttgtctgtaccagatattgaatactagattatctcacttgaacagcctgttagtttcacatcttagttcctttacgctttattggtgtgccccatgcgtgcactaggctgtaggatttgttatgctaaccgatcttcacattaaaggttcttactttatgccttgttttgattgggcggaaggatggggtcgagaagataagtctgggtgcgacatgattcatgcttgtttatactaacccaatgaggagggagtgaacatggcagaaaaaaaaaaacttctcttccagtagtatgatattgatagttaagatagcgaaatctgagtcacgtacaaatgttacagcaatactgttctcctccctactctttctctacgttcatatctcaccctttcgatccatcgagcagagagctggtaatgattgttagtgattttttgtgagatcctgaatgtttttttgtgcactttccatcatatatattacttaatagagcttcctttctttggagaaaactcaacagagcttcgtatttaatggagaagcacatctaataaacttctctaagccgcctaactatttttagccatccactggaggtggtttataggaaagtttaacccctctgtttctttgattggcggtatatcaggatatttttacacgagtgctgcaaaagctagccagtctttaggttaattgattagtccaatcactgtccgcaccacttttataacttatgtgaattggcttcattatgaagaagttgggtaaagagagccaccagccaatggttgtattcaggtttttatcctatgcttgatgagttcatgccatatacagcattataggtgataatgttagatacttgtatgagaagttaaaagatgctattttcctaattaaagtgcgtggtggaccatatatgacatccaaacttaactgctttcatatgccaagaaaagtgtctctcgtaagaatttaatacggagaattgactcagagagtgatagttcgtgactttgcctacagataaaaatctatgttacttttcactttatcaagtgcctacctggattactggtcccacagatcacatggaaagtatcactttgtcaaaccaaccgaagttgagtaagcacaaaaatcatgtgacatctatgcaagttgcactccaaatgttcttcagtaatactggcaaatttctgcaagaaccttaattatttgtgaaattggtttatatgagtgttaggccgcatttgatctcaaatcgttttcctctgttgcattatttgccgttataatattttagctgtccatgttaaatatattgctaaaataggtcttggttctgatagtttgatagataaactgttcatcccttcgtcaccccttttctaacctgttatcctctatttgccccttcgaaatttgcacagtgcgcagagtgatgggaggggcaaatagagggtaaaagttaagaacaagggtcattgaatggatgagcagtttcagagaggtaattaagggaagtggccaacttacagaggcaaataaagaatttctctacatataaagcatgctggatttgaaatgaaagatgcccactacttttaacttgtgaaggaactcttgtaaccaattaatctcgtttgctcattttgttgagtctcaaactgataagaaatatatctaaactcttgtttttcagtttgttgcagcatgcaagaaaccaccagtcttctgtatcattactgagtacatggcaggtggctcccttaggaaatatctacatcagcaagaacctcattctgttccaattgaattagtgttgaagttatccttagagattgctcgtggaatgagctacttacactcgcaaggcatacttcacagagacttgaagtcagagaatatacttctcgatggagatatgtcagtaaaggtggcagattttggaatttcgtgcttagaatcgcagtgcggaagtggtaagggttttactggaacgtataggtggatggctccagaaatgatcaaagagaaacaccatacgaggaaggttgatgtatacagctttggaattgtcttgtgggagattttgactgctttggtaccattcagtgagatgacacccgagcaagctgctgttgctgttgccttgaaggtatgaatttttgacatgccacctctccaatcttcatgtccatctttgtttccttggctataatgtaggctgttaaaatcatgagatgctgctgccttttcagtcgcagtaccagtagaaaattttggtttctttctgtaagagagtaaaaaatgttttttttcccttatggaaactatggcggacatttaattagcctgaactttattggtatcaaaattgcgggtaattagaggatttaattaagcctgaactttttttttgcttaaatcctctgtatcaccccaaaaattgtttgtaattctgttgacatggtttctagcttgaaaaaaaaaacatattaaacatgctcgatccatttaggtaattactgctcaactagcgatgaaatttgaataggctgaaaatatggtgtttttccacacattgtgttgcgcagcaaatatctatatgatcccataagtttggaaaataagagtcggttagcttgtcctatctgttactgatgaccttcatctattggacttttgcaactaatagcttttgtgcagaatgctaggccaccactgcctccttcatgccctgtggcaataagccatctgataactcagtgctgggcgaccaacccagacagaaggcctcagttcgacgacatcgtcgccatacttgagagctacatagaagctcttgaagaggatccatccttcttgcagtcatatataccgcctccgcatccgctgcaccatcaccatcaccagcatcataatcatcatcatcaacagagccttctccggtgcttccctcgctacagaaccacccgacgatctgcatctctgagagtataatctggatgacggcttcgtcttcgccgtgtatgatgtatgcactttgttttttcagtttcttttttcctttttcaatgcgccggccccctattatgcggcagtaaggcttgctatgatttagtattccccttctttcattttttttctgtttattattgacgattttccatcattaatgcctgcctcgatcgacttacttgagagacgacaagcagcagtttttctggtgattatctatctctgaatgtcgttttatttgggtggtggaacaatggacgagcatctgtaattgtaatataatcgagctcttccgtcaatctgctgtttttgttgtgatcactgcaatgttatgccttgaacaagtgcaatgtttatccatgcatggcaagtgagattttaaatatcaggttcaaaaagtgagattagttaggcactgcgttttttttcacattcatctctctgcgtatcattaagagaatcaccagtgtatctttaaaattgagaaggaataaacaatactactatcagtttatatacattataagactaataagtaacaaatacaatgtaatatacttaattacttagccataagaaataaataaataatttctttcatccctctctcatggctagtggttgttgggttagagattttgctaaaaaagcatatgcctttagcaagtactataagtggaatgtctgtcaatgtatattgttatgtttacattgtatatggtaagagacagtattaaggtggaccttacaaacacaagagtacccagagagaagtactacctaagggtgaaaatggtcatggaaattcccgattgaccaagcgttgtttctgtatgaagggcattgttttttatagttgctgatttcgtttttggctatatgtaaattttgtttttttttctcaatttctttctgtatcgtattggacaagtgtcgtttaaatgataaatatagtcaattaccgaccgatcgagcgtctttttgaaagagatgctaccgattccgttttcacccttagtactaccatgtgagagtgaagagtgactttttagttacttgtgggtggtctttatgcatatggccaccttaaccaaatgcctcctgtaagaattaatctcacaatgtataagatccaccttaaaggcttaagaccccccctatgttattgtcctaaaccccttaagtacttgcccctatatgccgtgtaggctcatttgcagatgtggaagagagaaaggattatattagagagtgaatgagctatccctcatgtaaagagcaaccattacacaaatttcagtaaaaatatgagagcattagagttattgggggtttgtgtgttagagtaactattattgtatactcccttcgtctaagaataatgttacttagtatggaatgtgatatattttagtactattaatttagatatactctgtctaaattcttagtactactatcatatctcataggtcaacttattatgggacgaaggtagctggttacctcttaaatctatataaagatgatatatatgaaattggaggtaacagtcacctatattataaaacttgctattatgaaaaaaggagaatcaatagaatattaatggattctaaacaaccactacattaaacatttatgaatgatgaatgtataaatgatgaaaaaactctgaaattgccctaatataatattccaatagaaacctatgttatatgggagtattcaagcactagtaataacaattgttggatcagtagaaactcctggcagagcgagtccaccaacttgagcctgagctcgagctagagcttgaggttgacgacgacgatggcggcgatggagaagggctcctccttgcctccttcttgtactgcggcggaggagaagggtttctctgctgacgtcgccgcgctaggtcatcatccgacgacgaggaggaggactcggatgatgaagacgaagacgaggacgaggactcggatgatgaagacgaagacgacgacgacgactcggaggaggaggaggtgtcggtgccatggctggagcgctggcggtccttaagggaagaagcagcaggagcctccggcggcgtggcattattgtcctcgtcctcccccgccggcgtctgcgtctgcgagtggagcgtggcgaggcggccgcagatgtcggcgtagcagacgagcacgatggcgacggtgaaggcggcgcaggcgaggctgatgacggtggaggggtcgagggcgcgggcggccgcattcatgtcggcggcgatcgcgcagagcgcctcggcgatgacggcgaggtggtcccggaaggtggccatggccggccgatcatctaatctaatctacctgcagtatccaagtgtacgtcgtgtagatgtagaggaagatatatctatatatatatatatatatatatatatatatatatatatatataattcgcagtgttggtgtttggtacggatacggataatgcttctgtttggtatcgtcgccgacatagccggaccccaaaccaaagcttatctcatatgggctttcggcctttattttcagcccacttcaaatcctctcaccttctggtcctcccctctctgcacattttcattttccccctcctccctcccgtgcgttgcagcgcctccgcctcttctcctccccgccgctacggcgcctcctctcattcccgtcgctccttctcgccatcccttctccgcctccgcctcctcctagccacgccccctcttcatccccaacagcaccacctcctcccatcgatcagagctctctccggcaatagcagggtataattcgaagcatggctccatccgatggcggcacgcatagaacgttactttacgaatcgccgtcgcctcgtcttttgcatctccactagagatccccttgacctcctctgcagtctgcagcgcctcgatccccttctccagttattcttctcgtccccctctggtgaagattgccaacggaaagactaaaggtcccaaaaactgcacgattggggaagtcaacatcgatagcagtggttagtataacttcttgctcctgccagtgttcattgtatatgatgtgcagataccaggtcttcagctaactctgagaagttgagcacattcttgtcctagctgctaaagtgggattaagtcagttaacagtacacgcctgagaattaagacctaaatcaaaaatagtaagtttggactaaaaaagatcaacaagttctaaaacggggtgtttaaaggcacttatgtatttgcattttttttattatgcaggtttcatttaagatcactgtaaaaagaacgtgtcctacaaacatagaaagattgtaagcaataaatattatagttatacaatagaaaaatgtgttgatggttcaaattcattaatgataaacaattacacgcacaattgaatttcatatatcatgttatactcatttcaaaatgcatatgaaaacaaatgggtttaaaactagcagcataatggtttgtaagtggattgagatagtatctttattacttttgcacacaaacatataaaattcagtttccaaataaattccatgagtattggattaattcgatatttgctaaaaaaaattagttgtgacaagttagctgctaaaaaaatttagttgtgacaagttgtgataagaaaaatctagaattatatgcaagttggctccttcagaagtcattgtattatatgctatagataagagtcatagaaatttacacattcttttttgttggtattgtgtctaacttctgggtgttgaaccataccaatattgttgaattgggctcctcgagtacattcatctgcactggaattccttatcaaccattagtcagtaagtgttcttccatgtcacactattgcctcaagtaaacaatctactgaaatttgtgtttaattattactttctgaggtcatagcaacaatagccgtggtaatatgaagcgttgaactgtctatcatatcctaaactaagaaggcaagtgggagggatactgtatttacatttgccatagtatgatatttatgaatgtgattacaggttggatctgtatactagactccacaccccttctctaaaaaaatactagaccccagccatgcttttgtgctacttacgatatgtttcagattttttgttgttgtacaattttcaaagttttttttagacattttctcttggtgtcaccatatatttatgatatgatattctttacatttgaagaggcagagaatgattgcaataagcataatcacattggagagcataagcaagcaatggatgatatattttgactgtcattcttttctttttttatattaactgttgtatcgatggacactaaaaactgaagagtaatatgtttaatttgttgtcagcattaatccaaaaaatcaaaagctcagtaagctgtattctgagttcaatatttatcatgtactatctcaggctgttatgtgggttttccttttacctctttggcacatgtgatggcgtaggtaatgagagtcgcgcaacacacgacttatgtggctagttgatttgatgatttcccttcccaaaatatcttaccaaatactccgtattaataaatttatagataaggtcaaaaaaaattatagattgcccaacaacaaacgatcgtgacactaaacattatgggtttaaacgatcataacaatctttcgaaaaatgcataagtactccctttcttttttttcttggagccgaacacacctaggataatactgtaggaaaaaaaatgcttgtgagcacatctttatttatcttttcaaaaattccttgtgaggtaggaggaatatagagtttctttaaaaaattattatggtatcatgtactacctcctagtattttatttactaaaaatcctaacatttttttgttttggaaaataaccacgcttaggatcttgttactactatttgatattcgagaatcaattttatacacctaggtggatgtccacctacgccaatctccatccaatgttctttaagatctgtgccacccatatcccacgcccatcaccgaatacgaatctgcctgtgcacatatctcgggggatgcatcgacggcacaacagttgggtggacatccacctatgcgatcggaataatctttctttgatattctatatatcacaatacaagaataaggctaagttatagtgtttgcaaaaaaaaaaaatatacgaaagttgtgtaaaaaaacatattaattcattttaatttttacctaatacttaactaattatgcattaataaaccacctttccaagcacagcctaagtggtggtggatctaccatcggcacgtcacaactacttttacacgttttataaatcagtccatgaaaatttttaaatatttatttaaatcaagtgaatatatatatatatatatatatatatatatatataaaagcatttgcaaaataaaacacggacattttttttacccatagccttctgttagtagatagaaaaaagaaagaaaaagaataaatgccgaactgcaagtgaccatcagtcctcaccacagttatccatggcaacacagagagaagaagagaaggggattgctttgatgaaattgtgtgtgagcgaagcgacacgtttcgtttcgttttcttggaggaaacaaaataaacaccctccgcgtgcagataaagtacatgtgaatatcgcacatgctcatcgctgcttctttcctccgacgactcgccgccgcctgaaatctctttcttgattcgtgcgctcctgagctaccccgatggccgcccaatcttccactccctcgccgcaaggtcaggtttttcttcccctctcttactgtctcatatcctccgaaaatcgtggcgctccccgtccaatcctttggatcaagatgacgcttttcttcagacttggaatcttggcgcttcttgctcgatgtttctatcccgccgattgttagccatataatttgggactgagtttatgagcaactcttctctttctgttgagagacgagggtttggtaattttgagggttagaacatgagaaccgccgaatcttgtaccgcgattgcctactggaataagcgtaagagtcctggctgctcatatcatcactaattctagcctcgttagcaagggcaactagcttttgaggcgattcagccaagacaagttcatgccctcttgtggttgtgggcacaagtccagtggctggctgcagtttttgctgcaaatatcgacaatttagaggtccatagcaccaaatgaatttggaaccaccggggagaaattggctattctgaaaccttgagttattatcttgttattttgttagttatagtcactcagattcccctgtcctgaaaatcgaactgcattcccatttgctcatgctgcagatggttctggtagaggtgaattctcagacaatttggtacttcaaaccccacagccaatgcgggaggattacatacagaatgctgttaactttcttggacatccaaaagtgaagggttctccagtattttacaggcgctcttttctggaaaagaaaggccttacaaaggaagaaatcgacgaggccttccgtcgggttcctgtatgatttactttctaccgcccctacatggctgtttgtatacctccaaatgaaaataagatgaaacgttcctgaaacagcttaatgtcttgtaggatccacagccaaacagtacagatgttgcagctgttgcttcacaacaaggtaccctattgctctacatgataaacatttagcactagcacagcaatgggttgcagtgatattatatcactgcgtttgtcttacttttggttgagtggattgtcctaatatagtattatgacataatagccaccaggctttgctatattgttgttggttaacttggacgcacacaacatgcagaagttttattggtttcactgagtttgctcaagtgatgatctattggcagcttcttttcttttgtttacttgattggaatgtcttattttcagctctttttcactaaattaattcaaattacatcaagattttagatctttagattggttctataaattattgtgctttgatagtagttcatatctgtgattgcaagtctgtacccaaaaatcttacaatacactgaaaaataaactctttttgttagcttgatcacttaaaggccgtgttattttctttgcttccagccggcatcgcaaatcaatctgctggagtacaaccttacgagacagttcaagcaccacaagccattaacactggtcctatcgttccacatgcgcagccgcaacttagctggtcccgtactctcattggtgtaggtgttttcctcggagttggggctagtgctgctgtcatcctcaaggtatatctcgtgaattttgcagactatcttaattttagcaagttcttgagaaattaactctatatgcgtgcatgttttgtacagaaattgtttgttcctaggctaaaatcttggatccaaggagcccatgttgaaggggatgaaatttctgggaatgaacttaaatccaagttttatgaagaaatcaaagcagccatacaagattctgcatcagcgttttctgatattgctaaaacaaaccaagagttgcttgcttcaaaggatgaaggtttcataattttccgttgatacattagcatgttttagcagaagaaatgtacaatagctatcactgtttcgggtttgatcgtcttaatgaatctcacttgtttatagataagaagatacttacaaagttggcacaagcatttgattcgcaagcagaggcgtttagatccttgagtgattccttgaatcgtatgagtgagaataggttttaccagtacaatctaatggaggatcattttcaatctgccccatggaatggttagaatcaattcttttttgttgcattggtttctttaaatctgttgctaatattgacgttatctgtctgaatagggccaactacaaattcatggagagcttctcaggtatagcttattgttatttaccccattgtgaactcattattcttatttaccctttctgtcaatacctttttttttaatctttgcatcattccgttgtagttctcattcggtttctctatttacagcaaacaaacgcatacaacacatcaccacgcagtgattttgactccggtaagtagcctccaccagaagcagcacaactttcttgtatcatcacctgagaatatttttttctgccttgcacttattttgtgtgccctctttcgtgttatctttatcagggaggcatccgttcatgccagtaccgggagaaccttcacctggagcatttccggcgagatcctatgttgaggtaggccatcgtatgatcatggattctaggtgcagtagacatgatagtattccaaaacttgatggtgtgtgagtacttatttcagcagcagcggatgcagaggcctgggtacggatttcagcctcagatgagcaatgacaggtggaaccctggctcgccattgacgaactaccacggtgctcctccgtatcagcagtatcaccatggatccaccaacgccatcgatgaagctccagctccagctccagttccagctccagctccaccagctgaaagcccgttccagcgtcgctgggttcccccacagccaccgggcgtcgtcatgccggaggccgtggccgccatacggcagccgaggcagcaagttgcagcggcatcgagaccgtcggaatccgccgcggcgacagagcagccacagtcaggtgacgtcgccggtggcgccgccatggccaatgcgggcaatggcgaggccgagcaagagcgggaagctgctgcttaattactccatttcttttttttttgtttgccacgcgatgcatgcgtctctcgtgtacaaaatacagactagtgacgattacctatgagaaaaagaagaggaacaaatgttgtgtattcattcactgtgggtgtgaatactgactctactgagattatactctgtctgtctctaaatataagggattatactatgtctgtctctagatataaaggattttagtcgaatgtgacatattctttttctgtctagattcgttattcgttattctaggatatgtcacgtttaaccaaaataacttatatttagggagggagggagtaatggccaagaaaaacaagatgctcgcgctgcttgctttcttgcgtaccttgtattttttttacaagaaaaacaacattattttcatgccttgttttacatgtggatctattatatctgggcgttagttatcgacaagtgcagacaatgcacatgggacacagacagagagtggctccaagtttcgtagtctgttgcatttctttgtttcctttcattttctccttggaaaaaaccaggccttgtgatggtgacatggcatctcctcctctcttcttctcttggtactccaaaaaaaaaatgtatggaaaaaaacatgccgagatgcagagacagaagtatatattatgatatttttcaaactcgtggttgttaatttcgttgctccttgtagtacaaaaacaagaaaaattcagacttggtttgacttgtggttggtcttgcgggatgtcgcaagtagggcaacacgtgaactagaaatccatgcatgttcaaagcatgcctgattatggtctcgtccatttcacagtcctactaattcaccggtcaaacctgcaattaacataataacaacatttggctggtgccttagctattcagttattcaaactcgtggctgggaaattccactgcatgcctctgaagctttgacgcactattatacatgcattggaaactgtcagatttcgagcatactgttgtgttgttttcagtctccctccacacgactgaagatcaggcacgcagatgttcagaaatgcagaagcagcttgacctcctctccaattggtaagtgcaaaattttaggtttgtacttattgagttgcacacgtaaggattggttcaactaaaaagcttaaactgatagaggaagacaagcaatttaccaaatactagtgctattagaagatacagttttaagaagaagatgaaagcacacaaatttctgtagtaaaatatcggcgaaacgcagtgcgtaactagctatagatagctcctcttttccatagtggtggcactatggactgattgaagcaggtcaaaagaaatgaaatgaaagggccagacctcaccttaatttgctgtgcatttccactaccaaaatttagagtcagtgatccagctgagtggatgcactagtatctcttcgcaagcagctgtacacgtgtcatacttctatcagatatacggagatgtgtatgtatgggttgatgagatacacacacatgtcgtgtcaagatggagtatgtcccatgtgtatgggtaattgtcatgttaagtagggtaggtcatcccacgaggccgaccggccgaccacgccattcgcctgcgaagaaagaaaatgcctgaatattcaaccacgccacaagtgctgcccacaattttattagcaataactcgttttagtttgtgcgacacatccataggcggcccactaaatctcccatttattcttccccctccttccaagtactgcactgcaatttaattactcacccaacaaaaatactactccctccatcccaaaacatgagagactgcttcccaatatttcaaagcccggaataacctaataattgcattgagtatttgctagaaaaaaatatttttttatcatacattagcattaaatttctactggatggttcgtcgggtggtggttccactactggtcgtaaggccgtaatatctcaaagcaaacaatatatctagttctatcattttacatacaattgattataacttataacacttattaatgtcttaaaaaaatttaaataaaacttttaatatactagaaaaaaaatactcgtgcgttgcaacgggtgaaggctattttaatcttattattgtttactgtgaaattttctgtaagaattcgcttgaatatatatttttcaagaaaataatgtcaagttagcatataagttttttaaagagatttctaatacggtatttttaaaaacgaacaaacttacggatatgtatttccaaaagcgaacaaacttaaaactgacttatacacagatggcgtaccaaagtactggtaaaaacatcttcagtttttataatagtagagattttataaacgacttaaaattcaatgatggaaaataaattataatgagaaaaacaatcaaaacaactctaaaattaagttttaaaacttaaattcggttgtggctgataagccaaagaacaaacgatgaagcataggagataagtatttaacccataaggaaagccagtaacatacgaatgtacgaagaatattataaatttgaccgagtttgaataaaatttatgcaagtgatgaatatgaaataaataaagtacggtacagtgatagagagggcatttcgtcctcacgttttgtttttgttttttcttttcttttctgttgggagtggcattcggaagaagaagagagaagtccatctccctcaaggagcatcggctgctggcgctgcagtccataggagtctcagattcccatctcgtcgtcttatccctccactccgctccacacaatcttcttcttcctcctctcctctgtttatatacaactccttccctcccccattcgcccgcttctgcatcccgaccagacgtcgagtcgagcattaactcagtcagggtggccatggcgctcaaggtcgtctctttccccggggacttggccgcggtctcattcctcgactccaacagaggaggagctttcaaccagctcaaaggttggatcttttcctctttcttatccccttccggatcaactttactgctctttcttgtttcttggccctcgacttgcttctgttttcctctcatcttgtttagacttcatttcgtctgtttagcctgtttcaagataatccgcagtgtgttcaaagagcacccattcctggtgccgattaaattaggcacttctactcactcgacacagccggcacccatgctgtgagtgggattaggaaagctgctgcttttgcaaggatttatgccacaattttggtttggattgcttgggctaaaataaaattggtcttcgttctcacagtgcatgggaatggcagcttctgagttctggagaacatagacacacagtcattgtaaagttgcaaactctgtgccttaactgttttgattttgacatctgaaaaggtggaatttccccggttcgcagaaaaaaaaggggtctgaattcatttctttgagattaaaaacgggttcagatttttctcttatacgggtataagacacaattcttccagaatttatgcaacttcctcttggtcgagaattatgctgttgtcagtattacgtgtctagaatcgaacccctttttgtaatcaactgggtggattaaattctgaaatatctgagcattatcttcatgcttgcaacttctatctttggaatatctagtgttctgagaatatattctgcatagattccaattcagtttctactttctagtgatatggttctattcagatgagttgcactactgtaacgtgcttttactctaaattgcttggtgcacatgaaacacgcagtctgccaaattgtcaagatcggcctcaattagctcaggcctcaggactattttttttttctgccatgtttcttgagcatattgcagcaaacgagttagcagagagttgtaggcacgtatatatgcctgaacattgattactagtactattttcattcatatatcttaatttggctgtctttattgcagtggacctcccgtttcaaacgagggacagaagagcagtttccctgagaaggacttgctgttcaatgcaacaggctccaccaccagcatggcctggtcgagccgttgttgaacctgggaggaggtcatgggatggccccaagcctatctcaattgttggctcaaccggttctattggcacacaggtaaatggaacatcaagatctaagattaacggatggaaattaatactccataccttttttatatctgtcagttgtgctagtacatcaatgtttggtcaattagttcatctaagagtaaatgtttgacctatttatctgatgatacgagttgaccctttcaagatcaatcaacatgtcttgagctattcattgaaattagttggacatgaaaatgcgacgtttatattctgtggtactaatagtgttttatcttttcttttctttgcataactaaaaagacattggacatagttgcggagaatccagataaattccgggttgttgctcttgctgctggctccaatgtgactcttctagctgatcaggtataatgattttgtgaggaaaatatcccttctttcgacctttcatggtaggattatggacatgaaagttaactgaatataggttgtttaactaagcaggtgaaaacattcaaaccaaagcttgttgctgtaagaaatgagtcattagttgatgagctaaaggaagccttagctgattgtgattggaagccagaaattattcctggtgagcaaggtgtcatagaggtgagtttttcatgtcatatttatgtttaaatagctgatgctttgctgtgaattttataaagattcaactctcatataataggttgctcgccacccagatgcagttacagttgttactgggatagtagggtgtgcaggactgaaggtaatctttctttttatattgcatattctttgctctgcttcctttaatattaggtgttaatattacaaaaactcaattatttctttgatgtttcaacaagtatattcaagaatttattgagaaagaaatgaaaatatatgtgcttgaaaattatattcccagtgttatattaccataacaacaggccattttaaacatatagtactgaaacacttggaatacatacgttattatggttacatgaatgtacttgcaatttttcaaggcgagtatgtttgaattggaagagctcatgccaaaacagtccttttgtagagttgctgattatctactcaaaagtgtctagcaatttgagattttttttaatagagttctgatgcaccaaaaaataaagtttgatatgcaacaactaaaacggtagtggtacatatatcctattcttatcttgtagaacattcgtgcatggaccgttttgtatatcaggtcacccatcataccttgatgatgctacttttagactactcaatatcttgatcttctttttggtacttatttcttaaaagtttgatttatctagacgaatgagttgtgtagccaaacgaaagaattgaatgcttgctgaagttctgtatgcatgcaaactacattaccagaatctggcaccacttgctgatttgcctacttaaatttctttgctctgccagcctacagttgctgcaattgaagctgggaaagatatagcattggcgaacaaagagacacttattgcaggtggtccttttgtgcttccccttgcacaaaagcacaaagtgaaaatacttcctgctgattctgagcactctgctatatttcaggtaccacagaaaataaattacctgtaactaattttacttggttcatctgatataagtttggtgtaaggttgtgatagtctggtacgtactcaacgttgcctgttcaaaaacctcttatacactagtggctttatctttaacacttaaacaaagtagcagtaagatgtatgttgcttgttatagtttactgttgttctattatatgctgatttgcagtttccctctactatcatagtgtatacaaggcttgcccgaaggagcacttcgccgcattattttgactgcatcaggtggtgctttcaggtaaatctactgacatacatgttatatatgtttttctactggacattggactccatcttatatccattgatgatgtcagggactggccagttgacaagttgaaagaagtaaaagttgctgatgctttaaagcacccgaactggaatatggggaagaagattactgtagattctgctacattattcaacaaggtgtttgcagtaaactttcagaattttactgaggtcatgttggcagtatttgcactaaaatgatcacttgattcatacagggtttagaagttattgaagcacattatttatttggtgctgaatacgatgacattgaaattgtgatccacccacaatctatcatacactctatgattgaaacccaggtgagtcctacagcacagctatggaaaatgtttagcggttatgctcaactgcagtggattttaaactgttaatgcatgcacacttaatcctgatatggcaaccgtattttcatgtttacgtttggcttaatattttttttcaagtattcatgaagttctgtttctccaggattcatctgtgttggctcaactgggatggccagatatgcggataccaatcttatacaccatgtcttggccagacagaatctattgctcagaggtcacctggccccgactagatctttgcaagtacaggctcttcccttaaatgctgtgctacttttgcattaccactgataattttgttcgagaatgacctcaaagaattttagctttcttattgttatcgcatggttctctcatagcccactcagattatcagtaagcttgagcagccatcctataacagttaatatgtggatctactctacttaaattcaatgaagctcgtatcgaaccttcatacaaagttcaatggatcgattaagtcccttttggctggttggttaccagtgatacgcaagtagttaacgcttgtaatgaattatgctttggttgttaggcatgaacgctgcttcatgttactagctatattttgggacgaagggagtagtaataaatttaaagaataaaaggttaataaagtaaaagaactagatgcaacaaaaaattgttaagttatagtacttaaccgtgaagaccttttttcattgcacgaagggttaatttttaatttgataatgcaggctgggttcactgacattcaaagctcctgacaatgtgaaatacccgtcgatggatctcgcctatgcagctggaagagctgggggcaccatgacaggagttctgagtgctgctaatgagaaggctgtggagttgttcatcgatgaaaagtatgacactcatcatcatcccttttcctctttccattgcatagtggattccatcgtctgattttgtttacgcacctattctctgcaattttaaaggagaattatgtcctgctgattgcagcaatgcagcaaaacgaataactggtatctaccaaagtccatagatatctcttgccctttggaaagtgagagctgaaaggagagagcatacatgtcgtcaaagctaatattctccggcactttctgagccttaagatatatcatggattataataaaccgacaacatcttgattgatgctagtaggcctgtttatatattgtaacttgctagcttagctgggggctacctattgttgtgaatgccatgctgtagccatgagaagttgaaaagagaacacatgtccttaaagcttaaatattctcagacactttctgagccttaatatctatcatggatcgtaaaaaaccagcaacgtctcaatttatgctagtagtaaaaggcctgattaaaccttggagcttagctggggtacctgttcttgcactgtagccatcagaaggtaaggtacctgttcttgcactgtcagaaggtaaggtacctgttcttgcactgtagccatcagaaggtaagtaccaaaatggtatccattggtgcaaaataaaaggtttgtttttgtcgaagggcgaattgttttctaaatggtgaatggctgacaaaacttcattgcaagttatttaaactggtgaattaatgtttcccggctatttctttgcaagtagacattttcccgtcagataaactttacatatatataagcaaatgaatagatgattgtggttatgtttttgcaggatcgggtacctggacatcttcaaggtggtggagctgacatgcgacgctcatcggaatgagctagtaacaaggccatcactggaggagatcatacattatgatctgtgggcgagggagtatgctgccagcctacagccatccactggcctcagccctgtacctgtctagtacttgtagcaatacaaaattacagtagcattgtacactactgccgtgccagctccatgcatagtcagcagctggccactctctagctatatctagatgcgagagaattttaaggatgtaaatcatgccttcacatgaataaatcgttcgtccgtgcgttgtgtattcatgtaaattttgacggatggtcaagtaaaaataacaatggcaaattaatttagggaagaatcaaatatgtttgcgttccttttctgagccgtggatgttgttaatcagttctaccaatcgctatttgtaaaaagtttcttaaagaaatttccttcttgacatcaatcaaagtactatatataaatcttcaggataaggcacgtcgccgaccaaacagcatgcaaaccgccagaatctgatactccattcctaaccaacactggacaatttaaattattagtcgaaaggataaaccggccgacgacattcacaggctcgattccatgtcctggaaagctcagaaaagcaatcaaaagcaagcactggacttaaaatggtaccacagcttaaggcaaaatagagagagaaccgctgaatacaataatagcaagttgatatgtgacccacagaacattaatatgaaggatcttatgccatacagtaccctctctacaaatcatccaaacacaatccctgtatgggacaagtacgcacgataaacgtccagcgatagatgtaaggcatcaaaagaagctaacgatggagctgttcggcagatgatacggcttgtgtttgtagcgcagccgtggcaacaaacaagcgcagacagcaggtggtgtctagtgcccatatttctgaaattcccattcactgttatctgcaagatggaacaagagctattgatcagcacacaccaacatacttaactccaagaggaaatcatacacaggaactgcaactacctaacgggcacacttggcgagtcttgagccacctgctgatgcaatggaagtgaaaagcatgattacagacacctggtgtacacgaaagcaaatcatgttagatccagtaaagcttaagactcaacaattcaaccaagcaaatatcatatacaggaaaaccaagaataaatcagggatgaaatcaagcaccatcagaaaaggtaaagaatacatcagctatgcataaattctttgaatgttttttttaaaaaattaatccacatatacatttcttgcagtgatatttggttcatggctaacagagtatgtttggataatttacagagttttattattcaattatgaaggcagattataatatcaagggcctaggtctagagagtcattacatacttgttacttgtagtatatgcctggggaatttactccaaacaaatatcaatgattaacgaaacctagaaactggtattgttatcaaacattgaacattagaatttagcctgtcacagggtcatatctagattgccctgccagtaccagaacatacatcaaactgactccccttaagtaccatagaactacaagtctacgacgacatcaaccacacgaccaggtgtagcttcaacaatagctaatctcaaaattcttatgtctaataaagatctaaatccaaatacacatccaaatatgtctcaatgttaattgttaattcctttgttatagacaaaatatatgaaggaagctagaattccatggactcatggctgctccatcccaccattagacattagttcaagtctacaaccacacttgctttttcagttcaataaggaaccatcagcactgcaaactataaaactgggtgaacttctattacgaatactgtagtatgattagatatgagctgaggatggtcatttgacgaggaacatggaaaagacttaaatataatttcagaaacatgacttgactctatgagtaataagaataaagatgtgagcatggtagtggagttaatgcaacaaagctcaggaatatgcattgggtgaagaacgcttgggtgtcctccaatcttacctgatgatgtgttaaaatatggtttggaaccatatgcgcgtatccatgtaaaagaatacacaacttcttttcaaaatctcaactacactcttgttaacaaaaaccactacatcgcatgtagttagatttggtttcattttttttagcacataaacattttccttagcacatacacatgtatctttacactacattataagtcaatcactctctccaatttgaaaaaaatacgctacctggtatcctaaagttgaaaacacaacgattacatcattacactgagccatatccatcaagaacagaggcacagaacatgtgtagttcaaattggttagagactactggcctagtggactgacagttgatcaaccagaataacacattaacaggcatcagtcaatagctatatatatatgaatgggataattaagacattggtcatggcaaatggcggagtgatatatacatgaagatttgcttcctgaatggtgagccagtctagagaaaagtttagcatgcggcaattgaaacaaggtgtgattggttggtaaaagtggatggaagcgtaccccaagcgacagtgcactcctcactggtggcgctggcctggttcgcctggcactcgatgcctgcagccaaggaagcagattagtattcaaatcgcccttaataataagtaacagaaagaaggggaaataaaaagaacaagagaagagaagggagggcggactgacatagatccatgatgtggttgcggcagatggcgcagttgtcgacgacgatatctgaggaggaggaacaaggatcaaatcagaactcagaagattgttaagattattagggttaggggggagtagagaaggaaggatgcgcgtagggtaccccatgcccagagcgcgacggcgttccacttcttgatctcgaagcgcttgttgggcttgcgggaggaggggccggcggcagaggaggatccctcgccggcgccggcgggggcgggggcggggggcggcggcgcgttgatgtcggtctccatggccgacatcgtgagctctcgatcgacccggattcaggaattccaccagaccaggttgggattggaagatgagattttttttctttttttctttttatccctcagatcagatcagatatggactccacaaagcaggccatggcccatcatcatgcatccactgggccgtgccttctctttcaccctttcctccttttcttttccagttctttatttcggaaacaataacttcttatctattagtaatatataaatacgccctgaagtattttggggttgctcatattgtagccaaaataaattttactaaatttttgtattgtcaaaattttggtaagttgacaatattgccaagttttagcagaattacatacatctttaacaattttagccgaaaatgatatggtttgaaatgacataaatctaaacaacccctttatttccgttcgcgagtctatcaaccttttggtcatccctgctaacgtcgtcgcaccctattatatactcctatgtaattatatacaacatgcgatcgagtattgtaaccggttataccaacaaagttttctttaaaaaaattgttcatgtattgttcagttacgagttactaggacatcatatgtacatgcatattttagacgattgcagttctggcaccatgaaaatcgacaaaaaaaaaaaatcaaagcaccaccatacaatctgctctcaggagtcaggagacacatcaatgcagataacgactcattaacgcaaaactctgcctgttgggcaaaaatcgatcgatacataaggcgctgcgctgctcaaataatgatacaggaaaagctctttctacgataatgtacacgctcacgcaccaacagatggccaaaaaaaaaaaactatgtttttcgtttgtgtgtcagctctacattgcatcgtaacagggggttgaggaaacactcaacactgtacaccgcaccttgtttgtgcctgggcaaacgccaagaaaatcttctcatcgtgttcaactgcgaaaggcatcagctgtttgatgtatgtagacatgccctttgaatctttcaacaaccaaatgccactgtcttgtcattaactctactgctgtttgagtgagggcatcaattaaagaacccatcccatcccatacagtatgaatgtatgtgtgggagagcaccctgagggcatcaactaaaagcttcatgggcacatttttgccttggctcagattccatctttttgttcatagtggcatagtgcttactgcttacaaccatgctccccaccctggaaacatttggcacaaccggtccgcatctactgcatcctgtatcagttgttgcacctgaaacccaaacataaaggaatgtgtagttttgcatcaacaaatacaaacatcataaacatatatttcctctttgcaagcacacgcatcaccaagggtcaaagagtgcttggttacctggccctgtacacttctcatttcaccatcttcatatccatctagtttctgcttaacacggaggatagctcgggctgcatccttgttgccctcgcaagcctcttgcgagtcatccaagcacgagtcaatgtcttcactttcctgcaaaaatataggttagcatattcatttgctacataacttacgactgcatacttgtcttccacatagcggtgctaaaagtttacttgtgaatttacttgttatgcttgtaaaattgacagaccatttactcccgtgttttatacgtactaaaaaggctttaaagatacatttataataaacttttacatattttgatacaattatatataatccaacatattatctacattccatcattaactgcaggctgtcaacctgctgcatagaacctttatgggcataggtgtgtgtttctttaacactacctttgcctttgccattttttattttaaacccttttcaccatggcactgtagctgatgcagtaagacaaagcaaccttgccatagcatcatgacacaaataggggctcgctcctatggcattgccaaagggcttagttttgggaataacattccagcaagtttgtttgaatactaaatattggctggtactagtcataatgctgacagtccaaacagaatgtatgcccagtagatgctggttgtatgaaccctgcactggagtgcagtgaacaacattcagcactaatgggtaattccaacaactttcaatgtacattgaaaagagaaacaagatgaatcttagaacacagtagtgcacaccatgaggaaaattaatatattttcaattaccttttgacgctgtaaagccttcagtggtgaaagagcccatttatacaacggatcatggacgaagacctggcatattacatatgttaccaggggaaattgaaatattgatttttccagatacataaaaagccttttgataacaaacatacttcaataatagtgaccaacgcttctttatttgccctcatgaccgaaagagttttctcacaacaccttctaaatacaccttcaacgccagtaactcccatgccatctatcatgtccctcgtcaggcgaaatggaacctgcaagtagaggtataaaacttaattcaggctattacaaaagaaaaaaaatggaaaatacgtacgtacatataaagaaaatgacaatataaaacatccattttacgttaaaaaaaaactcacacacaccagagtttcacaaacgtaaacagcaagatgacaattttaggaatacaaatatgatgcttcatcacatacccgttcaggagttttaagcatgagaccctgttcaaatgcaacaccaagatctatgtgtacaacctcagctgtctcttgatcaatgagaatattctgggaatgacgatctccaagtcccacaatatatcctacctgaaccgacaaaattgacagccagtgcttatcattctccagtaaccagtacagatccagacaaatgatttcatatactgctcattaactacaaagattaccattgagcttgctgccacacttcttgtgtaagcaagtctactttggaaccaatctgcaggctgcaagaatctctcaaggaagaagtggtgcatcacaggcctggtattacaggacaaagaaatgtatgtgaatgccatgttttcatgtgtccccatattgtcctagtagcaaatgaatataagagataacagaagacctgaagttgttgcagactttgacaaacgccctcctcttgtctttttcctattaaaaaaaagaaatgcttttagattggagtattggacatatgttgtcatggtataaatagcaaatattttttaaaaaagttccacaagtaaacatacatttgtcatggtctccctgcattgatgatatgtccagtctccagttccatatcttccatgtgctccaccacttcttgtactgtatggaccaaaggggaaaaaaactacataaatataaagcatttgtaatgtatattgcataaaatagcaggaaccgtgcacgcagaataccttcccacaagatattcagcaagaggaacagtcccgtttacccattcaacaacaccagcacttggggtgaagggaacaacctaagttacataaactagttaaaattttgtgtaaactacaaagaaggtataatgaaaaactaagatggacatgaagatatctaagaacaataatgaaaagaaaaggagcgaatctcttgattaaattcaaattcatgaattttgtttctaccttatatgtgcgaattctcaatctcctctcagatgtatctctgtgattttgcaagaacatatttactagactgaaaaattgttccatcacctgtaaatgtactcaatatagcacaactcattcatccacaagataggccattgctgaaaaaaatttctccacgcaattcatttcaattgaccttagcagacagtgaccaaaaatactgacagaactacaatggtagctggttgctatgtttacttcctgttgctaactcatcagtttggtgatagtctaanaatgtgagataataacactgtaaagcactatgacaagagataaagntatactgcaggcattattccaaaccatgtctcctttgtcccactaaacagattgcttacggtaggtaacagatagtgttctacgatatggtcaaatgccagtagcccaactgttttagtcatactttgcactagctgttactagcaattgggtacacactagttgctatgcaaatacatgtactaatcatttccctgaaatacatatgtagtcttgctaatgaagacaaacatctagggcacttatgtggatcacaaattaacacacagatagacatcccatgatgcaagtttaaatgagcagattcatagtacataggctaggagaaaagataaaataagaaagctagaactttgttggtacttgaaagctctcaaacaatacatggtaaatgcattcttgtaaaactttctcatgcttaaaatgtaggaataagaacatacagcatcttgtcgcaggtcatcatttccagattttgcgagtcgacgatatttgttaccatcaaagccaatacattcaataaccttcggagcattaattccattcattaccctaccacaatggaagagtcccaacagttaataaagatcaaaaggtaaatcttcagtcacaagtaatgggtaaattgcagaccaacttacataatagaatctgctagcccattaaaatgtggaaaggaaccttcttcatactgacaattaggatcgactggaatactagcagttacaacaggaacctaccaaaaccaaatagaaatggttcaaaaaaaaatgcagagaagtgaaatttctatggataatttgaaatggaccgccagtgctatcaataaactaaaagaatatggaatgaaggcaataatagaaaacaaaagctatcaaaattgctgtgacacaacgcatccgctagaatgttaggttttttaagtacataaaactatcttcttagtttcttcaaccaaagaataaaaaagtttataaacgaacagaacgaagcaattttgttccacctataagtttttaattcagagatttgagaggttctaccaagcactactagcatgtgatagcacaaaccagttatcccccatagaagtacaagaaaaagttcatagaagtaaaatttcccttacaagttcaagctgacaaatgctgcggatctccctaggtagtggaattcttttgttcgtgtcctgataataagatggacggcatcaatattttaacatggataatatggacaaaaatctagcacaagttgcttttgaaaagataactacctccttcttggtctctagttcagccaacttaatgtagatctcaaccatttgcttcatctacaagatgtgcaaatgaacataataaagagtacactttaacaataaatgcattttgacttccatctgagatgactgaataagaatatatagatatttgaaaagagtagcaaacctgacgaatcaaagctccatgagaagaagataaatcctttaacagattttcagcagcaagtttcttgtccatgtctacaataaaagaacttctactcctttgcttgtctttgacgcggtcaccatttgctagagccaaaagctgagtaccaaacaacatgcttaaaatggcaaaagagatgactcttaattctagagaatgattaaaatgcactgcagctgccttcaaatacataaagtacacgtaaatgagctaattgcagagtcatgtaagtgaa

SEQ ID NO: 46436 - DNA, 3082 bp, Oryza sativa
tggaagtttgttgagccttgcgcatcttttgagctaccaagtctagaagcaatttgatagaccaatggtatgaatttgtaggactggacctatacaataagaacatttccatgaagctgataaaagcaccaagagagtaataagtgaaatttgaagatttacctcttttgttgttttcatcattgctttcacaacttgctctcttgagaaaagactaaaccatagtgagaccaaccggaaaacctgaacgtatgtttagcactgctataaataacagtgtccctataccccgagatatacaaagagcacagcgtacaaaagaaactaaacaattttattgctgcaagcacattgtgactgaaacaggaagaactcttaacaagaaacgataacagcaatgacatataaaggacaatgggtgctttacaattatttgcaggagatgaatgcttcgcattaaatgttaaaagaataccagagcaactatgaagcatattgtgactaacacaagaaacaatactatatccgaaaatggatgattgcaacttgcaatgataagcaggaggtgaatacttcacaccatatgaaaacatttttatagtgacaacacaagcatattgtgactgaaataatatgaaacaataacaagcaggagatttcatatatgaacaggattacatattacacgacattaactggcacctgccgattcaaagattataagatcttgaaatggaaatggcataccacttgtagatcatatttcccaccgacaacgagtgagcgttggtacccctgaagcgctagattcaagaatttgtcccgatcatcctaataagagagttcagtgaatgtttaaaatagtaggtatacaatgcagagcagtaaacatgcaccatcgtatttcaaagctagaatattgtggtggcctgttctcctaaaaaatattatgtggtgtcactccatttgatattgagagttcaaatttcaagttaaatcaacatcctaatatataaatgagtttggatttgctgctcctattggcaattccaggtataaatattacaccattttaccaaaaatttcaaaaatcacttattcattttttttcaattttttgaataaatatagaaattaaagaaatgtagatgtataaatgcggaagagaggcaaaattttcagtacataaaattttgagtgtcaactttactccttaacctgtccggttttgtactggaatgcaagcattacactctcatttttctaaatcaaattattcacgcttgtccaaggatgtggctcttgtaattctatgcacatgcataatttcaaggtccaacttgtcgatattaaatactgtagatgacaaaaaaaaagggagtagtacaagacaatagcacatgatgcaggttctggataactgaaaagagtagtacaggagaatgatgcatgatagtggcaataatgtttgttaccttgctgcttttttgaattttagcgctaaatttggcatgtgtgcactgtgaaggcataaaatatcatccaggtgtttttgttagaaatttttttagaacaccgcatcatgcacacatagaaaaatgaacagtgtggttgctgtggccagaagcacaatatttgtggatatatggttattgatctggttagtactattgatatagtgcgtgatgaatttgtgatagcagcaaatgctatatttaagttggagtcaggacctcgatgttggataggtctgtgaccagataggcgtattgaaaatttgactgaatgcatcatgagaggcatattttatatactttaaactacacatgcacacctgaatcttccctgcctcttcttcgtcaagtgcaagttgtttctgtaactcttggattttcactgagtaatcagtcttttcactctgaaaattttaaggattagtatgcagtagccaacagtgcccatgctccttgacattttcagacaccatgaaaaaatgcagtgcttacctttgatgaacttttaagtcttttcatcagtgtatccagctccttagactgcattaaatagaaaatgtattgagatatacagtttcaagttcgatatcgatatgatgccactgtcaaacttagttccttaccttgtattttcttaatcgcagagctgcttgccattcgttggatgaaagtctttcctcatagcttttgaataagccatctgtgtaatgcgctagatggaaatatgttcggcactgcctagacttgtactttttgtctgggcacttgtgcaattcagtaaaatctacggaatgccttaggtagtcatcaatgatagttcttgaactacaatatatatatacatatatcacaaacagaaaatagagaacagttctcaatacatgaaacaagtgcaaagcacaaagtagaaataaatggttacttgctcgatcttgtttcagccaaccacttgccgactaatcgatagacatctgatacattcttcttatcaggatggttctttagaatgtatttcccaagatttatagccatatcatgctgcccttgagctctcagcagtttagcttcttcaagctggagtgtaaaggcaggacatgaacttcatggatcacagataattcacaacatataagcaatatatataaaccaatatgtgtaatattatcaacaaaggcagcttactttaggttttatttttccaaaccactataatattattatataggaaccaccaatcgaaaccagtgaaccagtgggcttgctggttcgagcgattcccagtttcaaagctatgataacaattctatgggcaactttagtcctatttgttttacatggattttataggaaacagggcaaattctctagaactatagagctcttttgtccccaacgggacactaatattaaaagatgacttatcaacaaatattaaaaagacaaggccgattaagaactaaatgtgtactggaaaggctacatggactgatcatttaaaaccagtactactagtacttaatttgttgggtacgaatgtatgatatgagaacagagggtaggaacctcat

SEQ ID NO: 46437 - DNA, 5439 bp, Oryza sativa
gggagtacataaggtgattttttttaccttaaataggaaataagaatttggcatagcttgatgatccatgtggtaacgaagttctttgagttcatataaagcagctgcagccaaagaaaatcttgctccctgaatccagaaaaggaaccacagaattattatgagaaagagcatgaaactgtgactgcagttaaaagcagcaagacaaccttccggagtgctgaagcagattgaaataaatgttctctgagatgctcttcagaacctaagatcttaaggacggcactgcggaatgctagaaaaggttccaaaaggtcaaggttacgttctgtttgacacaggatgaaagtccactctttattcagcagttccaactacaaccaaaatatgtaggaaacgattagttcacaaggaaaattcaaatagttaaacaaggaatgttaaagagtaaagacagtggtaaaccacatatacatatgtgcattctcttcagagataaaagacttaaagttgttttctcggccaaacaaactcaagcagcttagtatggggaatgaaaaagaacatgtacatgtagctattctactatcttaggcatccaaagtgatttacaatcagtgggaggatacaaaagtcaatataagacagtgactggtctgtatcaacctcgatgcacatttgacagtgttacatgtatgtgaaggaaaccaattgtctattttgaacagaagatcatgtcagaactatctccataagaacagacaatgcatgctaaagtgttacatgtataatgctgtgaaacagtgggggtatttcttgcacatggcaacctttttcgcgaacgcttgcacatggcaacctaaaaaggttacataaatagatatagacacaacaacagttcccaaacttacatctgaaatctgaatgtaaattgagtcgcatttatttcaaacaaaataatgagagaactagccaaaatattatatatgactacaacagatgtgaaacaaacctgcatccttgtaggaacagttggaactggagaaaaatccttgtttccaacataagactttgatgtctgattgagacagaatttccatcgtaggtcccaagccatagtaagatgatctaacatctataaaataacaaaagagagtaacaatgtacctcataccaagtatcacaacaagtatatcattgtaagataacaagccagtacctgtagtttgataacagtagaatggatgtattttgtgctctccttgctagcatttgaaagagccagcacaagatcctaaaaggggataaaataataagtattagaagctagattcacaataaatccaacagagggaagtgaaccacagatgaaattaaataccatcttggagttagaaagcttcacatggaactcctcggaatcaccattctgcagagctcttaagcaactaaagcatggagaaataagttgtatatgagaagttaggtaacaggtttctattggtccgaagttagaactatttttcaacaaacccttgtttcatttatttcaaggatccagtaagccgaattaagaaagtacatgtattaactttgtaatccaacaatcaacaaagtgcaatgcacaccttctaatatattctagatagaatggcataaatagcacaattatattatgtacggatctgataatatgcatctaatatggtaaaaaatgcctaggtccaggtcgtacctatcttgcttagtcagttcatgccactgagtccttaaaattcaatcgaaggtaacaggttctacaatactataaattattaaccatgccttttgtttctcaacagtcaacacaatactaaagataataagctattctttcagctataaatatgcaaaagcattgagatgtgtaacttaagagtaaggaaaattagggacctgtgcaaatttccattgaaaaggcagtaactttgggaatgggtagaaggctgagaagagtatggaatgaaaaaggagaaatcccaatttccagctctccaagcagcttcatactgcatgacaggcaataaaaattaggccatactactggaaaaaatgttgcaggatgtaaggttatatgaaatatgtactaacttgcatatcaataaattctgaatcttgttgaagacaacttttttggttgcttaaaccttggcagtagacatcaaggacatgactacatccagtcttctgcaaagatctcatcagacctttgtgcatttgccagttcagcatcttctcttcagctttagaaggcacatcagatggtccagtcaatgctgtcccagccaaactgccatggttctcctttcgagttgatcttacaagtaaatcgtgatattcaagagcactactccaatcaccctcatgctcatatctaatgatttgtgaagttatctgctcaaagagaataataacgacaaacaagaggaaaacataactttaagatcttaacacttaaataatgggtctacacatgtatatctgatagccctaacttataagttcatacagaaatgtaccatgaccaatgaccactttaagaataacttggagttcatatagaaagtatgaacctaagcctaccaaaactcaacaaaaaatagtgagaatttttttatgagaaacctcattcgccagtgtgatcccataaatgctgtccagctcatttatgcgagtaaatgaagcaaccagtagatcaatatgtgggggcaactgtaaaaaggcaagaaacataaatgggcatgtggcaaaactacggtagagctaaaatcacacacaagaaagtaatagttgaagaaaggataagagacagaccgactcttcgtgcgaaaaatctggaggtcctaatgctagcatattgaatttttcctcacaccaaagctcaacatacattagtgttgcaaagtcacatgagcacctctgcaatgatccagaagttcaaaattaatacaaacaaaggaaacaggagaattgaggtacaaggcatttcaatcaccagtggcacatgtgtaaaaagtgcaagctcaagcatgaagcacaacaagcatttgcatggcctatagatgtcttcatggcccattgctagtccaaataaattctcgagaaaaaaaaactagtccaaataattattttgctacgtacaacgaagagtagtagggtaggaataggattgggtacaatggggtttcaggtgaaagagacgaccccttgctagctttaaggagcttgcagaacccatgcaaaacagcacaagtgttgtatcaatccagccattgatttttttaacaggaaccaaaccatgaactggaactagaatcagattacaaccctaagagttatgtggtagatgtatctttgtctgggctaaaaaggccattaggattatagtgtcaaatgcaatacatgtatctctgttgagtgttgacaaggccaagtggaaaatctagcctaaggttggcctatgatgtcttgtgtatcatataatttacccatgaacaacatgtccagttttgaatggcctctaaacttaatatcaagttccagaaaatattttgaatgtaaagtcgagtctggtataatacagtacaaaggaactaaacagcataatgatgtagctgtgggcagggtagcacacttacattagcagctctggcagccacaagataatcaactgaaagccagtacacctgtcgaataaacgatgtgttaagattctggacatcagctgcaaaattttccctagcttacaacctccaatcacatgtgccagctgaaccacagaaaaatagcaggtccattgaagcataggtaaaagcaaaagctctttcatttgcaaatagccaatcaatccttacaatagcacaagaatctaccttatgcatacaataatccatctagaaagcctgacataacagcaaaaaagctaaatgctggaatcatttgctaacagtaacatcaattgaattcaagttttccaaggagtgtacaggactatagtcatttgtacttggtaatcacaatttttttccgaaagaaattagactgacaatgccacactcttatgcactgctatactatgacaataaaaacagaagaaacgtactagcaaatgttactccaggatgtgtgtgtgtgtgtgcgtgagagagagagagagagagtagaataaaataccttcttccaggaggatgatggggtggtggttggtgatcgacttttggatctaacagatctaccatcctacaaggttcaatacgtagttcaaaagacaaataaacagaaacaagtatatcaagtgctcaatattaatgatgaaaaatattactccccctgtcccaaaatataacaacttctagcattcaaaaattgtcccaaaatataacaacttctcacctacattcttttctcaaccaatcacaaccttccacaattcaaattctccacctacttttcttctcagccaatcatactttcttaatacccgtgtctaagcctaaaactccttattttgggacggaggtagtaatagagtaacaatgacattacaaataacatctgtgtattgattatgatatgataacatatatttctttcctgacacaattataaattaacagtaacagaataccttgagagtatttgaagggcaacctctggctttttctgcaacataataagacctgacaacattcagcgcatccaaaaacagataaactgacttcatcaaatgattggagtcacaaaatattttttcctccacctaaagtaaaacataagtcatcaacagattggcaataatccaaccgtgcaaccttcaagtaatcaaataacttgggatgcaacaaaccatagatgaaattaatctgcagatgccagcatttgaatccaaattgcccgcaatgttcacaagagcacttgcaagcaaaagttcagcaacctcaactttgagaaaagcaatactcctacaaagtctataagaagaacatcatttcaaacagcaacaatacagtcacattgaagaagatgtgttaagctttagttactgttacaggtgtatttctcagttgaaactggtacctcaagatgatgtcatcacaatgacaaattagtgagcccaccaaggtgcatagccattgcttgtaagtccgaccatcagttctccataaatctgaatcttcaagtgaaactatcgagccaaagtttggcaggaaaaaagagagaataataaatgtcataccatagggagcataataaacaagcactgcaccatggagaagcttgttcaatagtgttctacattatggatgctttcctaattaaacaagacattacatcaatgtttttttataaaaaaaaaaacggatgcagtgcaacacccttttattctcttgttttaccaga

SEQ ID NO: 46438 - DNA, 727 bp, Oryza sativa
cgggatcggcaccggcctccccctcacaatccctgcaaaaacaatttgaaaccaaaaaaataacttgacttcaattcgaatatttcttggaaatttacaccgacaatttgacaaatcggatttattcaaagtttacagcaaaaaaaaaattgatggttttgtcctcataatttggatttgtcagaacttacagttaaaaatttgaaagttttgttttcaaattcaaacaattcataatttacataaaaaattgccaattttttattcatatttcgaaatagttcaaaagttaaagaaaaaagaatcgacagttttgtcttaattcgatagttttaaaaaagactacagtaaaaaaattgacaattttgtcttcaaattgaagaatgttgtttggggcggtttgaaatttgggagaatttggttggggggatttgggtgattttactgtcgaagaaccactcctcgcagtccttgttgttgccggagccgatcatgtactgcggccggaacgacgcccagctgccgaactgctccgcgatgtacttctccacgcccacatgccccgcgctctccttcaccgcgtcctgcatttgcacgtcgccggcgagccgacatggccggagaaagtcagtcagtgaactcaactcatcgagccaatcctccggcgaatctggttgttatgtttctttaccccctcgacgtgcggcggctcgtcgctgggcgtgta

SEQ ID NO: 46439 - DNA, 1112 bp, Oryza sativa
actggccagccgatacaccaaaagcacattttgtcggattcatctttaaaccatatttcctagtcctctcgaaaacctttctcaaatcggctatgtggtcctctatttctctagatttaacaaccacatcatcaatgtagacctcaaccaaccatccgatcagatcatgatatatataattcatagccctctagtacgtagctccagcgctctttaagccgaaagtcattacaacccattcaaacaagccgatcgcaccaggacacctgaaggctgtcttatggatatcttcttcggccataaagatttgattatatcctgcgttcccatccataaaacttagtatcttatgtcctgaagcagcatcaaccaactgatcggccactggcatcggatattcatcctttggggtagctttattcaaatccctgaaatcaatgcaaaccctcaccttaccatttttcttgataacaggaactataccagaaacccattcagcatatcggtaaggacgaataaaaccagcatcatacaaacgtttgatttcagccttgacaggttcaagcatatcggctttgcatcttctcggaggctgctggtgtggtctaatccctggctttaaaggtaatcgatgctcgacgatcgatcggctgagtcctggcatctcataatactcccaagcaaagcaatctctaaactctttcaaaagctccatcagcttggttctaaattctgaagacaaattcttactaatgaatgtcggccttggtcgatcacccagacctatatccacttcttctaaatcatcggccgacataaaaccctaaccttgcttgtcatcgagatcatctaccgtgtccttggcgtagacgcttgaaccctccacgacgccctcaaaataatagcttgggttcttcatcttcaatcggctgtatatcagaatcggacacttttagaaaatctccaacccaaatcttcctggataaacaatcaaggccatccatctcccaaagagctagatcggcactagcaacattaactgacctgtcggctggtacaatctcaaccttgtcgccttgccattgaatcaagcattggtgcatggtcgaagg

SEQ ID NO: 46440 - DNA, 949 bp, Oryza sativa
ttggttgaccagctcccattttgatttactcaactatctctgtctgtcttcccgctctaaacaaccagcctttttgctgtttagctatccaatttccaatgcattctgaaattcagaaaacacacaatttgtgaactttgctcgagaatcctagaagtctgggtctcatattctcattagccaagagcactttcattattttcagtggggcacacataatgcccatggattccatattaggggtttatgtgtacattttcatctcaaattcacttttcatggaagactcatgtgggcaaaacatccacattgaacttagtccggtttgtcaggtcaggtactgtgctccttttggcatgtttgggaccttgagtggtccattttaaacaaattcagaggctcttatatgcatttctaaagtttagacatcttgaccacttgagacaagtttatggtcagcattgtatttttatcatagaaaaagataacacaattttttccgtcaatgccaggatattgtgcattacatgcggacaaattttgcatgttccaaggcagtttctggggtcattttgcaggtattctccctgtccctatcttcttgtttggatgcgaaggggtgaagtgaaaatatttgaatgtgaactatgataggaagttagggacttcctccctaaataacagaccaaactgatgaatttgtaacctgttgagaataattgcttttttatgtgtaaatccatgtaaacggtatcttgattcaacttctatgatattcaggccccagtaagtgacagggagtatagagcaacacttccagaaactgcagaaatgatagatttggcagcaaaaatgttaagtgagggccgtggaatggatttgatgcccagggaagcaaatccagatgctccgattactgcctacaggtatcaatttccatgcctgagat

SEQ ID NO: 46441 - DNA, 1137 bp, Oryza sativa
tgtccggaccggattggcaatggaaaaacacgtgtcttttcagtcgtgcttagataaattaaataactaaccaaaatatgttacgtccgaatttcatccagtctgtccggaccgggccgacaatgaaaaaacacttgttttttggtcgtgctaaaaaaattaaatcactgttatttaattatatataatttttcatgcggtctgtccggacaagatcgacaatgaaataacatgtgattttttgattgtgctaatataatttaaataactagtttgacggacaaatcaaccccaaatcgatctgaatttagcaatttatgcctctccgaaaattattttcttctccctccactctttccctccttttttttttgctcccgcaatttttttctgttttcttttttttgccgccaacttttttttttgcccccaccttccccatcgagaaaagcaagccaactgcccctaaaaatctctttcctctatcctgactccctgagtaaatctctttcctctgttgtgggattcccctttcctacgaactctcctgtcgttctacggttctcctcctcgtcttcatcggtgttgatctgtaggtaagatgccgggcgctttactgacccaccgccccaagcaggcgctcctagatcttccaccgctccgctccgtcggctgctgtaccagccatcactgctgccgcaccttcctgccgattaacagccacgagcaggcgacccccatgccccatggatgatgtagggcatgcggcgggccggagacgcccccagccgatgtgccgggtgaccggggcactgcaattgatgcgggttatacctcccgacaccggctgtccacttcgctctgctccacgctgcgcggctggcggcaatgtttccaagccccggaatctctgcctccctctgcacatcttactacctctctgagtcgccaaattgcaatggaggctaattcccttccaggactacaatacttaccaatttgatatgttgtattttcaggtttggagtcagatgcactgaccgtccatagctgaaggagcctggtctacgtacagctaggcttcacacaactgtaagcaataaatatgtgatctagttttaccttgcagccaattaa

SEQ ID NO: 46442 - DNA, 1295 bp, Oryza sativa
atgtgaatgagactaaggaagctaattgcaacaatgtcccagaaggtgtgctttctgaccagtggattgctcttgtcaatcattggatgaacgagaaatcgaaggtacatataccatattcatttctgtaatggtcttacaaattagaactctgtactaaacaaaacaatgcaatattcttttttgattgctaactctacgagaccataacagagaataagtgagcagaataagaaaaactgccaaaagaagaaggcaattcacacagcagggacaaagagttttgctcgcacaagagaagagatggtaaaacatgtcttgaatagtattcatctatttccatttcaagcatgtatagctagtattaggactttactgatttggtcatgtgttccatagagacaaaaagatcctgcaaagaagaacccacatagagctgttgtttatgtccacacacacaagcgcaaaagtgacaagaatataaatgggcatgtggtatactattaacactcaaccatagatatttttcagttattctcatatgttgttttatttgtattaatttttcatatgtttaggataatttgaagagacttatagctgaacaaccagctttagcggatgctagtaaaggaaagactgcttggaaaggagatgcattgaaccaaatactaggagatgacaagcctgggcgtgtgcatggtcttggactagttccaaagcctaaacaagtgcttgatgtgccaacttcccgacgttgcagaatataaatcttactacagtggaggataactccagtgaagatgtaatggctattagactgcagatggaaaagttagaacgccatgttgagaataatgatgctgaacttttacaattaaaagagaaggcaaccaagttggaaaaggcacaaaagaatcaggtgaatttaagggagttgagtcttaaaaaaattatatgaacttgtgtgtgacccaatgaatgcatctaacttacctaattgaagttacagggaggtttagatggagcatctacaaataaaaaagctatttgtgatgacgtacctaattcaaaaaggagggtatgtatctttatggaagaaatatcataacattttctgcattatctcataaactgtggtatagatctctgttcattttctgttatggacagagagtgtatggtgacaacccctcgcaagaaatttgtatgtttgaggagggaaacattatggatcagcaggacaacagtttgatggtaatgtgatatagcaccatcttataactgggaatagc

SEQ ID NO: 46443 - DNA, 1288 bp, Oryza sativa
atcggcttggttgacattatgccttgggtattattctttgatggatctgtatgcagtcatggttatggtatcggcttggttataattgcgccttggggggcaagttttgaatttgcctatgctatcaaacaccgtgtgactaatcatcaggctgagtatgaggcggtcttaaaagggttacagttgcttcaggaagttgcagccgatgctattgaaatcatgggtgattcgttgttggtgattagtcaattggcaggggagtatgaatgcaaggatgatacattgatggtttattatgaaaagtgccgaacgttgataagtgaatttaggatggtgactttgaagcacatatatcgagaacagaatatagaggctaatgatttggctcaaagagcgtcgggatataagccaatgacaaaagatatcgagatagagattgctacaattacagccgatgattggagatatgatgtgtttcagtatttacagaatccatctcaatcggcttcgcagaaattgcgttataaggccttgaaatatactttattggatgatgacctctattatcggatgattgatggagtgttgcttaaatgtttgagtgccgatcaggcaaaagttgcaatcggcgaagttcatgaagggatatgtggtacacatcagtcggctcataaaatgaagtggttgctccgacgtgctggatatttttggccgacaatactggaggattgtttaagatattataaaggttgtcaagattgtcagaagtttggagcgatccaaagggcgccagcatcggctatgaatcctattattaaaccgtggccttttagaggttggggaattgatatgatcggtatgattaatccaccctcgagtaaaggacataagtttatattggtggcaaccgattattttaccaagtgggtagaggcgattcctttaaagaaagctgattctggggatgctatacagttcgttcaagagcatataatctatcaatttggtatccctcaaactattacgactgatcaaggttcaatttttgtatctgatgagtttgttcaatttgccgatagcatgggaattaaattgttgaattcttcaccgtattatgcacaagctaatggacaggccgaggcatctaataagagtttgatcaagttgattaagaggaagatttctgattatcctcggcaatggcatactcggctggctgaagcattgtggtcttatcggatggcttgtcatggatcgatacaggttcctccttataaacttgtttatg

SEQ ID NO: 46444 - DNA, 1504 bp, Oryza sativa
tatatatatatatatatatatatatatatatatatatatatatatatatatatattggaaacttggaactaccgttggatcgaaaaatagacatccgtgattcatccatgtcatcatgagtaaaagttttacttgcgataaaatttttacttatgactaaatccgtgagtaaaatttttattcgtgatgacgtgaacaaatctcaaacatctatttttcgatttaacggtagtttccagatttccactacatatatggtttccaccacagattttccccacatgttgaggggatattttgctagttggccatatttggcacttccatcctcgctcgatgagtattatcctcgatacttctaccgtcattatccaacatgtaatacaggttttttaccatcgtactaaaaccaaaagtacctttttaaataatataaaatctataaaatgactaatactacctccattttagaatatatgacgccgttgacttttcgcacaaagtttgatcatttgtctcattaaaaattcagtatgaatatgtaaaactataggttaatattatattttatttgatgataaaacaagtggtaacaaaataaattaaatttatatatttttttaaaataagacgaatggtcaaacatcgtgtaaaaagtcaatgacatcctgcattttgaaatggagggagtatatggttagcccaaaagtacaattttggaatatataatattgactaatacatagtccaaatagaaattacatcagtatttctttttgaaaacagaaattacatcagtatattgtcactatggctgcgtttagatccaggggtgtaaagttttggcgtgtcacatcggatatgctgacacacatttgaagtattaaacgtagactaataacaaaacaaattacataatccgcctgtaaactgtgagacaaatttattaagcctaattaatctgtcattagcaaatgtttactgtagcaccacattgtcagatcatgtagcgattaggcttaaagattcgtctcgcaatttacacgcaatatgtgtaattagttattttttcgtttatattcaatacttcatgcatgtgtccaaacattcgatgtgacaaggtaaaaatttttgccaggggatctaaacagggcctatgtaatcttgatgtagtgtagttaatcacaacgtgcttatgagcgcgtaaacttgaaacttaaaattctatctactatatagacataaggaggaagagatggaaatatttttattaaggttacattgaaattggtattgatctattcccatataatgtcaaacatcaatgatataacctacctagtattgataacataacaagggtgttctacattgacatggatgcaatcaagtctcccttgctactttgtacaatctgattttatattccccaggcatgcacatagaacaaaagtacagtacgatagaagatttaaaaaggatgtgcatcaatcatcttgggtaa

SEQ ID NO: 46445 - DNA, 1672 bp, Oryza sativa
attcctgcagccccgtctttatgtgctgaacaaatcatattgcaaaattattgtcgtaagaaagtgctattgaatttagcaatctataagattgtaccaataaatgagtgggtggttgcaaagatttatattttgaactagtggtaaacaaaaaagaaacaccatgtaccttgacttcatggtatagttttttctcccatgcaagcagcttatcaagagtggtagcatgtgtctcccattcgtcatcgtccatttcattcctcacattttccggttgaggtatccctttaaacgagcgattccaagtgattacttgcatcactctggcagaatggtccacaaatcctagcaagaccgaaagggatgccatttaacaacagaaggaactcaaatatgtaattcctatttttttcgaggaatggttctcaaatcctactaagataggatgcaaatggcatttacgttaacaatggaaggaaaccaaattaacctgagagttctcaaaagaagaaaaaaaagaatgctgagtatgaagaaaataatcacagcgagcactaaaaaacaagcaagacagagactgctcaactgaacttgaaagtgaatcatgagaatacaggtcatcaacaatttaaatgtgaaccccaaacaactcattcccctgtaccctgtgacccatatgtgattagatgctctgtccggttcttcgctttacccgctaaatgcggctccactaccataaccattccattggcccattccaataattaaaacaatgcaatcattctgttgttcttgacagtgcagattagtaatctattcaaagtcttaatacaatcgtgtggaacgggttaacttcttccataatcaccaagtcaccattaataaaacgtatctgaacttctctatccaatcttgctaaagcatattccccgaaacaagtgtactgattattttactcattccaatgagtaatctgaaatggtagataagcagcaagtgttctatctatctagtatcacagtgaaaaattgaaaaagattgtaaagaagatattttaattttgctgttggtttgaaagtaatctgaatcgtgaagtgaattcatcgtgttggtttgaaaattgaaattacctcgcgtctcagcgaagttggagtggtagtgcatcctggcggcctcgagcagcttggacacctcgtgcgcgctctgcgacgccttgaggaagtgttcgtccagggcgcggaggatgtcgccgacgcccagcttggccggctgcggctgcggcggcgccaccagcatcaccgccttcgccttccccttcctcgccgccttctgcgtcatcgcccgccgcgtcgtcgccgcctctgccgcggccggcctcttgccctccgccacctctctcgccgccgccgatggctggtgttcgtccggcgcggggggtggtggttctctccgctcggccgacgccgaagacgatggctcggcggcggcggtgtccagagtgggcggcggcatggagtcgaacaaggagctgatgaacccgccgggggtgtccaccttgtggtcattctccggcgggaggggaggcggggagcgggagggaggggggcgctgcgaggggagcggcgggggtggcttcagttcggcgtcgtcgtcacctcgccgtcctcccgcg

SEQ ID NO: 46446 - DNA, 1156 bp, Oryza sativa
ctggttgttttcttcttcggtggaatagccttttttggctgcttgccaactggcccatcgtcactatcgtcatcatcgcttacgatcatcttcctttttcgagaaaccgtttgactgggcggaatagcatctcttttgggccacgggttgaatctttggacccccggtagcttggccttggtgatgccacggagaacgacgttgagcggttggagggtcggatttcattagggcatttccctatggataagcaattttgagattattcccaagaatagcatgataaaagtccaagcatttagatatttaccgctggaggaggattgaaggcgttgtatggcacatcggcagcaaatgtgagaagctgaccacaataccagatgagaagattttatacatcctctccttcatgatcttgaattcgagggagttggggtcttctcggttgggatcagtctttccgtcgtactcgaaggccgtgcgagatctctctttgattggagccagtcgacactttatgaagtgctgagtaatctgctcttcttgaaggccttgttcctttagcctcagcagtcggtccagcaactcaagagcttgagaagcttcatcgcccataggaagtgagttctagatgtcttgatatttcagagggcagcatgaatattcgtgtagcgcaggatctggcttttggatgtaaaaccagctagcatgccagcccttattggaggttttgaagggaagagtgaagtacttctggcatagggtgccacgaagctggaagccggatcccccaacgatgcagggcttgttcttatcggttggggtttcagaaaaaagattcggcaaaataaggcgaagtttggccaaatgcccaaaaaaacttcacaaagatggatgaaatttgctatatgaacaatggagtagaggttgaggtgatagatattgatcctataaaattcaaggattcccctaaagaatctggatgttggaagagcaaaaccaccatagaagaaatgggtgaagacgacaatctcgtgagtatcgggggtcggaaaagcctcaccaaatgctggatgccatccgatgttctccttggctggtaacaccccgtgcgccatcatctccttgagggtttcctctatgacgtcagaaggca

SEQ ID NO: 46447 - DNA, 775 bp, Oryza sativa
cttgtcttacaatttacgaacttcttgtcgatatgcagccatattgtcatcaagacaggaccaatccttcatgacttgattgataaccaactgagaatcaccacggaccaccagacgctgaatccctagagatacaacaatcttcagcccatggagtagcgcttcatattctgccacattgtgagatgcttgaaagtgtatccatagcacgtagcttaacctctctctagtcggggaaaacataacaacccttgctccagtgcccgagagtctttttgacccgtcaaaatgcatagtccaatactccaatttctccccaagtgtatcttcctgacactcggtccactcggcaacaaaatctgccagggcttgatacttgattgacgttcgtggcttgaaggatagatccaaagacatcaactccaaagcccacttcgcaatacgtccagttgcctctcgattatggagtatgtcgccgagtggaaaagatgtgactactgtgaccgagtgactttgaaaataataggacaatttcctgacggtaattaaaacaccatataataacttttctacctagggatatcttgttttggagtcggccaagaccttgctaacgaagtaaattggtcgttgaactttttgaacatggccctcctattctcgctcgacaaccaaaaccatgcttaccacctgcgatgttgctgacacatataatagcaatggttcttgcggatgtgatgaagctaggactggtggagtcgtgaggagtctcttg

SEQ ID NO: 46448 - DNA, 1800 bp, Oryza sativa
taggtgtagtgtgggacaaccataaatttggctaacgccgggcgtccaagtatagcatggtacgctgtctcaaagtcagcaacttcgaaacaaacgttctctgtacggaagttctcccgagtgccaaaagtaactggcaaggtgatctggccgagtggggttgaagacaaccccgggatgactccatggaagggcgcaccactcggtttcaactcggttcgtgggatttgcatctcgtccagagtcttggcaaaaagaatattgagtgcactgccaccatcgatgagggataaccgaagtttgatgttgcgaaccactaggtctagtaccagggggtaccaccctgggtggaccactcggtcagtgtcacgcccggaatttctatccaaaattccaaacgcttacatgtgtgtaaaccctcgtccagaaatcagccgaggcacacaataacaaattgataatagagtacaattattactctaattaataagcgaatataaagtcattacagaggtagatagttcctctcaaacaacaaagttctaagcagcggaaaataaaagaaacagcacaggcgactcctctccacaggcagcttgaccagggctacgcctaatcatccacaccatcagcatcactgtagaactcctcctctgatgaatgactgcaaggtgagtatatgacatactcagcaagccacgcaacaaatatgcaagtgcaatggataacgaaggatggcataatatgggctcatttgcataaacagcatttaataagcaattgagagaatagtaaaacagttgagtaattaaacaatattaaatcaacactatacaatacacccgtgttgcataggcccaaccattctgaacaaccaatcccggctgcacagttctatctccaaaccaggaatataccattccaaaccaggagctaaacaagttattaacatcatcatttaatatagtgagaagtgtgagactaatcacgaaagacattgttagacccgcccataaccgcgggcacggctattcgaatagtttaaactctgatcagaggtgtaccactgtacccacaagacacaacctcaacatcatgtcaaccatgcgtcgcgatacttgacaagtacccgaatagagattgtgacaatacctcctgcataacacaattcaaagcagtgcaccgttcctggatcataatcacccccttataaacaaggcatggactccccagcgacccccgtgggcttatctccgccacttcacagtctggtgctctacaatgaaccacactatacagaaagtaaagccgttgcccacgctggcttgtggttcgcacgattaatgtttcacaaccgaaaatcgtgaaccggtccttaattgtcatgagcacgaccatcaaaaccatgtgctcacaacccaccattatcaagttttagttggcaaattaattaattaaccaatcacgatcaaccatcgtgagctatcattaagccatcattaaataatagtgaatcataagttatcccatttatatgagctagtgtctctaagcatggctaagcatcctaatcactttagctaaaaccatataatgttctagctaatccaattattaactaggtgacaaagaataggtaatcaacataaaaaggctataacaaaggcaataggttatatccacccaatgacattcgaaaataaatgcaatagttgaatagaaacaatagctttaaacgggatcaacatgctcaaagggttgtttgggatctgtgtgacttgccttgctggccttggaact

SEQ ID NO: 46449 - DNA, 2902 bp, Oryza sativa
tccaaaagaaattagccgatgattccaaaagagaaaagatagaggagatcaaggcgatcatttcccctctattgatttcaccggagaaggaaagacgcgatcgaattggaagggcggcggcggctacgcgcggcgtggctagggcacggcggcgcgaggaggaagacgagtccgacaagtcggccccaccttacagcgggcgagggcgcacgcgcgtgggctgactgggctggggaaagagagagagagagagagagagagagcttttgggccgactttcggcccaaagccaaaaggagacttttaaaacctttttcaatttaaattattcatgaaatgcaattccatttattaaaaatgcttccttggctcaaataaatcccagaaaaatctaggaactatagaatcaagtgaagtatttaataaaattttatctggcccacttttatattggaatttattatttaaaattagatcttctcttctaggcttttaaaattatttctaataattccaattaaacaacaatttatacatttgggatttttagggtgtgacagtcagggtgattcgagtagtcaaacttaattgctatctccgaccacccgaaggtattgaggtgtgtccgactgaacggtattgatctccttatcagttagcttctgcttccgtttggactcataggcttgcggcccaaccaagatgtgattgagctccttacgagaatcttgaaaaccaggtgggccatcgtcatcgtcgtcctttttcttcgaggtgctttgctctccatcagtcagcttcttcgcttgtttggcatattgttcggcaaactgattatagatgaaacaatctttggcagcatggttggaatttgggtgatgcgaacattgagcattcataattttgtcgaaggtgttgactcgcgattgttgacgggaagaatgtgttgtagtcgccaccagatcctcgggcttccgcttgtgatctttgttatgagtgccgcttccactcgcccctacggttggtccatctttcttggatttctagtggctgcccgactggttggaagcaagaacggcttcgtcagcctttgcatactcattggccttctcaaacatttgcttgactatcctgggaggcttgcatccaaacttgccgactagaaggtcattacgaactccttttgtgaatgcggctatgatggcatcatctgtgatatcagagatcttgttgcgttgttcagaaaagcatcgaatatattcccgaagggtttcaccgggcttctggaccacgttatagagttcaaaacatgtgccgggacgctcgaaggtgccttgaaagttggcgatgaagtgatctcggagctccgcccaagatcctatggtgcctcgtggtaacccatgaagccaggatcgagcagagtcagctagggccactggtaaataatttggcattgccttgctatcttctcctactgcgcggattgtgagaccgtagacagtgagccatggttcaggatctattttttcgtcatacttctcgatgccagtcggcttaaaaccagccggccaatccactcgacgcaggtcgcttgtgaaagctgcgactccatcttcatcatattcgtagcagtccagggttcgatgccgccgatcacctctttctgcacagcagcggttaagtgtgtcacgtaggtcaatgggttgccagcgacatggcaagtgaggctgctcagcgcgtcactctctgtgcctatcggctggcgaatgaactaaatgttcatgatgatccctgcccccgtgagcagaccatgaccccccgtgattggatcttgaccccgcgatgctgagacttggttgatggtaatcttcagattggagggatggaacccgactgccagttggcacccgaatgctttccaggttgactggaactgatgcggcgatcattgtctttgtctgattgattatgttgagaacgtgattgggcacatcctctttaaggagtgtcagggttacgggttaggcataccccctacccttcgatatacgttacgtatcgacatggcatacccacgcgcacgcggatatttcctttatgatctaaggaaacctttcacgagatcaatagatgggaaaagtccttctcggacaagaactgggtcacctacgtatcgtgctaggtctggtatgttcgagtcccactcggagagcaccagacctgcgatataaaagggaccccccagggagggcatagatcatcgaatctcagtgccaacataacccacacagcctacgaagtcagagcctgcgaggagccaagtcgtcaagagctagtcgaatgagctcgactacaatctcgccggatctgacaagttccatcctttcctttgtaacctatgttttccaccgtataatcccacatcaattggattagggctattacctgtcaaggggcctaaaccagtataattcttgtcttttgattgctcgatgtcgtattacgtagatccttgtaccagcgtaccccaataccctctatatccggtctacgggtatcacccgtcgacagtggcgcgccaggtagggggacttggtactcaaggttctactactatgccatcaagcttcgtcgacaacaacatcaacaccagctccagccaagcactctcaacttcaacaatgctggtatggactcatgtcggcgaaatcgtcttcccggtttacaccatgacgccgatctcaaccggtcctccaatgactgaaaacgagaacgtagtggctacgaaccaagacggctccatgtcgaaaaatccacccgttgaaacggagaacggattaccgactacatccaaactcgagacggattctgatgcggccaaatcttgtccctccgacataaa

SEQ ID NO: 46450 - DNA, 2810 bp, Oryza sativa
tcggtgaccaacctcagcaatgcgttcgaagaggccgctaccgcagcacaccaagatcagccaccaaccggcgacgccaatggtgaagatccggagcggagggaattgcctcgacaggctacccctccacctcgtggcactagcgatcttcgagatcaaattaacaaccgccgagaagcacggcgcacacgggacgacgcaaatcgctctcggcgtcatgtttcttcacggcgccatgatcgaggaaaccgcccaaacgaggacccagaatgcacgatcgcgaacggcgggggccaaacaatactggtcatggccgtcgtcgcaacgacgacgacgaaggagatcggcgccgagataatagcgagagacaacgacaagattcccgggatccaggtcgtcatcctcgtaatcgtacgccggagccaagcgacccatcgtcatcgtcatcatccgcgtcctcttcatcgtcagacagacatccacgaaggtcatgcgaccgccgacaacccaccgcccctagtgctgggtgtagggctttcggtcgttcccaacgtgatgtccgatggcctgagagattccgacccggggccattgaaaagtatgatgggagcaccgacccagaagaattccttcaagtctactcgatagtgttttatgctgccagagcagatgacaacgcgttggcgaactatttaccaactgcgttgaagggttctgtacgtacatggctgatgcatcttcccccctactcaatctcttcgtgggcagacctgtggcaacagttcgtcgccaatttccaaggaacatacaagcgccacgcgatcgaagacgacttacacgcgttaacacagaactcgggggaatcattgagggaatacgttcggcgcttcaacgagtgcagaaacacaattcccgaaattaccgacgcttctgtaactcgcgccttcaagtcaagtccggtgtcagagatcgctacactacccaggagttggtgacaagacgcatcacaactacccgaagattattcgagatcgttgagcggtgcgcccatgtggatgacgcgctaagacgcaagaacgacaagccgaagactgggggagagaagaaaccagccgcagacgcatctgagtcgaataagaagaaaaatcgcaaaaacgggaaaaggaaagcttaagcggaagtcctcgcagcagaatacgcgaaccctcccaagcgcccagacccacaaggcagcgatacaaagaaatcatggtgccccatacacaaaacggacagacattctctggaggattgccttgttttcaaaaagtcgctcgagaagcacatggcgtttcaaaaaagcaagcgagtacgcgttgtcgagaagaacgaggagacacctcctcacgaatcggatcctgcgtacccaggctccgacctccacgtctcacacatcttcagcggctccacaacatactcctccaagcgggaatacaagaaagtggaacgtgaagtctgttcgacgtggtaggaggctgcacccaagatgaagtggtctgagcagagaatagagttctcggaagaagaccaccccaagacatctgttatcccaggacgatatccgattgtggtcgaacccactattcggaacgtcaaggtagcgcgagttctcatcgacggtggcagctcgatcaatctcctcttcgccagcactctggatgcaatgggaattccacaaagtgagttgacaccaaccgatcaacccttccatggaattactccccaatcatcgtccagacctctgggcaagattacgttgcccgtgactttcgaccaagccaacaacttccgaacagagcagatcactttcgatgtcgctgaattcgatacagcttacaacgccatcatcgggagaactgcacttgcgaagttcatggccgcatcccactatgcatatcaagtgctcaagatgccgggaccgaagggaacaatcactattcaggggaatgcaaagctggcggtgcagtgcgacaggcggagcctcgacatggtcgagcaaacgcccaccccacccgccacgtttgagccacccaagaaagggagcaagccaaacaagacgccgaagccggacggcgccatcaagatcattccgctcaacaggctaaccccgacaagactatcaaaatcggggctacactagatgagaaataggaactcgcgctcatcaccttcctccgcgataatgtcgacgtgtttgcttggcgcccgtccgacatgccgggggtccccagggaggtgattgagcacaaactcatggtgcgacacgatgccaagccagtaaagtaaagactgcggagatttgcaccagactgaaaataagccatacgagaagaactcgacaaacttctcaaagctggcttcatcagagaagtacttcatccagagtggctagccaacccaatcatggtgcggaaggccaacggaaaatggagaatgtgtgtcgacttcacagacctcaacaaggcgtgccccaaggatcactttcctctccctcgaattgatcagttggtggattcaacagccggttgcgagctattaagcttcctcaatgcttactttggctaccaccaaatcagcatggcaaaaaaggacgaggagaagacagcgttcatcacaccgttcggggtattttgctacgttaagatgcctttcggactgataaccgccgggaatactttccagcgcacggtccagggcgcacttagcaaccagcttggcaacaatgtcgaggcttacgttgacgacatcattgtcaagaccaagacaagcga

SEQ ID NO: 46451 - DNA, 3878 bp, Oryza sativa
tgagacatggataatggcgttcgatggcgcactcaacagccaaggagcgggggcaggatttatcttgacatcaccctccgaagatcaattcaagcacgcaatccacctcaacttcagggcaaccaataataaagcagaatacgaaggactactcgctgggatacgagctgcagccgcacttggggccaagcgactaatcgtcaaaggggactctgagctagtcgcaaaccaggtgcacaatgactacaaatgctccaaccccgagttatccaagtatcttgcagaggtcaggaagctagagaagaggttcgacgggatcgaggtccgacacgtctaccgcaaggcaacgtcgagccagacgacctagcatgatgcgcatccagacgagaaccgctcgacaccggcacctttctcgacgtcctgatgaagccatcggtgaaagaagttaacggtgaatctggcccgagcacccccgacattagctcgaaggacaccgaggcagaacgcgccgttgctgacatcgaaaccacagacgactggcgcaccccattaatcaaattcatcagcagcgaggaattgcccgaggacgatacagagaccgagaaaataacccgtaaagcaaagatctactgtatggtcggtaacgatttatacaaaaaagcgccaaacgggatacttctcaaatacgtctctaccgacgacggcagacaactcctcctcgacatacatgaaggcatatgcgggtcacatgccgccagtcggacattagtcggcaaggcctttcgacaagggtttttctggccaaccgcccttaaagatgcatgcgatatggtccagcgatgtgaagcctgtcaattccacagcaagcacacaaagctacctgcacaagcgctccagacaatccctctgacttggccgttcttgcgctgggggctagatatacttgggccattcccacgaggacagggtggctatagattcctatttgtggcaatcgacaaattcaccaaatggatcgaagcactacccactggggaaatcaaggccgacaacgccattaagttcgaagagggatattctgcagatacggactaccgcaccgcatcataactgacaacggctctcaattcatcagcgccgacttccaggattactgcatcggtttgggagtcaaaatatgtttcgcctcggtctctcaccctcaaagcaatggacaagtcgaaagggcaaacggcatagtactacaagggataaaaacccgcgtctacgacaaactcatgtcacatgacaaaaaatgggttgaagaactcccatcagtactatgggtcgtacgcaccacaccgacaacatccaacaaggaaacacccttcttcctcgtgtatggctctgaggccatgctccctagcgagttacgacatcaaagtacacgagtacagaagcatttcgacgagaaccaggaggaacagcgagacatcgatgtaaaccttctcgaggagcatcgtgagcgagttgccgtccgagcagctagttatcaacaagccctctgccgttatcacgagaagcgcatccgagcacgcatactttcgatcggcgactatgtcctccgacgagttcaaagccaagcaggacgaaacaaactctcaccaaaatgggaaggaccctacacaatcacacaagtcttgcggccaggtgcattcaaaatcgcagacggcgacggccgcgaattagcaaatttgtggaacattgaccaactacgtaaattctatgtatgagtcaataacgccgtacctgtaagcacccttacagtatcaataaagcctatttctaggcttcataccacgaccaaagtgttttcacccgatgatcccttactctgataatacctagcgttgaaacctatccttaggaccctttacgccgtctcgacaaggcctccaaggaacctaagggatcttcggctggggacgcccaaagccgataaggccttgtcagatccttcagagacgaaagaccatgtaagatctggtcatgtaagagttctcgccgtgcgtattaaccaagccgtgtaactggaaaccgagctttccaacttcacggctgggggctaggatcagagcttattcaaccaaggcagatcaagtgtccaagagccttatcatccgagaaaatttctccgacgacaaggctaggggctagggagagtgtacgactcaaacggccgaggtcgttaactgataacacactctaacacataacatccagagtaagatgcatttgtttaaggaatatttctttattcacataataattcttactgttttttacatagatctcccactacattacactttttcctaagacatctgtagcaggccacgagtactaccaagagggccaatgccagttcatagactggaataccttctcggctaacggcgacatcgacctcgcaaggtggtctatctccgccgaagtcctccgagaacgagcaaacccttcatggaggaattcgaaatccaggcgcgggcggtgatctcgcaggcaagctagcacatgtcctccggcatatcggctcgttcgacgacactcttgcttcaaggcttcgtcaatgcgattgccgatgccatcgagttgggcacaggccccgttgagccacgagatgtactcggccgccgactcttcaggatcgctgtggactactcgaagctccctgcatacccaggccattgaggtacagcaactctttaaatatgacacaaaccacacctcgcggcctcggagcgtttccacggcttgctctttcttcacggctagcatggttctctcgagttccgccacttaaaatttagtcttccaatattggatacgacgatcttgggttgcaagggcattcttgagacctgctaaacataacgaccactaagacaagctggaaaccactaacccaacggagttaaaaaggctactcacttgaggtggctgtcgccatctcgacctccacatcaagagtatggtcctcgacgtcgtgtgagacgtgtggttcaaattcgagtaccggaattatcgccagtgactcgggctgcccgcgctgctggacatcctcgtcatcagcatctctacaatcgacaagaaaaacttccaagatcaacattgaacaagggtggtaatcatatatgcacgaaggcaaccagagttcaagatttacaaattataaaaaatacaagaagtcctactcttcaaaaagggggaggacagactcccccaggtcactgacttcttccatcacctccttacgcgtgtcgcttgccgccccctgatccaagatctcacgcagatcgagttcagggcgcgacaaccttacacacgcgaggacgtgacacaccccggtgtagataccgttggacgtctcctccgcgatcctggacgtatgcttggaggggatttcccccattgctgtcgccagctccgcaagagaagaagtcaacgagaactcatcgaggttcaccgggatcgtggacttgacgccgcactccttggcgagctggtggaggccggtgtaggtgacccgcagcgaaccacggatctcggagagattgtctccaagttccgacatgcggtcctcgagccctttgctttggcgctcgttcccggccacaagctccctcatcttcgtgaggtcctcgcgggcctcagctagttcccgcaccaaccgctcggcaagcgcgtttgccgctgccgtctccgccctcgcctctgagatctcgcggccgatgccacgagcaccagctttgagaaggcggcccatttcgacttggagctcctcccaggtgaggacggcctctggcagactaggacccccagcgggatcgctgataggg

SEQ ID NO: 46452 - DNA, 761 bp, Oryza sativa
atgcacgaattaattaatgatgcacttaggactgtgtatgacgacatgcctatgagtgattctgcagattcgccatacacacacactgatggaccaaatttagaagctcaagcattttatgagttggtgaaagattcaaagaagcctttatgggatggatgtgaactatcacacttatctctactagtgcttttgttcaatatgaaatccatgaacaaatggagtgataaatcatttggagatctacttgatattcttcacatggcaattccaaatggaaaagaattgccaaaaaacttttatgaggctaagaaggtggtttcaaaatttggtctagattatcaacaaattcatgcatgtcccaataactgtcagctgttttggaaagagaaggttaatgatgatttttgttcaacttgtaaggcttctagatggaaagataaaaaaccagaaaccaagttaacgaagaaagaaagaaagaaagcaacaccaagcaaagtcttacgatattttccaataaaggagaggctgaaaagattgttcatgtgtagagaaacagcatcgctcccacgttggcatgatgaagagcgcttagtagaggatggtgtgcttcaacatccagctgattctccggcatggaagaactttgataaaagattcaagcaatttgcatctgattctcgtaatatacgatttgggttagctacagatgggtttaacccatatggtatgttgagctctacctatagttgctggccagt

SEQ ID NO: 46453 - DNA, 1126 bp, Oryza sativa
cataatgccagatcccagactgggtttgtatttctttgtggtaatactgccatttcctggcggtctataaagtagaccctagttgcaacgtcaaccaaccactcagaaataattgctctatatgaggccacacgagaatgtgtgtggcttaggcggatgatcggtcacatccagaagtcatgtggtctaaacattgataacacccccaccattatctatgaggataatgctgcttgtgttgcacaaatacatatgggctatgtgaaaagcaatttcacaaagcatattactcccaaattcttttatccccatgagctccagaagagcggggaaataaatgtcctgcaaactaagtcatgcgaaaatctcgcagatttatttacaaagtctctgccagcatcaagcttttacagatgtgttcgtggcatcggcatgagacgacttagtgaattgcaaggatcagggggagcaaacaattagcccatgattgtgatcctgaagaatcacaaacaagtcctgaagacttgatcaactgttgtactctttttcccttggtgaatttttttcccattgggtttttctcacgcaagatttttaacgaggcaacaggtgcaacacaatattcaaagtgccatgtactcttttctcctaccattttttcccattgggtttttgggaggagtttttaatgaggcatgtgcataattcaaattcgtccaagggggagtgttatgaaacctatcttattgtggacgaattaaattatgagtgggaagcttaccacagaagaaagcttacgctagaagctagcttacagaggaagccagcttacagaggaagccagcttacggcacaagccagaaggtccaaggcttacgatgtaagcctccaccctcctccgcctataaatagggcccagaaggtccaaggcgaggacaaccgatcttcggtctcctgcttctcctcttgtagctcgtactcaaatccagaagaaataaagcttccactcgctcatactttatgtgttctacaactctgtgtttggtttgcttgtgtgctgatcagtagaatcgactggtttctcaacttatagaatccagtttttttagatttttataagccggtt

SEQ ID NO: 46454 - DNA, 893 bp, Oryza sativa
tgtcctcctctttcctcatcgcgttcccgcgcgccgtcgcggcgaggaggtgcggcgaggcggccgcggcgccgaggagggtgggcgcggtgaccgtgcgcgcgcaggcggcggcgggggcggggaagaagagcgtgctgatcgtgaacacgaatggcggcgggcacgccgtgatcgggttctacctcgccaaggacctgctcgccgcgggccacgccgtcaccgtgctcaccgtcggcgacgagggctccgacaagatgaagaagccgcccttctcccgcttctcggtaggtaacattatgggggttcgagggctcacggcggcgatggtgaatgaatggatgcaattaataatgcaggagctgacgagtgccggggcgacgacggtgtggggcgacccggcggacgtcggcgcggcggtcggcggcggcgcctcgttcgacgtcgtcctcgacaacaacggcaaggacctcgacgccgtcaagtacgtcgcctccctcgattattctcccccctcgctccgagcaagcaggcgtcatgaccaaggtgttcgacgcgttcccgcaggccggtggtggactgggcgaaggcggccggcgtggcgcaattcctcttcgtcagcagcgccggcatctacacgcccagcgacgagccgccgcacgtcgagggggtaaagaaacataacaaccagattcgccggaggattggctcgatgagttgagttcactgactgactttctccggccatgtcggctcgccggcgacgtgcaaatgcaggacgcggtgaaggagagcgcggggcatgtgggcgtggagaagtacatcgcggagcagttcggcagctgggcgtcgttccggccgcagtacatgatcggctccggcaacaacaagga

SEQ ID NO: 46455 - DNA, 1536 bp, Oryza sativa
aagcaaggactcatctgtcttataaaaaacccaatcctgaggatgtatttggacaatgtgtatgttcagatatatctttaggattgaattttttttagacgcaggaagtacgtgtgaaaaatagacttagaaaattttttgaatctattcatttcgcaggaaaagaaacaaattttagacgagtagagttcctttttcttacttcaaataaagtcgaggttggaaaacgtggttcattcttgtactgtctctagtaatttctttttatataaatttagaaaaaagaacttttaggcccgattcttaacgggttttcacccgatattttggatgtgaattttatcttgatatcgatgttttttttcccaaaaaggatgtgattttgatatgttaatggttgtgtgaaaattgttagcacttctacgcggagccgagggcggcgaaggaggtgcttggatggaggagctcgacgaacctgccggaggacctcaaggagaggttcgcggagtacgccagcagcggcagagggcagaaggagatgagcttcgacctcgacgacaagatcatcgccgccgcctaacaacacccatctcatctcacctcgtcatggtcaaatacaaatacaaagtgctcggggatctcttcttctcgtgatttattttcttctccctctgtttctttggttcctcttctcataccggaagcatagagaaatgcaaaactgaacaattatatatgtaaatgctaggaaaatgctgttacaaataagtgaataagatgagttttcgcttttcgtttttcatttttccatcacatatccaatatgagaatggaactttgcagagtcaatcagattcagcacattttcttggtcttacctcttttttgtctgaatatatagctgagtaattttgtctaactattcgagggtataaaaaatgaattaactattataaagttgaaaaaatggatttgaacagtttcataagaaattcatatatattaagttttcttttccgaaaatcgcatcgtttataagcgctggaaataaatggttgcattccttaagaacagatactcctcaacaagatctgtgttgtgaattgttcaccttgactcgttcttaacaactgaattcaactttgattctgacagaccagaacagacagcaatgctgacaaagaacatcaggatttctttaccccctttctgcaatattcttttggagaccagtgctcacgaacaagccaactcagaaggagcattgcagcacattgatccacaaagccttctttgatttcaggtatttttgcgcacacacaaggggcaacacaccagctgatactgcatggtgtaaaaagaaataaagaaccaagaggactgataatggtagcagcgagaatcaattaaaacttacaattccagcgattctcgacatttccagaactaagattggtcccatctcgacatttccagaactaagattggtcccatcctaggtagtaatatagggcgatcggaactactgaagcatca

SEQ ID NO: 46456 - DNA, 1202 bp, Oryza sativa
aagtgctatttacacaatgaatcttataaaacagtatacaatgatgaggtccaaccagcttgtttgttagtcaagtggcacctaacacttgtcaaatgaccctagttctttaatgcacaaaaaaaaaggcctagtaaagaacaagcagcgttgcatattcatatgctaaagtatgaacatattaacacttaacaaaatggatgctgactctgaatgaacagataaggccggaaattccatagcccagactcagactatgcttaaggatcaattttcaggttaagtgaaggacacagctagttatcagaaggtagtaggtctccataggaaagaagattatatctaattgtctatataaaacacaaaatcgcatgcatacctcaaaaaagacctgaggtcttggacacaaggttgaacaacaaacatatggctataggatataataatggggcttttttctaagagaagatcaaaaagtcaaggtaaaagtgccaaagggtctcaccactaaatctcctcgaactccagcttcttcaatagcttcacgagcagctgcctcttcaacagtttcatcattctcccatcctccctaaagcagtatggcacatcaaacaaaagaccgcatgccacagaatcatgtactatataataaacaaacagatatatttatcccaataactaactagtacacctcgcagacaaggttatcataagattaactctactaatgagtcctgactggctcaaaagtcgactctacggcacctgatttcagtacctacttaatcaaacatttcggagggatattgattatcttgctcatgcccgttatgttagagcattgaggttacaaatcaaggaacatatctttatgtaatggtagatggataacggatattggattatagcctaaataatttcccatcaattactctggaaatctaaagcacaaacagaataacatcacagatgttttcatataccatgttctgagaattgagtgactcttaggcatagatgtttaaaatgttaataccttaggaaataggagaccagatccactctgggagttgatcatgagaacttccacaagtttcttgtgtccatcatcagaagtttcatcattgttatctttatatctaaaaggtatgcacctacatatataagaaacaagtatcagatgaatttaaagcatgacaaca

SEQ ID NO: 46457 - DNA, 1017 bp, Oryza sativa
tgcggcggaaggaggaggaagaaggggagggtgaggggctcgagagatgtgcgtgcgtgcgtgcgcctaagcgccttgcttcgttccttcctgggtctctcgctgttcttgccctttttattttgggaattttttgccctgttttggtcccctttttaccccctttgtgtagcttttttaggactttttctctggtttctatggtttttggctttggtatgtggttttggtttggtaaacattttcaacttcatccctctttccaactcaaggttgttctctgattttgtaatacaatgtgccgtttagttatgaaagtgctttaccgcttccgtctatgtcggttgtgtctttcggtttaactcgtcgacaatatattgtttggaccgatttacggagagcaagaaaacgtacacggtactatgttttaaaggtattgctttacttgaaaaataaactaaataggttgagcgccgttgaaagacgccgacaaatcaagtctcacacgagggggaggaggcaatgctatgtaatgcttcatcgtgaaaggaaaaagaactttacaaataataccttgataaaaatttttgttttcattttcgtcacgttttctgtttaacttggcgacgatgtgctttagcggagcaggcgtgtgtgtttagtatcgtgtgttgcatcatatgaaaaaaaagtaaatgaattggtcgtacataagaaaagagtgaaatacatgactggtccctaaagttgtgtagtggtatcacttaggtccgtgaacttgaaaattacacgtttaggtctgtgaatttggtttaatgtaccacccggtccaaacgtcctttgactgcgtttgatcgctaacgtggcatgccacctaggcaacacttttgctctcagccccctccacatcacaacacgtcgcatatatcttcttatagttatatagtgacaccagaatcccaaaaaaattctcacatcgttcttccatctcattcttctccttgcatgtatagaaaa

SEQ ID NO: 46458 - DNA, 1484 bp, Oryza sativa
ctgtaaacctttctagccattttaatccaatttcattacctatccatgttgttttttcctttgaaaggacagttgcttccatgttttagactcctaggatgtgaaaatgattgaagcaacaccatattgtcacttgtttcttgatctaaactgttatgtttgtacatctgagccaggattttgaggttatcaggagggaatatcaacaaaagctagctgttctcaacaaaaagaagcagcgtggtgtcacttcttcctcacttgagaagaccaagtcggttgttagtcacttgcacacaaaatatgtagttgatctgcaaacaatggagtcaacagttgcagagatcaaccgtctcagagatcaacaattatacccaaaacttcttgaacttgtgaaggggtaagcctttttcaatgatttctccttctactatgaataacaacattgctaacgaaacaaaaaagaacaatagatatagactcaagagaacttaattgttttgttttcttacattggcagaatgtggcacatgtgggatgcaatgtaccttcatcacaaaacacagctcaagatcatcttggagctcaagtcgttggacatctcggtcgccccgcgggaaacaagcgagcaacaccatgaccggaccgtgcagctgtggaatgttgtacatgagtggcacactcagttcgacaagttcatgacataccagaagcagtatgtgggatccctctacacctggatcaagctgaatgtgatccccatcgacaccaacttgaagccaaattcatcacagccacatgagaccacacctcccatcaagagggtgctgcatgcttggcatgaaatcctcggaaagctccccgatgaggctgccaagaaggcgataaacacgtttgcagagatcgtaaagacaatcctggttcatcaggaagacgaactgaagctccggatgaagatcgaggataccaggagggattatgggaagaagaggaggcaattcgatgactgggcacaaaagtacatccaccaaactgcgggtatccttcctgaggacaggaaccctgacggtgcacgccccgatccgatggcggaacggaaggctgccatggaaaagttggagctttctatgaaggagctggaggagatgtatgtcaagcagtgcagggtggtcagggagaagtccctcagccttctcaggacgaatttgccggagctgttcagagttgtgtcggatttctcacttcagtcagctgggatgttcaagggcgtgtggtcgattgcacacaccaatgaccaactggatgaataatataagttcttttgttgttgtaatctttctttctttttgtttatgttcataggttgattagttgttgtatattgatttttggcttgtggtgccgagattaaaaaaaaaagaatgatcctttttgagctactgttgttaaaattcgtagtatagatataggagttttacttttac

SEQ ID NO: 46459 - DNA, 1185 bp, Oryza sativa
ttggctcttggggacgtacgtcctaggaagccccaacaaggagcctcttccttaacacaagtggagccacctacatcaacccaagccgacgatccctctatctcaagcttggatcaaggtgaagaaggcgagcaagtgccaccctcaccgatcaacttactcgcccaagaatccaccaaagtatccaaagagatcatcctaccgacaacatcttaggagacatcaacaagggagtatccactcgttctcgtattgcaaatttttgtgagcattactcgtttgtgtcttctcttgaacctctaagggtggaagaagctcttaatgatccggattgggtgatagcgatgcaagaggagttgaacaatttcacccggaatgaagtgtggactttggtggagcgacctcggcaaaatgtgattggcacaaagtggatcttctgcaacaagcaagacgaggccggggtcgtaataaggaacaaggcgaggttagtggcgcaagggttcacccaaatcgaaggattagatttcggtcaaacttttgcgccggtggctagacttgagtcgattcgcatattgcttgcttttgctactaacctcaattttaagctatatcaaatggatgtcaaaagcgccttcctcaacgggcctatcaacgagttggtatacgtggagcaaccaccgggcttcgaggatccgaagtatcccaaccacgtgtacaagctccacaaggcactatacgggcttaagcaagcccctagagcttggtatgagtgtcttcgcaattttcttgtgaaaagaggctttaaaatcgggaaagccgattcaaccctttttactaaaagacataataatgatatttttgtgtgccaaatatatgtcgatgacattatatttggttctactaacaagtcttttagtgaagagtttagtaggatgatgaccaaacgttttgagatgtccatgatgggtgaattgaagttcttcctcggccttcaaattaagcaactcaaggaaggaactttcatttgccaatcaaagtatttgaagaacatgcttaagaagtttgggatggagaacgccaagccaatccacactcccatgccatcaaatggccacctcgacctcaacgagcaaggtaaagacgtcgatcaaaaggtataccgttccatcattggctcacttcttt

SEQ ID NO: 46460 - DNA, 703 bp, Oryza sativa
ttcagtgataaaactaaagatttaaataacctagagcctttattaaatcaactacgacatgaattagcagaaaaagaaaacaagctcccaacattgtacataaaggtgcaaccaaaagtccaaacagtggaagctaaaaggacaaaccagtgcttcccccatagttaacatcaagatatgcccatcctcgacttgtccaatactgaacactcaggtccagaattccacgtgtttctgctgttggtcctcctgaaagatgtggggaatatcaaatatgcgattgccatgattgtgatcatggaaaagaaggatgcaataacctaacgaaccaaattagacagaaaccacatagtaaaaattgtaaatacaaaacagaacacataacagttgggcctaaataactgaataattattttctgggatcaaactacaaagatattctgaggcatcacaaggcttcaataatttacttaccatgtgttttgacaagcaatggaggtttttcgtctggcaaaccttgaaaatttgggtttgaaggtgggtagaaatatgcataagctttctggccggtgctggatgttgaaaactcaacaaattctggtgcactgaagaaagaactatattgtacaacatctgatgaggatgaccaaattattgagaaactaactacttttgttctgtcctcatttaaagctacctgaaa

SEQ ID NO: 46461 - DNA, 5054 bp, Oryza sativa
caaggaaataatccacacagcaaatactgtaagactaacatgaacattttttttagagcaatactgacagaaatcatgatgtaacatctcggtagaatagtattgattccatctctggcgttcagtattagagtcaattaaaaatgtgaatatgcatgcctaaagaaagagcaagatatggtaggtactgcttcacaatgttacatttgtataatcttctcatgcaaatatgtttgaattcctacaaacatacaggcataataaataaataaataaataaacaaacatattacaaacatataacggctttctcactcaagtaacaaataaatatgcaacatgtttcagataatcagacaaaattaacaagcaacatgacaccttttggagaccatttaggctcagttggggactccactaacattggattgctaccagcaacacagacccgtttggtcaagtctctacaaacaaagaatcatgggtgcttaatcataaaaagctaacagttgaaaaaaaaatcagaaacaggtcgaaaatggactagcataaggtagacagactgcaacactagagattacaacagaaaataaatccaaaagtttttagtattatgagatattcctctgtagtcagactaacttctttatatatatattccatgcattagagatagggttccttagggacactcaaagtttattaaagtgtaccatcaaatgattcctgtagaagggctagcatgtattatgaaccaagaaaaagataatggatccatctaaatttctgtcatcccgaatgtaacatttgttttgtttatattacctgattggaagaaaaaggcagcatgttctaatatgcatttctaaagataatgttgcttacccgctttcagagaagtagccaacccaaagttctgacttatcccagggcatatttggatgactccactctatccatgccatacgcttgttattatggtcaatacgaggaaaagcatagaagtcattgccactaatcagcacctttggttcttcaatacagaaaaaaaaagtaagaattcttacaaaaaaagcagatatgagaaaattacaagcaacacgcacacatagatttaactttgtgaaagttataaacatttcgtatagtcttaccctgaacaaccccattactcaagcttatagctgcgattgttgtggtgggattcaagctactctttcgacggtctatcaagaaatttgagcatgtcagaagttcagtatgcaactatagtttgtaataaaatcatatgccaattaaccttctatcacggtaacataacggctgaagtgaggatcaaagactccatcagcataactgacatcaggcccaccataatcgggtgtaagaggcacaggcacaccagctgacaagggaaaatcatcatgtgaaatatttcagcagaaaaaaatatcattatttaatatgcatattgatcatcaagcattaagtggttctaaatatttaacagctgaatagtgtgattagatttcctttttaatcctgtcaaacacaacctatcatttcactggctgtcatttcattataaacgcaagtcttttcgcttgttaagacatgctccaccaattctacttatttgaatgagcatgctatacagtaacctataaatgcatatacacaatgaaatatttttcaatgaagtactagacaaagaattaccataagtaaggaaagtaaaaacacatccttccaactaaattatatttctttattgacatgctaattcagttaggttcacctaactccttagtcctacaaccatagcaaatgactcacttttagtactttgcttgtacagacgttgatccttgtagtttgagaacacaacaacattatctttgactgaaaatgcaccacctccatattcttgagctagagtacgtgctgcaaattcttgaggtatgatatccacaggcttatcatcctccttgactataaccatacgcctgtgtccaatatggtggaagataaattaattccgagtgacacagcataacagggaactattaaaagttgaacatgacatggtacactaataacagacattaacaaacttaacacagttattgcaaccatcaattatttaattgcacactgctagaattcatggaattagcaattgccaggcagaaagaatttattatattacattaatcttctggcatcatgttgtctctagtgcagtaatgcacacacagcaaatgcatataaaatacattctgggtttctcaaatttgcatattcaatcaactctaattgtcaaagcccataagccaatcattcatttgaccatgtattctagtgcaaagctgtaacttgctttcatttatatgcagaaaaatcataccagtaatctgctgagaaactaaaattccaataattaaaaaaaaaaacatagtgaaacgaaatcacattattccttccagtttctatgatacaatctccacgcaaatatgtgccaacatgctactaaaacaattccagaatctagatacgcacacttactaagaaactagtaacaaacatcacaacagctcgagaccaacaatcacaatagctcgaggccaccaagacacaaaagagaatcagaatcttcatgtgccttaacgtataattaaggcaccatacaaacttccgtaaaaaaaagtgtagtagtagctgccaatgctattaccaaaatatttggaggaaaaaaattatttataactgttataagctcaggaacggcggttactggttaacttaccctttctcctcgggccggccctcgatccagaggaggcgcccgtcaccggcgagggcgatccctccagccgcttgtcggcgccggagacaacatcggcggtgatgggcgacctccaggatccgtacggcgccgccacgggcttctcgccggtaccgccaccgtcggcggcggcagcggcgggggaggccgcggtggtggaggaggaggaggaggacatgcggggcgccgacgcgagcgggcggcggaggcggatgcggggcagcgcgcggaggaggtgggaggcggaggcggagaggcgtgcgggtgagatggaggcgagaagtgtcgccatttgtgaggactgctttttataagaggttttgtggggtttttgcggtttatagaacagtggaggatacgctccattgttccactctagcattcgcagcgagatccgctattgcgctttgttaaatttttttagttgttcatttttattgcgctttgttaaattttcttagttgttcatttttagtgcatttgatcaatgctactcaatttgtttctaaagaaatatatcaacacaatggatgcctcgctatcaacaatacatcacctatcatcgaaagaataatatattataaatataagcatctatgataagtctagagcttaatccgaatagataggttgcaccataaaaaactaccagctacgctcacttcgcaatgttactcaaccattactctgtttcgaatcatatcatcctacacagaagtacttgaaatatgcttcatgaaaacccttaaccccagccaaaatagcaaataggcgaaggcctctttcggaatgctgaaattttccccaattcctactagaattataccaaatttcgtaaaagtcatataaaattcctgcaaatgtgctacaatgtgaaaacgtgggagaaattctagctaacggaagcatttattccattatattgaccagagtcgtatgcaaagcttcaagagattatttcaaactacagctaggacagcgttgctccagagttccctcgagttgttcccagaagttgattaggtgacgaataacttcttaacgcttacaaggagggttcatcaaaattgtcgatcttgattggagtgatgccatcagccaccttgaagtgccccactaatctagcgaagaacaccatctgctgctccaaggtaaacttgatgttctcggcctgctccagaaatgcaagtcagatatgtgcctatgtaaaattgtctatttactggtctaaaagtttcatatactgaaaaataatatatacagttagccttcaatccttcatggtaaaaaaaaaaaaaacaattcggtaggaaatactcaacctgatacattactaactaatatataagtttggtgttgcaaagataaagacaagaggtactcgtcagaccttgcggaaaccatgttgttccccttcatactcgaccaaagcaacaggaaggcctttgtcctttatggccttatatatcgtcgttgcctgaactggtgacacaacctgaagatcatcaaagaggtgaaaagctggtaaggagaaacagaatgtgggaaatgcacccgctgctaagtcactcttagccgattttcgttccctctgttctgggttaacagattacatttgatttatcgataggtaactctatctgtaagtgcacttcctagccatatacatattgatcatgggacacgaggactaaagtgcatcagtgataattaaatacccttcatttttgtttatatgatgttattgctttttgtaactttgtactagtacagaccgattatattataatgatttggaagtttctttaaagacaaatcagccaaataggtttcatactgaataattatagatagctttgaatatactggtagtaaaaaattagaactcataactgcattcaaacaaaaatgacccgagggagaagttcagatcttatagctttaccgtgtcttccaatccttgaaacaatataattggacatgaaaatctatcaacgaagtttatcggtgatctctcaaagtaagcctttctattccctggaatattgaaggtatggcaagtaatgttgttaaccaaaccctgagcatatacatacgcctattttccagcatagatgagtgcaaaattccttaccaacaaggttgtcaatgtagtatgcctcaaacttgtgcatgcctgccctcaacgaagctaagtcagcaatctgct

SEQ ID NO: 46462 - DNA, 2529 bp, Oryza sativa
ctccacgtgcttcatctgtaggtccacctaaagaattgcaacaatgtcaatacgagtttccatttcctttctttaaaaaaaagtacatttccttattttaatgttctgctttcccttagcaattcaaaaggcttgtcagtcaagtcagtcaggacttaggaccaatgagagctctgtgatcttttatcatcactacaaaacattcttcaaacaaaaacaactgaaataaaagagaaacaaagtgctgctctatatcactaacaaaattgaatgagaaaaaccaacatcatgtttcctaataacttctgctacaagtgtgaccagtaaagacaaaaagaataaaataggctattgaagtcaacgaaatatcatataactaattaccatgggttctgaccaataacggaggtttctcatctgacgacccttggaaaatatgattgtgcggggcatagaaataagcataagccttctggccggggactacagttggaaactccataaattcaggcaaactaaagtaggacgcatattgcataacatcctctgaagaggaccagactatagagaaattagttgctgtttttctcttttcatccagtgtcacctggtgcaaaaacagaggtcaaagggttgcactatattgaaggaattcagtttgaatagttggcatgtgacaaccaataaggtagtcgaatgaaccttagcaatcgacactggaagagtagcagatgcaccctcaacatagaagaacccatccccagaaacctagaaaatcaggaggatttgagttaaaagcatcagcattccaacaaatttaaggcactgacgagtgagatccaaatgttataaccagcaaactacaattagttctgaagttgactcatcgcatttcatacacatactatgttagttacagaagagaagggaatgtccagttctgaaaaagaccctgaatcatggtctagcactccagcacatgaccttccattctgcctggataagattcaaagttatgaattacacacagtaaaccaacacttgagtatgggaaaacatgaaaaaacctgtaacagcaaacgattttgttactcgtgtcatcttttccaaggaaaccataggagctgacaccaaaaatccacattggctttgagaattcagcatcaagtgaatacagttgcactatcaaattgctctcctcatcctgttgtaaatgaatagcacgtaaatgccaagtaagaggacaaatcgcactattttcagtatctttagcaacataattttagccatcatggttaggatggactcttttctttttgtttttagtgatgataaatgtttccctcattctaaaaaattagcagttagtggtaggatatcaacatgaatattacgctgccccatataatggagacgccaacataatatctcaataataaaatggtttatcacaagttcacaactcttcctactgaaagaagcatatcaaatataaacagaatataacttcttgtatgagaaattagactgggaagtaggcacaagtaataaagacagaacacattagcgctgagagggttgcagcggatataaggtccggtatgcaccacaccatacttcaatcaagtagtttgcaaaatcagatcaacgggcaactgaataaaaataattagttcagggaagatcatacccatttataaatattccaaaacccactctctcggtcagttatgaagaacagctcccctgaagaaaattgattgaattaagtgatattttggaaatatatttgcacctatcttttggagaaatgaaaacctacagaatgattctgacatgccaaagattcataatccatgcagagaagaatggtatagctacaaggatgaaagagcatgtcttgaacacataaaaaacttaaaataatataaactgggtatgaaaatgctaacaccttttgaagtccacttgggttcagtaggagattctactaacgttgggtcaccaccagcaatgcaaatcttgttgtgtacctctctgcatgttatgaatacgtaataaatatgtaggcttggaatatatcattcaacattcgcacgtcaacaagcaacccaaacatagtttattttaggaaaaaggatggaataatgaatatatcttattgaattgactatttgccgtgaactagagactacaagatcagtgtgttctcaaatatggactagtgcagtaatgctgaagattagtaatatgcacaactccatgttccttcacatgaatacaaagataaagatctaaaatatcattcagtattttcaaagcaaaaaaggtaatccagtagtagatagagtagtacctctttctttatgaaaactagttgagaacagaaagcatgcaagtaagaaattaccctttctcagagaaatatccaacccataattgcgctttatcccatgacatgtttgggttactccattcaatccatgccatacgccttttaattggatcaatgcgtggaaaagcataaaa

SEQ ID NO: 46463 - DNA, 2158 bp, Oryza sativa
aaaaataaagataggctagtttcttctcattttcttttctctaaagcatggagatctcaattatgtaaacaatttgcccatgcatttggtcatctgggtcccaatttccatgatgcatcccaaattaatggcagacgaaagcttaactacatttcaactaaattttcagcggtgcctcacgaattgcagacattagacctgctcaggttttccactcaatcgtaccatttctgatccattttcctcaaagctactacccctctgtctcaaaatatagcaacctagcgttggataggatataacatagtaaatctggacaaagccagtattaggttgatatattttgagacggaggtagtccatcataggctgcgtgggcaatgtaccaacctacaaggctacaactgagaaccggtgcagtccttgtgaaacagcagaagaacagcaactgcaccagacctggtccgttgacttccattcgaaggcctaagacttggtgcaatgcgagctcgagtagtcgagttcaccaactattatccacagtaaagagtacggtatgctgcaatggcgcggcttgttcggtgtacctccaatggtctgcttgtaaaggcgctggtcgctgtagttggagaagaccaccacatccccttgcaccgcgaacgccccgccgccgtactcctgcgccagggacctcaccgcgaacccctccggcgtcacatccacggcatcgccgcccggctccgccgcttccttcactaggaccgctcgtctgaagaagaagaaaaaatgcagcatcaggagagcaatctgaccacgcgagaagggggtggatggcgtcggcgcgcgtcgcgtaccctccctcctcggggcgcgtctcgacccagaggagtcggccgtcgccggcgacggcgagcccctcgacggtcctcccggcggcggagacggcggcggcgctgatcggcgactcccatgacccgtacggcgccaccaccgccttctcggccgcggcggaagcctgcgagtgcatcgcgacagggcgtgcgtgcgcgcgcgtggcggctgccgggagttgcggggtggaggagagcagaggtgaggtgagcggcgttgctgtcaagaccgcgggtaaactccactactcttctagtcttctgtacctcaccgccaccggctcatcggtccaactcgggtatcattaagaacttaagaatgaataggatactgataaatttctgtattactagaacagtacttcggtaacaacgactcctatcggatggcctaataagaaaaaaaaaggcaaattttgaattttcaaacttaattttgagattattttaagatattttcaacgtgatttctttttaagcattggcttttaagtcaccgagaacacgtatataaaagttttacctacaaatacaattttattcactaataagccgttttggcttattaaaaaaaaagcgaaacgatggaggccacgctaggcctcctcgattgggaatttgggatccagtgaagttagagaagctcggtggtacgactttgaggtattctcagccgtccgatcgacagcgaacggacaagactaatctctacagtgcaccataaacagtatattgacagtatacttacgccctctttatttaggcttataagccaacttataagttgaaaagtctaagccaaaacaaacaagcagcttttttatttggcttttttaagccataagccactataacactattaagccaaaagctaggttggagaagcttttttagcttatatgagatagatgtatgactccaccactaaacttaggacattaaatccattggcttataaatcatataagccaataagctgacttaaaagtctaggccgataagcctaagcctaaacaaagagggccttaacactttctacagtaaaaactgcatatcactgttcttaacgagaaagcggacaatatgccactctataggttgtgttaagataaaatgccactcaatacaatgcaccagataaaatgccacccaatacgttgcctaccggatgaaatgccactttaaagatttttgtgccaaaatgtccctgagagagaggaagaggggagcgctggggagggctggacggggaggggagaggggagctc

SEQ ID NO: 46464 - DNA, 24964 bp, Oryza sativa
caaaaatctccaaagtgtcatttcatctggtaggcaacatattgagtggtgttttatctagtgcattgtattaagtggcatttcatctgaacccaatctattaagtgtacattgtccgttttctcgttcttaactacggcactagactcattttactgtgcacctttgccgtttgctcctaaagtcagaggagccgaatccaggcctgctcagcacaactttgatttactagagtacctctattttttttttaactatggctatgcaaacgagacttaagctaagactttgcttgagagcccgttcagcttttataattctctcgtttatcatgagcacgtctttcaaactttctaatcgataaagattttgaaacgctagtacatttgaaactaaaacatttcaaataaaggatggacagaacgagaagaagattaattctaggatgggaagaccaaagaccaaaggcatgttctccatttcacaatgtaaaacttcgtagaattggccacattcatatactacctccatattttaatgtatgacaccgttgacttttttttaacgtttgaccgttcgtcttattcaaaagttttatataattatcatttattttattgtgacttgattcatcatcaaatgttttctaagcataacataaacattttcatattttcacaaaaaaattgaataaaacaaatggtcaaacattgctcaaaaagtcaacgtcgtcatacattaaaatacggagggagagtacatattaatgagctagaaagtcttgcaatttgaaacgcagggagtagcaaactttcgcataatagaagtgtccataaaacaaaatcattgttcatataactcgtgttttattccagtaaatatatacacgcatgatgcatgtcttgatgtcttctcacactaaacataaacaatagtacaagagtacataaatcacttaaagaaaatgtagcggtaaatagtgaaatcgatagcacgggtgcctgcattattgattattgatgccgatcgatttgaagagttgcatgactggttttaagcagaaggagcattagagtcatcgtcgtcgtcatggtgatgctcgtcaaggaaaggatagtcggtgtacccaaccacaggatcctgcgtgtagaaggtgttgcgatcgtagttattcatgggcgcatcgagctcgaacctcttgggcagatcaggattcgccaagaagagcctcccataggcgacgaggtcggcatagccatcggcaaccgccttgttcccttcttcccggtcgtaccctccggcggcgatgaacgtgccattgaactgcttcctgaagggcaagaggccgtgctgaatttgccggcggccgtcgacgatggccatgcgaggctccaccatgtggcaatcgaggaaatcctcgtgcttgttcagctgctccaccatgtacgagccgagtgcctccgggtcggagtcgacgcagtccatgtagtccaggaacggcgacagcctgatgccgacgctgtgggcgccgatctcgccgacgacggcgtcgatcacctcgacggcgaagcggcaccggttctcgaggctgccgccgtactcgtcggtgcggtcgttggagctgtccttcatgaattgctcgaggaggtagccgttcgcgccgtggatctcaacaccgtcgaacccggcctcgactgcgttcctggcagcgagcctgaaatcgtcgacgatttgcgggatctcgtctgtccgaagccgtcgcggcttggagtacaccatcccatagccgtccggtgtgatcgccttgtcggtgcttgagatgggagccaatccgtcaggctggaaacctgtagcagagcatgcaggatgagaaacacacggcaaattcggatgtggattttcatccagcgacatccctcgttattcgcatgtcttctaaatagttatcaaatttttttaaaaaaattgacaacatagattaatacgaaatatatcactccacaaacatgcaaaaccaaattcaacttctataagttgcaacaaaaataacaaattaaactgaaaatagttaatgcacattcacaactatatttgttatttttgttacaacttgtagaagttgaccttaaacttgcatgtttgtggagtgatatatttcgtattaatctatgttgccaattttttttataattttttataactatttaggtgacatgcacgaaacgaggggatatcccctcgagggatgatttcactttcccggcaaattcatcaacaagaatgtacatatttcgtggtgcacgtaccgttgttggagactcttccgacgtgccagagctggcagatgaagagggcgcccttgcggtggacggcgtcgacgatgggcttccacgcctcgacgtgctcccgcgtccggacgccgggtgtctccgggtagccctgcgcggtggcggagacgccggtggcctccgtgatgaggaggccgccgcgggtggcgcgctgcgtgtagtacagcgccgcgtgcggctgcggcacgttgccgtaggatcggcaccgcgtcatcggcgcgagcagcacacggtgggagaggtcaagcttcgaccccgggcgcccagcctgcttgtacggtgtcagcagcgggatagcctgatgatcgtcgttcgccgccgcttgatgatgctgcaccatcttgtctcggttgattggtgattgctctgcttggatgatgtatgtatcaatcggcgatggaaaactaacaaatgcgatgcgatgatctagctaggctagctctttgctctgttcttgctaaacgctttggctgtgtgccgaatggggttggagtttggttgtatttataggtgtcggagtggaccctcgcgcgtggcgacggcggttttctccattgaccggcagagtacgctaatattttcgatctgcaaaatcgcgctgcgctgctggctccatatagatcgttgactcttcctccgtaccaaccatgccatatcgtgatttcgtcagccttgcgtcgtgaacttggtctgcgtaacaggcagcagccctgttgtctgcgtatcaggacatgtttcgtttgcatgacgagcatattacacatgtctgtggtcatggagatatatatggtcgatcatcagcatgaacaacagatgacgcaggtacaccatatacctatatttgtgctcggccaacttcatttcttaagcacctaagatgacattacaaatcaaaatttgcaccagagtaacaacacaagcaaacaaaaatcacaccataaagtcgtaaactaccaaactgctttgttcgttgattttggatgataaattagataattttgtgattactgatatatttgggttctaagtccataattgtgcaataacatagcttgaatctataaatttgtaatttcgggattgtagtttaaatgctaacgtcttataaaacataatttgaaagtgaataacttcagctatacaaattgtagggaataaaaatgtttgaccaactttttgaatctaaaattaaacatttgaactgaattgcagtgaaatttgatgaaaattcaaaggggaaattacaaaatcacatttttctctatttttctcccctaaaaaaaatgaaatgttatattttaaaaattaaccacaaccaaatttggaaatatttccatggaggggtagggggggttgaaattacctttaatattttgaaaattctaagtattttttatttcatttttttgatcaaatcatcatgtccactccgatttttagagtcaaaactgtttttaccttgagatctatatttttaaaatgtagaaacaagaggcaatatagttattccctccgtcccaaaatatagcaacttttggctatgaatctggacgcatagttgtccagatttatagctaaaaatacttatattttgggatggaggtagtatttgtgaaaaatctcgtggtcaattaacagattgagtataaaaaagaacaaaacaacttaagggtataaaggaaacatggctaaatttaggggtatgggaatgatggagcaaatactcaatgacacacaagaatttttttttatatgaggatcatcgcaatgatatctttactcctttataaacatcaaaacataagtctgcctcaccgccacaatcactaatatttgggcctcacaaagtgggccccacatagctagttcttatgaaaatcgatgacctctttctttcttatacccctccagttggatttttttactgtaccctcgggtaaatatggatcatccattcgttgcatccagcggatcatatccgccactactacactgagtattatggatagtattatttctccaagggtagatttggaaaattttgcatggtaaagaagtaatttcgcatgtgttaattaccggttaatttttttttctaatctactctattttttacgccatctcttggttttctcagactgtaggtgggcctgtcctagtgatgaacgtgcaagtgttcatacgggttttttgtttttttctgttgattttgttgcttctaatccggagagaaggacggttcgccgatccctaattgcatgaatgcaaacatggttggaatgcatcgctgctctttcttcaaattagtatatgcatatacacatgtgcccgtctaaattgatggaggattcctaaaaataaattgatcgagcattactcctgttcaagacgccagtgagaaggttaagacgccggtgagaagttatatgaaccggcgatgaagcagccggcgtcgcggcgaccttgccatgatccgtcgattaggataattgcagcgccaagattacgagcaatacccttctataattgaaattagagttgaaagtcaaaaataccctaagcatttttaaaagccctaaaatacccaaacaaatgaagggtcggatttagtttctactacactactaccaccggtagtaaaatgtactgtaaaaggccccctccagttttgtattctctctctctctctcccctttatcttccattctataatttggacctgataagcaaaaggaaaaagtacgaattacccccctaaacacgaaaaccaaatatttttcacctttaactatcgataccggatgaaactccccctcccccgagcagttttgcaagcggttttggtctacgtggcagtccagtcagcaattcatttttttaatcagcgggccccacctgtctgtctcccacactctcttttttccactcacctctctggctgtgttcggttcaaggggttcccaacccctttttctcgttttccgtgcacacgcttttcaaactgctaaacggtgcgttttttacaaaaagtttctatataaaagttacttaaaaagatcatattgatccatttttgaaaaaaaacaaatatttaattaattacgcgctaatggactgctccattttccatgccggagggtaacgttcccaacccaatgtaacgaacgtagcctctatctctctccaaaatccactcttttctccctccctcaccacgaagacggcgggcggagcttcgggtgacgggaggagggggcatcggagctctagccggtgggaggagaaagtggtgggaagaacggacaaccaaagggcggtgcttggggtaacggaggggcacccgcagctagcggtgctcagggagataaaaggggcgatggagcgagctgaggacgacggcgggccgagcttggggcaagggggcgacggagcttggggcggtgaaggggcgctcgtagccgccggcgcgcggctcgttgaggcagcggaggggatgcccgcagccagcggtgctcggggaggtggagggggcggcgaagtgatccaaggatggtggtgggagaagttcgggcggcgaaggaagcacccgcagccatcgccgcgcggctcgtcgaggcgacaaagggggcgtccgctgccgtcggcgctcgagccacaactgctggcatttgagagagagagagggtgggtgagaggggaagacatggagtggagagatatccgacaggtagggcccattgtttctttaataaaaaaattactgactagactgctacatagaccaaaaccgcttacaaagctggtcggggttttttttatatggtatcgatagttgaggggtgaaaaatatctggtttcgggtttagggggataattcgtactcacctgatagttggggagggattcgtactttttcctaagcaaaaatatatgatacaattgctggggcaagaagaaaacatagaagctctaaaaaatatacatatatgatggacaacattaataaaaccataaaaggcaatctgatgttaaatgataagaacttctcaaatgatttaatcatgagcatgtcttcttttcatctcgaccagagagcacatacaccctctaaaatatttcaacagaagcccataatatcatctataaagaggcccataattgtataatttttttgtgtgcatgtatgctaaagtgtcttaagggcttgcccaaaaataattcgtacgatcggcattgtcagtttaggttttagaggatggatttctagccattatcaaaaataaaagttaaggtatttaatttggaattgtgacaaaaaaaaatttgcacaagtgatggaaaccattgtttggaattaatttggatttatatgctaagtaaattcaaagagagaaaagttttttttaacaagataattcaaaagggacccatgctgggatgtaaaaaaaaggacagcacatcaacttataaaattacaaaagaacacatatatttctcatgtggtgtgaatacatctgcgtttattaatcccaatatatttggatgcataactaatcaaatatcaaaatgaattagttgcagacataaaccatcaaaaaagagagaagaaaatgacatcttgcacgcaggcatatactaacactgtttacatgaatcgtgcacattattattgtggatatatagaaccaacaactaaaatagcacaaaatctaagcatcagcaaccgagttgttctgatcctcatcgaggaaagggtagtccgtgtatccaacaattgggtcttgagtgtagaaggtgttgcgatcatacttgttcaatggcgcatcaagctcgaacctcttaggcaagtcagggttcgccaagaaaagccttccaaaggagacaagatcagtgtagccattttcgatcaccttgttgccttcctcccggtcatacccaccggcggcgatgaacgtgcccttgaaagctttcctgaatggcagcaggccgtgctgaatctgccggcggccgtcgacgatggccatgcgaggctccaccatgtggcagtagaggaaaccctcgtgcttgttgagctgctccaccatgtacgagccgagagcctccgggtcggagtcgacgcagtccatgaagtccaggaacggcgacagcctgatgccgacgcggtgggcgccgatctcgccgacgacggcgtcgatcacctcgacggcgaagcggcaccggttctcgaggctgccgccgtactcgtcggtgcggtcgttggagctgtccttcatgaactgctcgaggaggtagccgttggcgccgtggatctccacgccgtcgaacccggcctcgatggcgttccgcgcggcgagcctgaagtcgtcgacgatctgagggatctcgtcgacccgcagccggcgaggcttggagtacacgatccctgaaccgtccggtgtgatctgtatgtcggagcttgagatcggtgcctgcccatttggctggtagtctgttttgcaaagtaaattcaagagcagaattagaacactatcgactaatgatgatcgttactaaattacatggtaatgctaagaaattaatttatgaacacgaacataaaacattcatgcgcgtttgacgagtgtttaccgttggtggagactctcccgacgtgccagagctggcagatgaagagggcgcccttgcggtggacggcgtcgacgatgggcttccacgcctcgacgtgctcccgcgtccagacgccgggtgtctccgggtagccctgcgcggtgtcggagacgccggtggcctccgtgatgaggaggccgccgctggtggcgcgctgcgtgtagtacagcgccgcgtgcggctgcggcacgttgccgtaggatcggcaccgcgtcatcggcgagagcagcacacggtgggagagatcgatcttgccgccagcctgcttgtacggtgtcagcagcggcatcgcggcttggttgaccatctcgcctcggcctttctcaacgcttctgcctctctcttgcttgcttctgaactttgctctgcttgacttcttgatgaacgcttttggttgtgatgaactgcatttagtcgggagttctatttataggtgtccgtgcttgaagtgggaccggcggctcggcgcactttgtcattgaccaatcatgcaaccaatcatccatgtgcatgcagagtttcccattttcaatggttccctgcacgatatttctgaccccgttctcatgtcactttcttcgtctcacgtagcagccactgtctctctgacgaatggaaatacgtctattattactttatcgactattaccatatccagaggcgtttcttttttgttttcatataataacaaacaatacacgaggtgtggtttgaggagtctccagcagcatgaccaagcaatgacgcgagcataagaaaggtgcgtgagtgatcaacagctgatcatagagattctgattgtcaaacatcccccactgtggcggtttgtaatttatttgtatcaatcgtgcgccaagtgttttattgataaccattttaatttgctgcaaaagctacgggtatggattatgtatgcgctttggtcagtggggtgaatatcgcgcgcacacacgtaccagctgatcaactgaagtaatcagatcgatggtactcgtagtttactcgaatgactgatgctggttattaggaacttactccgtttcacaatgtaaatcattctaacattttttatatttatattgatggtaatgaatctagataatgaatctagacatatctatctagattcattaccatcaatataaatgtggaaatgctaaaataacttatattgtgaaacgaagaaagtatgaatttttctacataataaatatgatttccatcgtcagcctctcctattaatcacacatagaaaatgttctaattcaaatatgaaaaaaaaggttgggacaaacccctaatcctatatatctataaaattcatccccactaagatgtaattaatgctaattctctcttctctcatgaagccacatcatctcaattatttttagtctttggatggttcattaaagatgtaaattgcatctctcctcccaaaagacacaccatacaacaaaaatcatttataaccttagctaaaattgatgaagatacaaaaatacataaacacatgaaataaatggtttaataggtaagaaagaaaattttagaactcatatctactatattatcacaaaattctcccgtagcaacgcacggggtacccatctagtttactttaatttgtgaccagctaacttaaaaaaagatccctttgttacataatataaggatttgtagggttggacacggtattaaaaaagtggttataattgttatgattggttgaaaagtgatggtaggtgaggaaattgaatggtgggggattgtatttgattgaaaagaaaatgttggtggtgaagttattatattttgaaacaaactttaaaggccaggagttgttatatttagaacagattgagtatataagttatgttgcatcattctataggtgctagatcacctaaagtaaaataaataaccctcagctcgatactagcttcaaaataaataagattaccatagtttgtggtgttatgttttttctttgaaacagagagctattttcaagttactcttttagagcaatcttaacaaaccatttctctgttgcacattagaaatgttccctgctatctataattcgtaattggtagtattacgagagaaagttggacaacagttaatctcattttctttgtagaaggcaagcctgcttaattaagtgcttatccggatagcttaactaaatgtgggagctgacaaaacagtggagccaactttaacaaagggggcggatcacaggtcctcgaggaagcatcgtactcctcgtgttcagattcgttgtactatataacgttacatccacatcaaggctgatttttttggatggaaggagtagaagataggcatcataacttttttagaaggatattttacccggactctgtatccaaccggatatatgtatttttttaaaaaaattaggaactgagagagtagaagataggcagcgtaacttttctttttgagaagggcattttacccggcctctatatctaaccggatatatgtattttttttaaaaaaaatcaggaacttagcttatcgaacagaaaattagccatcaaataatttaatttaaaattcgctcctataaatatttgaactcaggaccttagatactactcagatcactgcaaccactagattacatgccctttcacggcagcataactacttaatatctccggggattaagaaaatcgatgtgcatgcagccctgcccagatatatgtggcgttgagcgctgctacgtcctgccattgccaacatcagcgaatacgttgggttcggcctacctgtgttgacgaacggtgtcgcctaatgcctcgtgctggctcactgtgcaattaagactttctcgcagtcaattatccaatccataatgcgattgtgacgatcgatctcgcagtgtacttttgtggtattaagttacatgcatcaattaattcaacacagaaactttagtagatgtgaaacaattttgctatatatttgtctataaattctcctccaaaaatttgacaaatgtaattatagtataatcacagtgtaattacactgtaacttctatgtaactttcaaaaatctctccgtaacatgttatttcggtaaaatggaggtcgtgggaacaaatcctttcacatatatgtgtgctatgatttttttttcttcctcgctagaacaaatcttataatagatctaacgattcaaaattacgtgaaagttacatgcaagttacagtgtaattacatgcaagttacagtgtaattacatacaagttacagtgtaattacattatgattgtactataattacatctgtcaaatttttaggagaaaatttgtcgacaaatgtataggtggtcccgatgtgaaaagatggctaattcactcactttatattccaattaacacactccttcatacatggtcccctaaaacctatagcatggaataaaagtgaactacaattttatttaattacgtgttagctagaatatatatgaactctaagatctctagctcaaatatcatattgagttatacgcaccgattattttaacttaaaagcttaatctaagtcgataacaaaagacaatacactcacttaatatactaacatgtaggctagaataaaagtcatgccgtccttaacctccgtaagttatggattctcatcacactcgtagccctttttttctactactctactctacatcgaagggtttaaaattgagaaactagccaccaagttaatcaagctatataattgagaaaccatttagtaaactggccaagctgaaaaggatcggaggtaattcaaacttttggcaaaacttatttaaattttgccagtttctgtcgtcaaaccaacggtaatcatggttatcgatgagatcattgggggagctgtatgcctggtgactaaatggtttttgcaaaccttgcaacacagtgccgtttactccaatattagttgctttcatactatatacctataaaattcgtaaagttcatccccactaaacgtagttaatataaattctctcttctatcatgaagtcacattatctcaattatttttaatctttggattattcatcaaaggtacaaattgcaccttttatccataaaagtcataccatacaacttaatcatttatggtctttggataattgatcaagatacaagatacaacatatataagcacatgaaagaaaaccgtatagtgagaaagaaaagaatacaactcatatatatttatttcattacaattctctgacaacaacctgtggggtatccatctagtaatactggacacttcacaacacggtgatgtacatacaaattttagttttgccctctttaatttttcctgctacatatttgcttgatatatcataaaatttagggaaaggtccaagtatctccttttaaaatataagttttattttgtttggttaggataagatttcatttacgtgaacttatacaaagctttgaccaacactttactctattggatatagtttttatgacacaaaaatttaaatttattatatccgtattaaaaatatactcacttatgattattcttttccatgatataattgatattctatataggataattttttaaaggttatcctaatgaaataaaatatgttttaaattttaaaatagagggggtggtgtattagtgttggtgctctttgaagaatagtatacaactgttgatgcgggctagagaagaaaagaacatattttttaagcggtatggatataatagattaatctcgggcttatctgatttggtgtcctaccaaatcattggtagtgtctgttataaaaccagccccgaaatcgacatcggtagctaaacgcggaagaaaacgccataggagatccaaaacgatagcgacactgagacacgatatttggtaacggagttcagccgtagcctacatctccggggcattgattacgggcgctcctccccgatccagcatatacaacgtatcagagttacaacgactcacggccggtcgccgccggcagccgctccctcacgctatgctaagtcgccatgcggttacaacaggcacgcccctctatttatgagagatcctaggatagagtccgactcatactctagtcctaatacctattacaactccaagtcctaaactgtaaccgactacgtacacatattcgacacaaactctaacaaactccaccttggcaaatatgccacgccaatccgaatctgttacttgctcgaacctccgtgtaccaggacttgagttggttcttccgccgctcacgccgagtcgcccgacgagcctacgccaggctcaccgccttcaggatcgtgcacagcaacaccagcataaccattttccatgactccacctgcaacagcactcccttgtaacttgtacaaacatgagcttgtcctctcaccagtcataacagtcttgccatccttcatgatattcatggtcttcctatcagaatccacctgatacaaccaacccgtctcatgtaggcttccaagcgaaatcaaactcttccttagtcccagcacgtgtctcacatatgaaagtagcacctcatttccatcatacatcttgaatttgacatcgcccactccaacaacacgataactcgtgtcatcacctaagtaaacagcaccaaaatcaccagatttgtatgaagagaaccactcccgcttcgatgtcacatgataggaactagctgagtccaacatccacgcttctccagacttctcgttagacactggagaatctcatgactgctgctctctgaatcatcactatgggctactaaacttgcactcgcacttctcctcttcttcagtaatgggcaattcctccttatatgtccaaactcatgacacttatagcaaacatgatcatgctccttgctcttcgacacccccgcttcatgatcatgctttgccttgaccagcaaactctcagcctgagaagcctccattgcctcgtttttctttgatcttctcaagtctcgtgcaagcaacgacgaaattatctcctcagttttgacagtatccttgccgtacgtcagggtagtcaccacatgttcataagacggtggaagcgagcacagaagaattatggccttgtcttcatcatccagtttcacatctaacttacttagatccacaatcaactgattgaagacgtccacgtgcatcctaagatctgactcctcttgcatctgcaaaccatacagctgttgtttgagatacaatttactcgttagcgacttggacatatacaggtttgccaacttgtcccaaatttccttcggtgatttttcgtccatgacctggtacatgacagaatccgagagactcaagcgtattgttgcagctgcctgcgccttcatctcctctcacttgctagcatccatcttttctggcatcgtctcctcaagagccttggatatcccctgttgagccaatagattcttcagcctcatctgccagagaacgaaattcccggtgccatcgaacttcaccacctcaaatttggaaaccaccgtcgccgccatcgatgataatcaactcaacagatgttgccctattaaattgatctgccctgattaattgaccccaccgactaactcgaacagtaccagccggaccgaaccgtttttttttctctctccaaaaaaccggaacaggtgtcctttactcggtcaaagaatcagttgatgcggtcaaagggttacagatccaaatcgaatcccgtttcttgctccttctgcccgactcctctcggcccgattggcgccgccgcccagcgcctgccgtgcctctctccccactgaccagccgagcaccagagccgccgcaccccaccaccaaaccgcgccgccgtcgaaaatcgcctaggttcccgccgccaacgcccgtcctcgagtgcatgcctgcaggtcctgctgtcgacgcctctgaagacccccggtgatggacgacgctgccccgacgcaggagaggacgcctcctctgccgccggtgtccgccgcctcctccaagagccggcaccgccgagcttccgccgcctgcacctgctgctcgcccaagccgtgcagcgccgccggagcccgacaccgcagaccacctccgcccacgaaatccaacaggtcagatctcgccttgctttggtagtttgcccgattgcttgttgttgcaatcccgtggtcctctgctgcttttatttggagaaattcgagtccaattcttaaccaaatcgaagaaactctttgttccccttccgtgtacgagttggtcaccggtttggctttttccatgcgtagccaggaaggactcgtaatccgagtctatccgctgtgcctgcaaaaacccgagtcggtttcctgggtaaatccggcccaaaacagaaccattttgctactctggactccggtcacagtagtctacggcttcgacatgcaaacgtgcacgccgccacctttgatgacctcctcagccaccacgcacccgtacgacctctagcgcagccaaccaacatcccgcccaacctcgccagcgaccaatatcgccggtcagttgcaaccaatgcctttgctgtactaacacgattgaataaagcattgacgatctgaattgaccacccctctgcctgattccatcgcttgtcgtatgtacgccttctctatagcatgtccatcacgcaattacctcatcaacaccttcaaaagctgcctctaggaaccacccgctccgacttccgattaaacaccatcaatctagtcgcgagccgaagccgacaagttgcatgccgtcttctcagccgcgaacgacccgagtgctatgtttagccgtctccctgtcgaacgcaactcatcgaaaggcccaggccaccccgcccagagtgatcgatccacccaccgagaacgccgatcgcctccagcttcaatcaacccgagcgtgcggccgcacgtctccctattgagagtagctcaccggaaagtccgagccacccgctcgaagtgtccgacccaccaattggatcaccaatcgcttctgccgccatcaaccagagcaccacgtctagtcatctccctgttgaaagcagccatcgaacggttcagaccgccgcctgaagtgttcgatccaccgatcaaattccgttgatcgccgccgtgctctaccttgcgcacatgtccctccctggacataaaccacgagcggcgcggtgtgaagcacctccatcgcgcctctaccatggacctcccgcaagctctgataccacttgttataaaaccagccccgaaatcgacatcggtagctaaacgcggaagaaaacgccataggagatccaaaatgatagcgacaccgagacatgatatttggtacatccttttttttgcggcatgctctctgatttacggattcgcagggggccgagggccaaccttagttgactgacaatgacaaaggcttgagaaacaaagtagtgcctttgaaatggaatcttaattaagtagtctatcagtggtgcgaagcagctttgccccggggagcgaaaggttataccttgccgtagcctacatctttggggcactgattacggacgctcctccccgatccagcatatacaacgtatcagagttacaacgactcacagccggtcgccgccggcagccgctccctcacgctatgctaagtcgccatgcggttacaacaggcacgcccctctatttatgagagatcctaggatagagtccgactcatactctagtcctaatacctattacaactccaagtcctaaactgtaaccgactacatacacatattcgacacaaactctaacagtgtcaaatcatgggtaaattttgacacttctaatggtttagtagagttgggttataggagttgcattacatttggtaaatttggcattaatctaaatatttataaggtattatttaaagtgccaattatttggttgggtaagttttggcatcaaaccacaacaggcttgacaacagcccatcatgcccatggttacatacctacgtaaacaaaattcacctcgaggtgcaaaaaattgatatacgcaaacataaaaaaaaaagggggatggatggaagtgagggtcacttatgagtgtatcacaaatatagtgcacattactaaaccgaacatttcaatttgacaatttaattgaggattaagcataagtagcagcgccctcgtctttctcatcaaggaaaggatagtccgtgtagccaacaacaggatcctgtatgtaaaaggtggacctattatacttgttcaatggtgcgttgatcgcgaacctcttgggcaagtccggattggccaagaagtgcctcccgtaggcgacgaggtcagcatatccatcggctatcaccttgtttccttcctcccgatcgtatcctccggcagcgatgaaagtgccattgaacagcttccggaatggcaggaggccatgggtgatcttcctgcgtccttccacgatggccattcttggctccaccatgtggcagtagagaaaccccgggtgcttgttgagctgctgcaccatgtacgagccgagagccaccgggtcggagtcgacgcagtccatatagtcgatgaacggtgacagcctgatccccacacggtgcgctccaacctcggcgacgatggcgtcgatcacctcgacaacgaagcggcaccggttctcgaggctgccaccgtactcgtcgctgcggtcgttggcgctgtccttcatgaactgctccaggaggtagccgtgcgcgccgtggatctccacgccgtcgaacccggcctcgatggcgttccgcgcggctcgcctgaagtcgtcgatgatctgagggatctcctccgtcctcagccgtcggggtttcgagtagacgatgcctgaatcgtccggtgtgatctgcctgtctgtgcttgagatgggcgcctgcccgtcaggttggtattctgttggtaattaattcatggtttgcaattcaatcagccaaagagaacaatttgcaagaaaccaaaaactcaacaaaaacctatgaatcaattgccagcagcttaactatgtgaaggagtacataccgttggtggagaccctgccgacgtgccagagctggcagatgaagagggcgcccttgcggtggacggcgtcgacgatgggcttccacgcctcgacctgctgctgcgtccagatgccgggggtgtccgggtagccctgcgcggtgtcggagacgccggtggcctccgtgacgaggaggccgccgctggtggcgcgctgcgtgtagtacagcaccgcgtgcggccgcggcacgttgccgtaggagcggttccgcgtgagcggcgcgagcaccacacggtgggagagctcgaaccgccccatcttgtacggcgtcagcagcgggatctccgccgccgccgccgcgtccttctccgcctcgcgcgccatctcaacgctagtgtggcctctgctactagctcactgtgctctgctctgctcctctattgtgttttgctccgagtccgatggtccaagggggttgatgatgctctttcatttatagcgtctgagtgggaccctggcggcttgacggaaatgtgcgcactgctattccatcggatctttcctgcgtcaccctctccgtcatcgtctggtcggtaggaaagtctctccttacctgggagagcgcactgattttcctcgtgtgggggaatgcgtggttctaattttctaaacattctttaatgcaacagccgtctggtgctgaactactgatgaccggtgtcaatcaacaagagtaagagatgcactgagctgttagttcttttttttttaacgtataggtttcttgcattatcggcttcaccttttcgcttatatttatatttattagtcaaaattaaaatttcaaccttaaatgtagagttgattttgagatttttttttgtcatcgcagtttattttttatcttttgcttgtttctcttagatcgttaagaacatgtatataaaatatatacaacactgcatctaatacaattttactagtagtagtaacccacgggctattattattgatagtataaataaaattttaattgtagcaggttatactaaagggaaattgctttgcgtacgataaaatttgtacgattttagtacgatcctaccatgcatgtcttttttttttattgggtggaaacatgttggaccccacatttgcatcacacacaagagactatgaagtatcgtagtctgatcgtatgaagttttatcgtacgtatagcaatgctcatactaaaggtagagtccacaccagttatgagttgctaattatgaatacgaatttttagaattaaatttcaagataggtacgtctttatatttattcaatttgaatttttgagttataaatattagaagaactaaaacttaagagttcatagtgataaacaattgaatgttttggttaacaggttctccatatatagaaatacaacctaagtaataaatgatcacatcctttgagttagaacactactacacgatagatttttgtggacactaccctcttttgtttccatgcggttcgtaagtggaaccgcacaaaaaaataggggaaccggggccgagctgtcgcccgcacgggaaaatcaattttctcgtgcggtcctcctaaatggaccgcacgggaaaatgagtcgattttccagtgcggatctattaagagagccgcacgcaaaaatagtattccttcttttccctcccacccacttcaaaatttcccctcatatatctcttttaatttctcctcacacccctcccctcttatctctcttctctctccccctctctctttcacgtctctcctcttgtctcctttcggcgcgcgggtgacggcgacggcggcgtgcggcgacagcgacagcggttcgcgtcggtgcgcagtgacagaggcggtgcggcggcggcctcagctccacacggcggcggtggaggcgcgggatccggcgggcggcggccatccccgctcggatccggcatgcggccggccttcccccgcgcgggatccgctcccctcccctccccttccttccctccctagatccggcggaggggaggggcgtccgcggcggtgcggccagaggggagggcggatccggtgggcggcggcgcggagtctagcgggaggagggtggcgcggaggccgccaccgatgacgatgaggtggaggaagcggcggccaggagcggcgccgcagctgcgcgccaacgagtaggcgcccatcgcggctgctggcggaggcagcgcggcggccgccgccgacgatgacgatgaggaggagatggctgggatctggcagccgggagtgtcgccgccctccccacgccaggatctaacggtggcggctgccctccgctcggatctggcggcggcggtggcagccggcgtggcggtggcggggagtagcggatctagggttaaggttcggtaatttgtgaattttattttttttggatttttatttttccgtgcgggcgacataagcaaccgcacggaaaaatccgattttctcgtgtggggcgccacccgcacgcaaaaatacgattttcgcagacgaagtgttgcatgtgggccattcatccgcacgcgaaatttttcttgaccgcacggaaaaacccatcccgtagcaatggaagcttcttcacaatgtctagttagagagatttgtttcggttcaataaaaagtacatcaagctaccggtacctcacggtaccaaatcatttccgatcgttggatctaacaatgcccatcctgtctagctatatccaataatcgaaaacttggtaccatgagatactggtaccttaatatactttttgctgaaccggagcaaatctcctagttagaacatatatggatagattagtggtatgtcgaggacaggaaaatgacacatcttccgagacacccaagctactgaggtaaagattcacgcaccaacaaatttgacacacaaagtgccctgcgggaaccatttctcaagcaaaggtccgcaaggaatgggggaaacaggccaacaagacctcattaattaggataaggtggctcagggcgggggagaagtactgcatcagccaccaagacaagggtgatatgtgggtgtgatcttcaccccacgccagaatcgccgtaggcaacgacacggtgactccctcatcaaccacggtgtcatcaacctcgccggtgagccaggagaggctctcctgatagattgcgatatagactctcattgaagcgggggacgctactagacgatgtggtgggtggggcaggctagatccgacaaaggagagtagggttttgaaggcatggcgccaaggtggtagatatgaggagagaggaacaagatatggggccgacttgaaacgagggaggataggggagggcgggggaggtggatccatggaggtgatctcgatcaatagatttaatgtacacatttttaggtctctgatttgtcacatgatgatgatgatgatgatgatgatgattataatgggtaaaacaagtcaacgaaacatgtaacccatatatttggcagtatcaatacaataaatactcaacaaaagataaccttaattaaattacaaatatgcatgcacagaaatctactcatgcgtgtttcacaagtacacattattgatccataaaaaaaaactcggcgatttaggtgataatcaaacaattactgtagctgagtcctctttcttctcctcaaggaaagggtaatccgtgtagccaacgacgggatcatgtgtgtaaaatgtagatccatcatacttgtttaacggtgcattaagctcgaacctccttggcaagtcggggttggccaagaagagcctcccataggcgacgaggtcggcatagccatcatccaccaccttgttcccttcctcccggtcataccctccggaggcaatgaaagtgccattgaattgcttccgaaatggcaggaggccatggttgatcttcctccgtccttcgacggtggccatcctcggctccaccatgtggcagtagaggagctctgggtgcttgttgagttgccgcaccatgtatgagccgagagcttcggggttcgagtcgaagcagtccataaaatctatatatggcgacaatctgatcccaacacggtcagctcccacctcggcgacgacggcgtcgatcacctcgacggcgaagcggcaacggttctcgaggctgccaccgtactggtcggtccggccgttggcgctgtccttcatgaactgatcgatgaggtagccatgcgcgccgtggatctccacgccgtcgaaccccgcctcgatggcgttccgcgcagccaccctgaaatcgtcgacgacgtgagggatctcatccgtccgcagccgccggggcttggagtacaccgtgtgtgaatcgtccggtgtgatctgcttgtctgtgcttgagatcggcgcctgcccattcggctgttgatctgttggttcatgtcgcaattaatcgaatcaatcaacaaagcacaatttgcaaagaccttatattgatagatcaatcatcagcaatatagagtgagatttgctccggtcaaaaaaaaaaaaaaacctcgaggtaccggtacttcacaatactaaatcacctccgattgttggatctaattgagcatgatagatattgttagatccaacgatcaaaaaatgatttgatatcgtgaggtactgctaccttaagatattttttgttggactagagcaaatctcattttctctactacttaaaaaatctgtagtggtggtcttgatttctgacatagcagacgcatctaacaaacacgtctaatctcaaccatccgattttcatatccaatggcgtcaaatctcctcccatcgctcctctcctcatcacgcgccacgcccactcctttccccacgccgcgtccttcgccctcctccctgcgtcgcctcctcgtggtcttgaatccaacagatcagatcacaattcaatcttccgcacgcgccccacgcatcgtcgatcgcacgcggcgcgcacacacacccctttcccccgattttctctccctctcaacgccgtctcccatctctgtttccttcgcgtccgcctcctccgccccgcaccaaatcttcgcctcctcttctcccgcctcgccggcgcatggcggctgagggtgagggcaggctggcagctgatgaaggcacactacgacccaatctccggctcgtcgaccgcctccacgcacgccccgcccccgatctccgccgcctcttctcccgcctcgaccgccttcacgcgcgccgccggaagccaatctcctcggcgccaccccattctgtgagtagtccgcctcctccgtccggccccctgtctccgcagcctcttctcccgccttgcaggtgccctccaactcaagagggctgagggcgagcacggtggcgcatggcgactgagggtgagtgcagctgacgacgccacatgacgaacccaaccggctgcacggttatcttccccccaaaccctaaaatttccccatctctttctacaaatccatctacatgttttcagatcggggattttgtcctcttgggcgtgttaaatttcaaacatgggaattagagatcggggattttgtctttgcctgccatgtttgtacaaattatgctaaatggacaaatgagaacactaggacagctgcttgtgtagagactgaatgacactgttgcataacactgttgctggatctcctctctcttgagacagggttatctttaaatcagtgcaagtacgtactgtgttctcaacaagaattgaaaacccaaatatggatttagttgggcatgatgtgtccattaaggtaagcgatcacccacataacccccacaaataatagcttcagaacaagtagattgttacatctgaagaaatatcatatcactcctgggcatatattccatatggacaatatgatcgaacttgtgaagcatcagacatgcagaattaatttttttccccttattttcttgattttgctgcaattataagtaagcattgttagtatgatcccatggcgtgtaatagcagttctgaactgatagatacctgcaccctcaagaaaatggtttctaccgtcagagtaacaggtcagggtcatgctaattaatactccttctcaaatgaatttttatctcaaacagtctcaattcaaaaaaaaatcagttcatcagtttgtcaaaaattgtcgctggatggatcggttttagcattaatattgaagcaaataaatgcataggtgaattagattttttttttctctataaggatattttgtgccacttgctttggttgtcggttagttcatccatgaactcggtagggaacttgtctaagcaaccaatggtcaattttctcatgaagcagtctttttttcttaccagttaaaatgtttccagctacaacaaatactcaggtttcatttcattgctcaatttcagatcatttgtcgaggttggaattgctacgggatcaagaaaagcttcgtcagcccatgccctcgtctcattcctcagtttatagagtccattccaagcaggtacaatatacatcctcggaacaaataaatgtatttggttttataagaaaaattagtttgcagtgcatcagtgatcctatattcctgcttattggagtacatacatatatgattattggcgtcatctgtgatcagttccctaggtttagatccattgtgttatttagaattagaatggtcatttattcagggggctttgacctgttagtaacccgagtcaagtcatg

SEQ ID NO: 46465 - DNA, 2107 bp, Oryza sativa
aaaaattaagaagataagactaatacaacaagttaatacaagctcaaaatagtgaacaaaaagagaaaacagaaatcatgaccaactaaaccctctcaagattggtgaattaacctaaccatcaactaaaaaaatcctacaaaagcataacagagaagtaggatgttcccaaaattcctaaaataaaaggaaaaaatatttttcactatcctaaacaaaggacgggaaggaagatagcaagcatatatcctctaaaaattagtcatccttcaaaacggctcttcctagggtgaggtattatctgtccccataaatagaaaattccaggagtaataaataggattaaagtattgatataattggaattgcagaaagaaatactccatactaatttactaaaaaaagaaagtacctcatccaaaggactcattttatattttaggattaaacaaaagggttcgcaaataaaagcgcttagggatagcttcatcagatatggaggcctattttttttttatacaaagcagagataactaatggcacaaaagaaaacaggctatgcagtggatcaggcattgaagaacactattgatagacaacggtgagccatacacaccatctccaggtgccgcagaagtgtcaccgtccacattcctttgactgttctctaaatctttttggtagctctttttagctttctgcagtgaacagtaagttacaaataacaaggcatggtagttcataaatcaaccaattgcaagataaattgaaacaacacagcaataagggaaaggataaattcaaaaagaaaaagcctacatggttttatcaatgcagaagtgtttacccttcacaagctctgtagtttgtgacataacaatatgtacattaggtgattaggataccaacatactggggaaaaaaacagcattacaaacttacagcttctatttgcttgagggcccgggctgcttgctgctgctccttttctttggcagcaccctccttttgcatggttgccaatcttttagtgacattgtccttgtggcgcttaccgatttcatgtgttctgatgcttagcgggttattagctatgtaaatcttacagaagtcacaccatttgtttccttggctcacccagtactggaaaaagataggggaaaaagttatttataacaaaaacacttgcaaagttggatgcttgtgatgacagtgtacaacaacttaaatgtcaaagaagatgatcgcagataactttcaaagggctaatagggaccctgtattcctaccagaaggaaactacagttgcttcttgtactgtcaccttttcagatagtgactaaataatctctttctcgcaatggtaaaaaatattgatgccaaaaagtcaattagcaggattggatgcttgcaacaacagagtttaagagcataacatagatcatatgaatgattggacacgaattttttcgaaaggaaaaaacaactaactattctcctataaacgaacacaataggcatttgtatcctgatttattcagaaagagaattgataatattgccatgatacatcacattgggactttcagtctctaatctccacttagcatttcaaattcaattacagttgaatacaaacaagtactaaaaaataccattaacctaccaaaagaatcaaagccctatttggttaactatctcaatctacaaaaacataagatgactgaagcacccatatgaagatggaatcactccagtccagaggcaaaatcttcctcagtccagcctcaccaagccgcatattctatctactctcccatagcatccgaacacacagggacatgcacaagcagcatacgaattacgaaactaaccctaattcatcgaaatccacgagaccaagtgactaacagaggcaaaatccctaaacatcagctaatcctgtataaactcgcactcggaagacgccgaccatcaccgagaaaccccccaaaggagaaaaaagcaccggggtttcgttcagatcgatgcgcgaatccccacagcgggcggcggagggcaacagggcaacgcgcgatgccggaaaattgcggaggaagaagggaga

SEQ ID NO: 46466 - DNA, 1381 bp, Oryza sativa
tatttaagctaacatgcagacttcagtttaattagaaattttcctgcattccgaacttgtttcaagtccatcccaggctattatttctcaaaaaaaaaaaaaaaaaaaaaaaacccggccgaatgtttgtgttatagatgactcttgtctcagaagaaataatggtctattaaaataaagttaggtatggatgtgtctcctgttgcctaatatgggcgatttctggagtttccgaaactcaaatatgcgattccattgccccagactccaacattgattgattttaatgaacatttagtcggagtacatggacaattcaaacagatgcaaactgtaagaggtcatgttccacgaaatgtaagctactgctacactttcttcgagcgatcagtcaaagttttcgatcttgattggagttatatcatctgccaccttaaaattcccgactaatcgagcaaagaacaccatctgctgctccaaagtaaacttgatgttctcagcctgttcaaatggaagagcatactccatcacaaccttatcgcagggtttagggtgtaaagagacttgagactatagagagacaagtgatacagtttggtaccttgcggaaaccatgctgctctccttcgtattccaccaaggcaacaggcaaacctttctcttttaaggccttgtatattttgcgtgcctgatctggtgggactacctggaatgaaaatgaattgaagcagatgaaattgtttgcactttacagttgcaattatgcaccattaatttctcggttatcatgattatgagctcataggaaatgtttcacaaggaaatattgcaggaatgatgagaggcaattatgcatcagtaattcctcagttatcatgactatgcatgagaccaacatagaaacttccggtttatgaactcataggaaatgtttcacaaggaaatattgcaggaatgatgagaaaaaggctcaactacacaatatagaagtatttttttttaaaaaaaaaaatctttaactctaagttataagtacctagaaagtgacccttgcttctccaggtgagttatgaaaattaataaaaaaaaaaagcaaataacatgtgaacatgaaacttattacttgtcttagatctaatactcctgtaataaatctgtaagactaatgagtaccagaggatggtttaggaaaaaccattagttaactataggaggaactaaaatatgatgaattgatgatctgacagaagcggataatctaataaacagaaaataaaagctcgattcaagagtcccacattagcttgtctgctgttctgctagatattgatctctattcaagggtgcaagtgtaacagcggagcatacctcaggggtgcag

SEQ ID NO: 46467 - DNA, 9592 bp, Oryza sativa
aacgtcgttggtgcactcggtgccgtccgggaggcgcgcgaggttgcgtggcgtggagacgaaggacacgcggtggccacgcgacgccacgcgctccgcgagctcgaggtaagggagcaggtggccgaacgcgagccatgggaagatcacaaggtgcagcctcgacgaggatttggaccggccggtgtccatggcgatgttgccagatacagaggagctaaaccttaatctctcgctgtctcatgaataataaacaccggtagagataagaaatcagcaagaaaccatatgcattagctagttgttctttatataaccagtcttcaaataatgattgattttattggtgaaacaatggtcttacctatcgatcgattttttatgtgaaacaggactcaatagctagtggttcttaaatttttattattttctgtaggtacttgttgacagtgaaatttggtaagcccaaagtcatcatcggcttagagtcaatatcggcttcagagtcctgaaatcagccgatgggagtcgacaaatcgccaacaaccgtgttctcgatggaatcggatcaattaaagggaatttatccagaagagtccgagttcaagaagaatgcggcatggcagtttatctattaattaggaatagtttgttagtttcctttttatttttaggaaagtgtgtttagtgtcctataaggactttatgttttccttttatctttagtaaagtttctttcttgtcccataaggactagtatctacccatgggtataaatatgtacactcggggtcattgtaatctatctctacgatcaacacaattcggcgcatcgccaccctttttacttttacttttgtttctacgttccggtggaacttggcacccgacgcggggctgcatcggtgttcgatctccggctaaggggtaagtccaatgttccatcggcccaggcaattgtcttatctacatcggcgtcgttcaaggctgcatcagtacatttgacctcttggattgcactggtttggatgatatatttgcctacctacttatcatatgtctctgttaatctagtcgtagcatatcgatttagctctatcggctgtctctcgctttagagtttctgccggtatcggctaaatcgcgttgctagattagattagtttagacatctaccaccctgaaaactcagtcaacggcttgattgtctagatattatgtttcttttcatacttagtgctgcatcagttaagtttgatctactaagtcgtgcttagaaccataatccctagcctgcttcttgattgccaataagggtttcatcggggtttcagccggtgagttatctggacgttgcatcggcttgtaaggattgcatatacatacatattggatttagccgatgacaacaaaggtttcactgtttaatctaatcttgtagatttcatggcatcggaccgctagccgatgtgtgctttaaccttcggatcagtgcttgttctactatatcatattgttagccgattggtttctactggatattattgttatattttattaccatcagccgattgcctttatatcattatctacattggacatatagccgattgcttaaaccctatcgctatcggctggtaccggcatcggctattatcggctatcggctggaactgctccatcggcttgtcagccgatcggttgttttgatctactatttacatatcttgtcagtggcaggatcaaactgactggcatgcctgtatctcatcatatttggacctgcactggagctaagcagatctcctaggccgacgtgttcaattttttcgtcaacggtattgcaggtctcgatggttcttaattataatatatatatcgtatgcgtgcaacacatgttgtgaataataaataaataatctcaacccaataaagtctgtttctgccatttcactttcgatagattttaggtctatgtctttcatttttctttcgtaagatcttgcatcaaaatttgtgtttatttagatctaacatgtagttacactagttacagtaaacttactaggttacgttgcaccaaaattagattcttttttttacaactgttttgtttctatatttacgatttttggcatgtttgttcctttttatttcatttaaaacgggttgtatatattggatgaaaattatgtaagatttgaagctccaagtctatcaatctattgataggtagtaccataacagtttacttcggaagatcatcagtggacgacactttctactgatatgaattaagagccatagtgctccaaacaccaacaagtagtagacaagcagctcttttacaacatatgtgggaaaaagaatttatttcttaatttaatttgatagttcgtgtacaacaccattgttattcatgcttggcgcccaattcagggaatgacaaggataagatagaagtgataatttctttttaagttttgaatcgatttatggtatagagttgacacaatttgcttatggcgttaattggtctactaaattttagcggtacagatagatacactagcgaggagggaaggaggattggggaggagagggatgccaggaaggagggagagaggtaggggagaagaggagcactgagagaagagggctgccgagctgggaggagggccagcatgaacgaggggcgctaacatgaattttcttagtccgccactagctacaatatctcagcgccagtaagtttggcgttgagctcttattcaaggtggcgcaaatttgccaagatgtcgaagcgcagtaccactccactgacactgagctctctactgctaaaaacagtgtgcattccctcttttatagcaaagcaaggctagtgcagtggtggaggtcttcagtctcgagacgacggtttgattctgccatccttcatgcttgcttttttttttcccatttcactcaacactttttaatcagtagagtgcctagcgccaatgatattgatgctaaactctgatgatatggtatactcatgccactactagtagagagctcaacacaatggcattggcactaaactccgatgacatcacaaactcgtgccaccttggacaatgtgctcatcttcgatgacattgtaaacttgtgccaccttggacaagagctcagcactaggcattggtattgagatgttatacctcaacacagtggcgaatatagaatataaactatgaagatgcgggtgtaaaaatatagtatgactgaaacaacccagtgtgatcataggtgctccatgataggtgtgttgagctgcattagataatgcaataggattttgatagtattagcactataatgatcataggaaagggaatacatatttctcgaacaatattattacattagctcgttaatttcgaaccaccagctacaaactttcaagaaaaaaaatgtattcatgcttgtccgtatcacatgagaagcgttactccctccgtattttaatgtatgacgctgttaactttttaaccaacgtttgatcattcgttttattcaattttttttgcaaatatgaaaatagttatgtcatgcttaaagaatatttgatggtgaatcaagtcacaataaaataaatgataattatataaattttttgaataagacgaatggttaaacgttggataaaaagtcaacggcgtcatacattaaaatatggaggtagtacattattaatccaaataataggctaaaattggattatttaggtgccaattaagcataggtagttgttgactcctcatcaatctcctcaagaaaagggtaatctgtataaccaacaacgggatcctgtgtataaaaggtagacctgtcatacctgttcaatggtgcgtcaagctcaaacctcctcggcaagtcagggttagccaagaagagcctcccgtaggcgacgagatcggcatagccatcagccaccaccttgttcccttcctcccggtcatacccgccagcagcgatgaaagtgccattgaactgcttcctgaatggcaggagaccatgggtgatcttcctccgtccttcgacgatggccattcctggctccaccatgtggcagtagagaaagcctgggtgcttgttgagttgctgcaccatgtatgagccgagagctaccgggttggagtcgaagcagtccatgtagttgtcgaatggcgataatctgattccaacacggtgcgctcccacctcggcgacgacggcatcgatcacctcgacggcgaagcggcaccggttctcgaggttgccaccgtactcgtcggtgcggtcgttggcgctgtccttcatgaactggtcgaggaggtagccgtgcgcgccatggatctccacgccgtcgaaccccgactcgatggcgttccgcgcggctcgcctgaagtcgtcgacgatctgagggatctcgtctgtccggagccgccggggcttggagtacaccatgcctgaatcgtccggtgtgatctgcttatcggtgctcgagatcggcgcctgtccatttggctggaaatctgtcgatttcatttcgaaatttaattaatcaaccaacgagcacaatttgcaatgacctttgaaaaaaaatcaaccaaccaccagcaagtggacgaacctgtggtggagaccctgccgacgtgccatatctgtaggaagaagagggcgcccttgcggtggacggcgtcgacgatgggtttccacgcttcgatctgctgctgcgtgtagatgccgggggtgtccgggtagccctgcgcggtgggggagatgacagtggcctccgcgatgaggagtccgccgttggtggcgcgctgcgagtagtacaccgcggcgtgcggctgcggcacgtggccgtaggagcggcaccgcgtcagcggcgcgagcaccacccggtgggacagctccagctgccccatcttgtacggcgtcagcagcgggatcgcctctttcgcaggtgcgtgcaccatcttggcctggagtgcgcacgcgatttcgtcaggtatagactggtagccgcttttctgttcccaactgcttcagttagtgcaacaaaccaagaaaaagaaaatctaacaaatgtatgggcattcacctcacgagcgcacacgaggtaacgacggcctggattcctatccgtgcgtgaggttttgattgccacaggaaaacggcagcaacacttcaacaccggcggcgaagacgccatggatgtttggagggagagtagagaggaaggttggggaaagaagacgacagtgcgtgtggtttggggatggatgtgctggccctctctatcaccaacacaagatcctggtactagaaaagatgtactagttattggggcggagctagcaccaaaactaaggtggtgcactaccattgaaaacctataaaacttcaatcgaatactgtgcatttcagtgttttaaagtgagaaatcttggctttaggggagttcctgtgcatcagattagctgaacgtggctgactagtactataccaccaacacgcatgacggggacagcgcgtgtggtttggggatggatatactgccactctatccccaccagctattaggacaggtgtgggtccagttgacatgactatacttaggccgtgtttagtttcaaagttttcctttaaatttctaactttttcatcagatcaaaactttcctaaatacataaacttccaacttttccgtcacaccgtttcaatttcaaccaaactttcaattttggcgtgaactaaacacagtcttacaaaggttacaaaggccgtgtttatacctttgtcacatcgaagatacggacacatagaagtattaaacgtagtctaataacaaaaaaaaatacataatccgtctataaactgcagcaccatattgttaaatatatagcaattaggcttaaaagattcgtatcgcaatttacacgcaatctgtgtaattagtttttatttttatctatatttaatactttatacatgcattcaaacatttgatatgacagggtgaaaaaacttgccagaagatctaatcaggcctaaagaatacggaacacagaaaatgaatgaacggttgcaatagatatggactggtagatgtatgcacgaatctccaagttgagaaaattccatatgtacccttgaaacttcacccaatcccttctattctcctgagatttgtttattttctttcatatccctaagtttcaatttggatcccttctatacccctttcatcagttgactattatttgaccgttaaatttctatcataaagttcatttttctttttggtatcaagaaaatataaatttatgaagtatattgataaagtgtatactgatatgaattaggagccatactgctccaaacaccaaagtagacaagcagctctttttacgacatatgtggcaaaaagaatttatttcataatttaatttgacagttcgtgtataacaccattgttattcatgcttggcgccctttaggaaatgacacaggtagatggaagtgataatttctttttaagttttgaatcgatttatggtatagagttaacataatttgtttatggcgttgatcggtcaactaaattttagcggtacacatagatacgctggggaggagggaaggagggttggggaggagagggatgccaggaaggagggatagagtgtaggggagaagaggggtgctaatagaagagggctgccaagtagggaggagggacgacatggatgaggtccgtacgtcaacagggaagagagagccgcaggtggggatggagcgcgcatgcggcggggcaagcgatcggaatcagaaccgagaaccgagatggatagggagagttgggcggactaatattttgttggaagcagattttattttttaaataggcaaagattgatcctttaaaaaaacttgttttgaaaaaacatcatgataaaaactaattacagaaataggcatctgctttagcaccaacctcaatgacactgagctatagcctgggacgaacccaaggggtgccgggtatgcactacccaaaaattttgaaaaaaaaacactagggtgtggcgtggaatcatggcaaggatggtagcgagaaagcattaaaatagaatcccctcgatgaatagagcacaatggtgatcacagtttgtccggaggtcaaatcaggataagaagaaaggactgaaggaagaaccaagaagaagaatggctaggtagcttagggcatgatggctttcgttggatggtatcactaggagttcaccttactaattcattgtgcatccacgatgtcgtgcagctgtgcgcattaaaataaccgatcagatcaagagtgactgaaactcgatggtaataagaagatgaacctttagagactatacaactatcttaactgacaacgggttgcggcaagggccgaagcatgagtggactgctttttcttcccctgaattttacagatttttcacgaattctgaaccacagtttgattatttttttgaaaaattaaatcaaaatttgccaaaattttgctaccaaaccttgatgttttctttttaaaagatagaggggagtgatccctaatagacacactcaacgtgaatttccttagtcctccactacctgcaatgtctcggcactagtaagtttggagttgagctcttattcaaggtggtacaaatttgccaggaaccaaagtaccactgccactgacattgacctctttattgctaaaaatagtgtgcattccctcttttacagcaaagcaaggctagtgcagtggtggaggtcttcagtcccaagtccatggtttgcttccgtgatccttcatacttgcttttttttttccatttcactcaacactttttaattagtagagtgctcagggccaatgatattgatgctaaactctgatgacatggtatactcgtgccaccactagtagatagctcaacacaatggcattggcactaaactccgatgacatgataaactcgtgccaccttggacaatgtgctcatcttcaatgacattgtaaacttgtgccgtcttagacaagagctcaaagctaagcattggtattgagatgttatagctcaacgcagtggcgaatctagcatataagttaagaagatgctggtgtaaaaatatagtatgactgaaacaacccggtgtgatcatgggtgctctgtgataggtgtgtcgagctacatactctaacacagtaggattagcactataatgatgataggaaaaggaatacatcgatttttttaaaagtaatatgattttaatggaaaatcgcaaaactatagatcagtttgatgaaatcgcaagtttagcaccctatcgaacaatcacggttcgataggggtacctatcgaacaactacaactacagttcgacaggtacatgtcgaactgttttagttcgacagggtagttcgtccaaaaacaaataaaaaagtacatgaacagtatcactacagtgctagacagggacatatcgaactgccaaagttcgagaggggttgcgtgaacagcgcgctatagtgatgctacagtgctcgcaggcacatatcgaactgcctaggttcgatagggtattgtgaacagcgtgctacagtgatttttccttttttaattttttttaatcacctgtcgaactgccgcaggtaccctatcgaattgtagttgttcgataggtatcctgtcgaaccacggttgttcgatagggtgctaaacttgcgatttcatctaaccgacctagacttttacgattttccattaaaatcgtattattttcaaaaaaaaaattcgaatacatctttctcgaacaatatcaatattacattagctcattaatctcgaatcaacagctacaaacttacaacaaaaaaatgtattcatgcttgtccgtatcacatgataagtgttacattattaatccaaataataggctaaaattggattatttaggtgacaattaagcataagtagttcttgactcctcatcaatctcctcaagaaaagggtaatctgtatagccaacaacgggatcctgtgtataaaaggtagacctgtcatacctgttcaatggtgcgtcaagctcaaacctcctcggcaagtcagggttagccaagaagagcctcccataggcgacgagatcggcatagccatcagccaccaccttgttcccttcctcccggtcatacccgccagcagcgatgaaagtgccattgaactgcttcctgaatggtaggaggccatgggcgatcttccttcgtccttcgattatggccattcttggctccaccatgtggcagtagagaaaccctgggtgcttgttgagttgctgcaccatgtatgagccgagagccaccgggtcggagtcgaagcagtccatgaagtcgacgaacggcgataatctgattccgacacggtgagctcccacctcggcgacgacggcgtcgatcacctcgacggcgaagcggcaccggttctcgaggctgccaccgtactcgtcggtgcggtcg

SEQ ID NO: 46468 - DNA, 2729 bp, Oryza sativa
tcaccctctccgtcatcacaacttgtcgttagaaaaaaggtttccatttgttcccgtgggaacagattcattgcatgtggccgttttttagttcgcgtactcctgtggttctgatcaagacatcgaggtagcaggagtttggtgccgaggacggtgccaatcaacgcgatggtgtgtttggtgtgtacgtttgattctgaattcaaacatgaccctatttgtttatggttccgatttccattgcttgttctagtgcgtgtggattcccggagtgctttgagtaaataaacaacttgtttgtagttactctgtatactactactagtattttacgtttcaatactgacgcggttgacaatgccaggtatttataaaatttaaaacaaccaagttgagataagtaggagtatgattttaaaggaacactctatatctttcgaattgcatgttactgtagtattttgtggttaaatttatcatgtgcccgccaaggataaagtgaaatgtttagctcttaaaacataaagttcgaaatacgtaggattctcaaacactacaaacagaccaaacataaacagaataaggcgaattctggtaagtcaacaaaaggggattgttgcatcgaaagaaagcgacgcgaacgttgggccgcacgcgtgcttacgtcctgcgacgtcattgcaaacgacagcacgttagaaatcagtggctacgcgtttgatactaggccctatttaaatttcaactttttttttcttcaaactttcaacttttccgtcacatcgaactttcctacacgtacaaatgtcaaatttttttgttatatcgttccaatttcttcaaacttctaattttagcgtggaactaaacacagcctagacaccttgatactaagattaaaaatataattaaaaaaacttaaattctaagcatgaatctagatatccctagtatttttatttctttgagacggaggaagtaataacttttagaggaaggctgccgatggatgcagtgcggtctaaaacgcacgaaggctagccggcagggggcgatggtgcagtggacccacatgtcggcagaggttggactgtggtggagcatcggggcgagtggcgggtgaaaacccaacccggcctcagctgggccggcaatgatgacgctcaaagcgtcattcccctcctaagggcattgccgtgccgtctcatccctcatgtgtggatgccgggcaaaagcaaagtcttagttctctttgggaccttgacggacggcggcggcagtgttttccgttgcttctctccttagagatgtcgtttaggtatcccctagccaaaaccccaaaccaattggtgcaagctccctctagatttcatcctcttgtagcggcatcctagtctctacaagttggccacgttggagggcctaggggggagaggtgttctattattctctctcaccctctctcccttactcctaaagacttggatagataagggctttgtgttgattgtaagggttgggttttgggtgatctcggccgtgtttctttgttgacctagcggtagccggtcacgcttagcgacgaccggtccaatgctagccttctccttgttctatgtgttggcactgtcgatgtatgggtgtgatggtatactttttttttctttttcctggttacgaccttctaggtttgtaatcttataatttttcttctgctctatcaatataacttcgcaccgtcttatgtgagtcgttccagaaaaaaaaaacttttagggcccctttgaaacgcataggaaaaacacaggaatagaaaaaacgtaggaattgaagtggcatgttttcctaatcctacaggaatggaaaacacaggatgaagagggtccctttgatagcaccataggaaacaaacaaagcaaaagatagtttccaagaggttgaatctcttgcttattttcctatgaaattgagctataggaatgcaatcctaagaaaaatttcatatactttcctatgaatcaaagggtttgataggaaaaaatccttaggaaattaaatcctccaaaattcctatgcaaatcctccaattcaaaggggcccttagaggaaaatcgaatacctgtacatagctaccaggtacatcattgacagcaattgacgacaattgtcatcaatcccaggctagcaataatcttcagttcttgcagcctgctagatcatgcagctgctctgaccaggctgcttatggcgcaccgccgcgttcaccttgatccggtgcatctccacatgatcccacctctgcaacgaggcgtacatgttggacaggccataggcagcgccgtcgtccaggtccagctccgatatccggtccgccacccactcgcccaccctgacgccgtcctcctccgacgccgacgacaagcggcgggcgtgaagcaggagacacccgagaatcttggcgttcggcctgacgggcatcgcccgcacgacgcgcacggcgtcgccgaggagtccggcgcggcagaggaggtcgaccatgcagccgtagtgctcctcccggggctcgacgccatggaccggcaccatctcggcgaagaacctccggccctccgctaccaggccggagtggctgcacgccgacaggagcgccacgaacgtcaccccgtcgggccggatgatcccgcggcacgttcgactcctcccgaccatgtcgtggaacgccctgacgg

SEQ ID NO: 46469 - DNA, 10818 bp, Oryza sativa
  unsure (1)..(10818): unsure at all n locations
cacctcggcgcaaatacccggccatcatcgtgttccatgtgacaacgtccggcgacggggaagaggagaaagagcagcccatacaatcgaaaagctcctgcgcagcgtccattctcccggccttgcagtacccatcgatcatcgtgttccacgacacgacattgctcgccgtcgccccgaggctcgcctcgaacacctccctggcggagccgaggtcgccggccttgcagtaacacgtaaccatggtgttccacgaggcgggggtcctgtccggcatccgctcgaacagctcccgtgcgtcggccatcctccgggacgcgacgagcgcggccagcatggcgttgaacgcgaccgcatccctgcgaggcatttcgtcgaacagcctccgggcgggatccaggaggccgcgcctggcgtagcgggtgagcagtgcggtggccagcaccgcatcgccggcgaggcccagcttgcaggcgaggcagtggagggcctgctcctcgcggcggccgggggcatccgccaccgcgcggatgagggccgcgcgggcgttcgggagcacccgaagctgcatcagatcagataggcggcgcctgtgaacaactcgttgctcctccgaacggctgctcctcggcgccccgagcgctgatggtggtggccttcctcccaacgtggtctccgtccatgggggtgggtgctcgtgtggccgtgcctcaccggctcacccgtagagctcggctttagcagcagacaatgccgcggggtgggctcgtcggggtggagctccaccgccggccgccgggtgcccgggtgtagggagaggaatgagatcccctcctcaggtcaggtgactttacagcatatggttcatgtaaagatggctactatacgtcagtgactcaaagttatcatgtgacttaatatactttaattttgtgctgtcggtataattcacgtatcagtgcgacagctacaaattacataaagttactgcacaaagttaagggacttgtttctgagaaggggatataagaagatttttcttttgggcacatagaagatttggaggtgaagaaagtggaaatgggaagggttaattggaccataccattataaataaatttgctcttttttaaaatatcattagtcccttcgtttcaggttataagactttctagcattacccatattcatatagatgttagtaaatctaggcatacatatatatctagatttattaacatatatatgaatgtggcaatgctagaaagtcttgtaatatgaaacggaggaagtactgtttatctaaccgatatcatatcatcatctacatcggcatccacatccaccaaatagctataccaatatccttggacggattcaaagtgaagcggattacataatatcatatccgttttcatctctgaagcgattggttgaaacgatacaggtagtaaattttatttttacttttaaatataagtaacataattgtattaatccaatacaacacgcaatgtcatacaacaatttgttattccccatcgtttcaaaagaaaaccaacccttttggcctctcaccaaaagcaaaaccaagttattcccttcatctcacaatattactacctaatatataattggatattttctagtacaatgatatattaggtggcaaaattttaaaacagaacagtatactacttataactgtcgtagtggtcgccgttgccatcgcgaccgaacgcgatttgaatcagttggagagcaggaggcggcgcacgtccccgttcgggggtttggccagctggcggcagcaacagatggggtaatattgtcccggcttgcagtacgtggtatacgggtacacgtagcccctcttctggcagtactccgggcatgtcaccgaatcacatggcacgatcgcatggcaccaatcatctgtgcacaaatattcgattaagggtcagaacgtttggttgaaaaaaccgataataaatatacaaagaaaaaaaattcgataaattttgataggaatacaaacacaaaacacagtaagatttaaacagaaatataagtacaagataaaaaaaatacataaataatcttttgaatataatagaccaccagaaagacgagggaatcagaaaaaagaaacagaatcaaagatatgtcccaacaagttgaagttcttgctaattttccactaaaattcttatagaattatctattttataggaattttaaagaagtagatagattcaatccttttcaaaggtctttctaagaattttttatacaattgaaatcatccaagtttcctttttttttttgacaatcaaagggaggctcaatgtatgaattaaattttggaagatattgtgtgtcagaatcatttatatagcatgaaacaccatattttgttatacttttcagatgacaccaaaaatatatggctcatataacacaaaacaccgggttaaaaaaatatttcacaattatttgccaatgcaattcttcacatgataaataacagtatttatatgtatactgtgtccaaagttcttcaaatttgactgtctatatataaaaaataacatctatttatgaacggatggagaattgagttatacgtattgatacttttgtaaattaagatggcagaaactcttttataattaccttgtgcagcacatgaatagaccatggccatgagtaaaagagacgccaaaaacatgaccctgttagtgtccttgatgttgagaaacgccatgatagacagatatggccaggatattggaaattcaaaaaggctggctgaatctctcttgtgttctaagcttttcacttgctcttctattgcaatttggaattgctgctacattgctcagcagagcagtttatatagagaggaaaaggccatcaacaatagaattaaattcgatctatcctaatctttgcttttattgacctcttaaacctatatttgaatggcattaatttgttgctaattaacaaatcaatattttggcttcttgggccgaccattgcattcctaggcctgcaagcttgtaatgggcctacacaaagaggacctggaaccatctgttggaataagttcactcagtgaccctcaaaagtgatcgaaatctaatccgtgaccctaaactacaaaacgggatatctcgacccccaaactcttaaaaccggtgcaatttgactcccttggtggttttggagggcggttttgctgacgtggcgcttacgtggcggtattgaccgggtctcctttacacgtggcgtttagatggcgtttaggtggcatttagaattaaaaatatctgtgggacccatttatcattgacatgcaaaagaattgcaccggttttaagagtttgggggtcgagatatctggttttgtagtttagggtcatggattatatttcgatcacttttgagttttgagggtcactaagtgaacttattccccatctgtttgacaagttaggtaatgtttggtttgagggatatcctaaatagaagatggcaattcagtacatactttcctctttttttaatatagcgcagtaggagcctctcctgctgtttaatcgtcaaaaaaaaaatagaagatggcaattcagtttttttagtgtgtttggttggtgagtgacgccatgatggcctacaaagggaatatcccataaagatgttggatgagcgtattcggccaaattggtcggacgaggatatccaccttgttaatcttaatcttgatcattagtaattgattagcaataattaatgcattgtattgttaattagtaattaactttgtcgaaattagggttaattagaccgaattagtctattttgtttttaattagtatagattatgactatattagtgataattattatatttttagtattaattaatatatcattgttttccttctactccttctcattcatccctttccttggccttcattcaaccaagcaagaaattgaataaccatatctcactcaaccaaaaaacaaaacagaaccaccgtatcattactttgccatgcaccaaacgcacattaagtgctaatttggaacaaacaatatttgaaggatttgattcccatggaaatttttcggtaatcatgaaatattatctttcccatttccttgcaaaaagaatatatatgatcactataatcgagcacagtacagatctgacatcacattacagtttttttattatttcgtgctgtttcagaaaaagaaactatagtcgagtatattgttgtaacagatctatcgcgccgcgccgttgtctcttcatcgtcggacacgtacgatgaaataatcttgagaatcatttggagagcaggaggcggcgcacgtccccgttgctctgcttgtggcagcaacagctggacacagactcacctggcttgcagtacgcccgcgcgttcttcccgcatagctgcgggcacgttatgttgttgcatggctcagtcggctcacagtagtcctctgcatgaactgatacacatattcaattaaaacttgttgaaaccaatatgtatgtttaaaaagctttttgctccaagatttatatgttcttttcctactgaaaacaagtgtacaaagcccaaccaattgatgagtgagtgttattaccatcattagaaagtattaagttactgtccatatgcatatctttatcattactttcctactatacagatatataaactgctaacaatggttaaaactgtttttcttaaaatatgttaatgtaattgattttcacgacaaaccataatactatcgaatatgtatttgtacacaatggtttagagcttgacccgatttttttatatataataattaataaccccgtaattaaatatctggtaattgcgtgcaagtaattagcaaagtaggatggacgttgtttttgttagcgtccagatgtggacgctattctctagagcgtgtaggtctgaacgctattctctagatcgtgcaggtctgaacgttattgtgaacagcgtccaccatacgggtgcagtcgaaccgtgccaaaccggcccaaacatatccacctaaaaccaatcggcgccgaaataactgccgttctctagcgaccgcatcctggcctcctcggcaatccctcatcgccaccggcgggcagcaaaggcggcgcagtattcgtcaccaatcgcacgcgactagctgacaacacgccttnnnnnnnnnnnnnnnnnnnnnnncgcctttgcttgtgcggctgaccagctgtgccgccggcagctagcacacactagagattcatcacgcgagtacgtattcaatttcatctccattgatcatattgttgaacatatatttgcattaaatttcttccaatcacaagttttccctcgtacgtgcttgacttttcgcagcctacggagatcggcctctccatgtggatgaggtagtggaatcatttgttttctttcaaattgtctcattaccctattgggataatggaactccactacccagccttcatctttgcaattgaaagaaatccaatattttctagagctgattggtaaagtgggtggtaaggaattccatggtgatgatgccatatattcatggaaccactaggctgtatgcatgaaaacatagaacaattacttaaggagattaacatgaatagatgagaaaaaaaacagatttcaacaggtacggcaaactgaaaaaatacccagattttcttcaatggtagatatttagtgctggccatgaggcaccatagtaaatcatgaactgatcacgctatcagcatttttttataagctgtaatcaatgtgaattgctgagaatttatattaccaatgcaaagatatggtgaatgtaaaaatgtaatgagcaattcagtattttggaaacaactcccatgacaaatctaatataactaattatgtatttctttaatccacattatcacaacaatcaagcatactaacaagatggacatatataggatggtataatcacacatgtattacggaaagaactgactatgcatgcaaacaaacggcacttacactacacgtggaggcgtacggcggaggagaccacctgggaacgggatgtgtgggcaagtggcagtgccggcgaaccaccacaagcgtctgaggcaggcggcgttggtggacgggcgggcgtcgccctcgcgcgtggaggagagcagcggcagcggagctgccgagaacgagggctgcgacggccggcaccttcgtgcgattggacgcgcagcggtggcggatggatgggcgacgttgttccgcgcatggaggactttccaggcagtggcgtcgccaagaacggttcctcttcccgtttttcttttttttttccctttttcattttgcttatgttcgtactgggaccgccggaccgacctaggcgaccggtcatatgctggacgtagttagccagagcgtccagctctggacgattttacaaacagcgtccacatctggacgctttattcttcagcgtccatcctattattaaaaatcccaactttgatttaccagatatttaattatggggttattaattattatattaaaaaattcgggagcttgactacatgcattctacaataacatctattctcagaaagaaagagtagcccttgtgtatatgcttttataaagatgataataaaatgcttataattaccttgtgcacaacacaaataaatcatagccacgactacaaaaatggccaacaacatagccctttttacacccttgacacttagaaactccatgatcgagatatgtggctagggatattggaaattaaaaaggctagcaagctatagctattccttaactgattctactctctttgctcttatactgcgatggaactgttgttgcagtggtaaacagtgtagcttatatatagagagagagaggggaagcggccgtcagtaatcaaaccaaatcaaatctatgagatctcttcaaaaatacaatccatgcaaatcttgctttttattgacctctcaaaaaaaatctcacatttgaatgccattaatttgatactaataaaaaaagattctagtctcttgggccaattccaaaataaaacaatttctacctatgaatctgaaaaagctgttcaaattcatacgtaaaaatagtttcattttgttcatattcgtatttagaaataactttatttaggatccatttgcgtttacttggcacttttaaccaaaatttaaataaaatattgccaaattcattaaaaataattaaaatttgaaaatttcggccaaaataatatcatttcggggagtctgatagaacgaaaatttcctgcgtgcaactgacttcttacttttcagtgtttatggggttttgctgcccagtgggcatggtagaggcgtagagctagactgctagagcatagagcatagagttaatctccaattgtggctagagaaggagtattttgatatgtggatcatagctaaagaaagtgcgttgaaggatacccgtgacagtgagacaaagcgactgcatatatacaaaaatcaacacacgccacgaacatgcgcagtacaattaatccctcgatcgtttatttcaaccgaatgacccatacaaatacaccacacgcaacgcaacacaattagacatatagtatatattgcaattaataacttacaatattatcaaagcacaatgatgttctgatatcgaaccagaactcccagaaggtggcatgcagaagaagaagaagatcgacgtaggctagcagccgcaccatggccggcggcgaccaacccaacatctcggtggcggcggccggcggccggcggcggagaggggtgggcgggggccgggtcagtcgtcgcggcaggcggagctcttgggcttgacgatgaacttcatctggcccatggtgcagtggatgccgccgcgctcgccgcagacgaagtagtggggcttgcgcttccggaggacgaactcgtagcccgacccggcgccctgcatcacgttggccaccagcttcgccgccttgaggttgcacgactggtagtccgccgcgttccgcatcatgtacacgctgtgcgcgtgcgtcgtcgcgttcggcgggtcgtacatgaacactgccagtgccaccccccataccattgttcatatatatatacttattaatttcaccaacatttttttttaaaaaaaatattagactcaatcaaggttcaccgtgttactccatccctccgttccaaaatattagcatttataagttgtttagcaatagaaaatagccaaatatactaaggttaagggagaaaaaagttcttttcagtcatctctggttaaattcggaattccttatatttttccccatatatctgattggttaaaatttgtatggatttttatgtattcggatcagtgttatagaaatggtcataatacggtgtaaattttaaatcctagaaatacttatattttaaaacagagcgagtaaatatcattgtataataataattcaaacatgtaaaagcattatttacggcatacatactagttgtgatggagtgtgagatgcaggggcggagctagtatatattaggggagtgcccaggaacccggttaagaaaattttttagctatacctcatctatttttatcatgtatgcaccccctcaatacaaacttaggcacccacataagcttaaactcgatctaaagtagagtaaattaagcaactagcaccacccttcatttcgctctagctccgtccctggtgagatgttacgtaccaaggctgtcgttttggaagaaggggcccttcttgatgacccagtcggtgtagttgtaaccccacgtccaccgcgccgcgtcgccgacaacgaaccgctcggcgcgcgccgccgccggcaccagcaccagcatcgccaacaccgctgccaccaccagcgttgcactgctaatcctcccctccatcgatcccaacgaaatcctcactctaattaaccaacaaattctcttcagtctccggcaaagctagcttagctaattaattaactggatgaatggatggagatgcttgtgatgagcaatgacatggcgatcgagatcgagcatgctggtataaataggatagccaagctgcaggtagctttggggacgtaatgatgtcgcaaagttgacccacacccagtttaaacctgggcgaaacatcgggaaatttaaattaaagaaaattcgtgtgaaactgatgtgccatgccgtggattctgcatcacacgatttggttgggacgtaattttcaggtaaagcagcactcgatatggagctcgcgttctggattggtcatcgatcaagtgccccattagcgagcgtgcttagtggcctcgtaaaaatttggagacacgggggttggtgagcaaactgaccatttcactggtctaatctctagttgcttccattttgcagtggtgttcagccattagctaggagcttagctagccatgattttttttttattcccctctcgagttcctttcgttgattagccaatagccaccatgtcagcatgattactgtagaggattagggcggtgataggagatgattaattaagcaggcgtgtgtgattaaacgacagtgtatgtatatacgcctgcttcatgatcacgtcatgctgatatggactacgggagtcgacaggagtggattagtggatgttgcgtcgagtaagcatcacttcgattattacactggtcgatcgatcgtgaattactccacggttctccgaccaccgtcaaacgccggagctgtattaaccggcaaccacacgtaatttaaggtcagcttgtggtcaagtctggcctaattttgtcggaaaatcgcttagcttagaatacttaaatatgcctagcttctcctgtgcatttagctttgggatgcagacacagatttcgcctgtaatgcgtgcacgccgctgcaacataaaatcgaccgaaattcaacggaagatcttgcttgcagatggctactagtataactgtttgcgcacatgcacagatgcagccgatccatcgatcccggtagtagtatatgcgtaacagcgtgtatgcgtcatcgataccaaagggtagcagagcatcatgagcagaggcctctgtattcgagtgttgtggcatgtgaaggttcagacttctactgtgctgtattatacaatgctactgttcataggtgcccactgaggcactgaccaagtgaccagtagtccagtacgtagcttggaagacaagattaaaagatgagcggcttaatgatcacgaactcatggtgtacattaattcgaccggccggccattgcgaaagctgtggcagagagtatacgcaaaccacaaggctggggctgggcattttctttgcttgagtggatcatgtccttatggaggatgattgggatgcaatgagtgtttgggcagttggatttaacaaattgagtgtatatgacttaaacagagttaagtcaaattgatgtcctaataatcgaatgtacctccacaccaatactaccatgaatgaaattttatagaaatttgaactaaatatgtgaaacaagctcatgtcttccaaaggaagactacaaagcggaagttgccgaaatagaacagacacgtgaactttccaccggaaccgctattctcttaccggcgcgtgacgctcacgccaccaaggcactcacgggggaaggctaaaacaaagggctgcagga

SEQ ID NO: 46470 - DNA, 1716 bp, Oryza sativa
gtctcggctttaacagcgttgatacgcacaattacttttgtagtaatgcaaaagaaaaacaaaggctatcctctcccccactattttttttccttgtatctagatagggagtcagcgtcttttgcgttagctgcgcagactcccttgttataccctgcaaaaagaaagcatatcatttaatcagtatatattaacaaaattaaagagtgtaaatggtgtcgtatcgtataatttggacctcttcacggttccagtatgtatcccagatcaagctaccaaaagttctgccggggaaaggaaactagggatcacttgctctcctacaggagaacgaaacagccattagtacctttgcttgataagtgctgaaagcctggataagaaattaaggggggaagaaaggataaggattggcatttgagaattacttcattgtctttgtctgattttccagaaggttggaacatccttgcaaatgccttccgctcctgattccttctgtcggcaatctgtaatcatttgcatatagttggtaacgacgcgcatttatcaagattctaggttcacaagaattacagactgaccttcttctttgcagcagctagctctcgtttaattcctcctaaggattataaaagattattaaatacgcggttgcaacattacagaagtgttgccagtgaatatgaaaaataagagataccatcacttggctccaactccaatgcatgcttgaagctctccactgccgcatcaatgtcattgagtgcaatgtgtgcctgcaaatggcatttatgccatatgagttgcgcagaaaccagatggtaataataatacgatatgagtagcacattgcattgattaaaatgtcaatagtttcaccttgagctaggtttaacaaatactttcacctcacaccagggtaaagcaaattaagattcactttgcaccaacccaagcacctctcatctactaggtttgcaatctgacaagcatctcactagcatcagcatgcccatatggacaactcacctatagctgggccatacttatcaagatgtgaacagagtcaattttcaagtggttgggctggtgcaaaatgaaacatatttcgctccacctggtgcgaagtgaaatatttgttcaccctagtgcaaattgaaactaataatgagtgccagtgcacaatgcaatttactcataagatcaatatctaaaaataagcaaatgaactgatagtcccaaacaaatggtaatagcaatatgatggtttagtggttcgattaacaaagctcacaagcacgcagacaaataaatcatagttcagagaaaaaaagcatcagcaaatagtgaaaccattactgcaggtcaataccaacctgtccttgtcgaaaaaatgccttagcattgccctcactttcacgcagtgcaaaatcagcatccaacagagcacccttcaaatctcccaacttcaatttgcatgcctgaacaagatttgaagggcaatgtaggtgaacaacagagcacgaatttgaagtttgtgtacggagtgagtagcaagcaggaacagaaagacactgctcctgcagggtaggtaaggattttgcagcgatgaacacaaagatttaagtttagatgagaatacaatagtactctaaaatcatattagaactaatgataaaggaattaaaagaaaatttattcctctgctttgca

SEQ ID NO: 46471 - DNA, 9582 bp, Oryza sativa
acgtccaagtaacgcagtgctttcctgtactttctcagagctgccttgtaatcctgtttctgtaaagaccagaagtactaacttcagcttcagggaaacagataatgaaatattaaattgtgccaaagtaattaactagaattgttcaactgatacaagcaggtatttcattaaaacagcagtagtttggctactaaaccattcaaaaatcaacagcagaaggcttaagaaacatgaatctgtaaatactagaactatcgaagctggtatcgaacaagtaaggactaccatgcactaacttaagctaaaacctaaacatttaatcatgattaggatttgctgtcgtcacctgactttgctgatttggttttatttagtaaatgatgcaatattaatctaacagataaaaatacttgaaaattagcttgaagaggaaattaccttgaaattattattcccaaaagccttagcagactcaacagcatccatccaccatgaaacctccataggcttctcatcaagatcattgggccaatcaggatacgtatcaccatcattgaagaagttcacaactccatcatcagcaccttccggaagttccccacaatcgacaatttcaacatcagaagtcgggcggtcagcctctccaacaggagcatgctcaacagagcgaaccacccccattcccttaattactctaccaaaaactacatgtttcccatctaaatgaggtgtccgagttgtagtgatgaaaaactgagatccatttgtgttgggaccagaattagccattgatagcattcctttcctctcatgcttcaaaacaaaattctcatcctcaaacttcaacccataaattgactcccctcctgttccatcaccagcagttatatctccaccttgtaccataaagcctttgataacgcgatggaagcaagatccctacaagaacaacaattaccggacatggtctcagagattacggtgaagatgtgacaacagttcagagtagtgtatacacatgtgtctcggcacagagtttctcatcctcttttttatatccagagtacacagagagtggacctgtcttctttggtggttaaagccaaagggattaaaagaggcccgcatatgaaagaaccatccactcaatcatatagaaaatattactgtagtagatgcatccattagctccatgaacagaagttaaaatgaggtacaaaatgccaagcagctattcaaacaagaaccatgtcagcatgttatgtgctcctcctgtaaccactaaacttgtactagactaaatgtcaaactaatgaaaatatacagtaaaatggctagcaaagaatcttggtacagtactggtgactgtctctgattctattctaaaaggctacgaggcctttctatgcgtacggaatattacttaacgatacgcatacaaaaccctcttcatgtctacctaataacaaaacatccatgcatgtggctgggccacctgtcaatatgtaaaacaatgaggccttgtatgtgctccattaaaaaaggagcgcctatatacagattgcacaaggctaatcgctaacctgcacatggaatattttgagagtaaagtgccacagaaattggtaccccatatccaatttctggactagtctactgcaaaagaattggggttactcgtgtgcaaaagaacgttcatgtgatcaagtcacaagcccttgtcccaacatattgtataagtctaatatgtactactgccttagtttacttctaattgtcacagttcattacactatgcaaattttgaccattaataactttttcagtaattctgttttaatagacttcacaccgttcgatttgacaagcagtttgaatgaatatatttgtgtccttagatttttcaccgagcgtaggttaatgatgctatttaaatatttcctccttacaagtttattggaaagaaaaatagaggtgaaagtttggcaaaagccaatggagcgagtacatcactgtctactcttatacatggacttaaccatactgtaatagcagataacgaatctgccaaattttaacaggaaaactgtgactgttccacaggcatatgacaaaccacaaaagttagcacaggtggtacttgataggctaatatctgcaaggtgcagataaaaggaagccaaaatggagggggcccgttttaacagtcagaacatgctgtaccagcagtaccagtgcatagagttcatttcatatcaaaggacaatgatttgacaccacagcacaaatattagccggaaaataaatcgacagattccaaatgggccgcataagtaagaacatatccatacgacaaaagaagaccatacaatggcaggatgcagctgcccataaacacgctaaatgatcattaggaaagcaaatcggtggcacaaaggccggccgaacctttttaatctctaaactagaactgatttgcagtagtgtaaactaacccaaatgtttcagaatgcatgtttatgaaatccgcatcaaaatcctaacaaagtaacaatcaccaatcgcccaaattaaaaaagaaaaataaaacagttctctgtctctgatcagacgcctaaaaatttattgggagcggtgggcagtcaatcgcaccaagacacaagacatgtgctaaacataacagaatcgaatcattcattgcgcgcagtactaccgcccaaatccagagcctaagacgctcctccacccaacgaaaccaattcgagtccccactccccaacaccctaaacctccaccacggcagaaagccccgaaagggactacccggacgccacaagcatctcggcctcggcgatggctccaaatcggcggttccgtactcaccttgtagtgtaggtgcttcccggtgacggcgccgacgcccttctccccggtgcagagcgcgcggaagttatccgccgtccgcggcaccaccgacgcgtagagctctataacgatcctcccctcaatctcgccgccgatgctgacgtccatgaagcacctcgggttcttcacctccacctccgccgccgccgcggaggcgacagctgctgactccgcgccttcgccgccgccctccattgcgatctcgggcctcctcggggtcggggctaggaaaaccctagaaactagtggagcttcacgaggcgaggcggccggtggtggtggtgtccgtcggttacctcgggggccaaacggcgaaggtggcgttgtgggtgggtgccatctggggttttgtggggaaattgggtttataggggagggccgtcggtgagagagagtgtagtatattgtggatttgtggttttaccgacatgtgggcctcctctttaggagtagtactcccggtatatgattcggaattcagaaataaaattcagcaagataagaaaattaatactatataaaaatctactcctatatccaccgggcaatgaaacagacgatataaaatattggaatatgcaaaagtcttataccattaacctgaaatggtagtggatttaacccttatgtaacctacttaatgtttacagagagcgtagacatcgaatgctttttttttctccatcttatgaataagacatggagataatgtacatgtttagatgtaacaagtgactagttgtctacttgtcttttatttttttcagccaagctatcatgacttgtaaaatgacttcatcttccttattttcggtcaaactatcttaaattttaaaataacattaagataacttttcaaggaaagaattaaaccatatagatacctatcggtcttcattacgagggatggtgtatcatctcatatataactcttcgtagagataattttagctatacgaagatttcgaggtctcaaaagaacgttatctcacatcatcttagagagcctaattatacataggcaacatcttttcatgtatttatatagttatcaatatataataaattcaaccttaaagataaatcttagtacacacttgtacactcctacgcgcttcaataggtatcatgagatccatgcatgtagagctcttaccgtttctcgaaactactaattttaatgattatggacgaatgcattagaaaattctttgagcaggtacaatagcagactatgagccaattataaacatattttaaagagataaaagaagagagaagagcagcgggctacagatctgtagccagctgcagcacggactccaagatacaatatgtgtatgacatgtgggaccatatattaatagtgtattaagtaacaattgtataaactggctagtaaattagctatagatgatttggtgctaatagttgtctatactattaaacttgctcttacataatcataaacactatactaaagtaatatcatctaaaaggaaaagttaattgaaacactacaaacataaaagactttcaaatactcccatctcactcatatattattagtatgaagaataaacgataaaaggtagtggcaattatgatggtttcgctatccaccatcaatgtatgtctattcttttatatgaatttctaaaacctacaccacatctgttcttaaaaaaaatcaacttccaaatatgaacatatatattcatgacctctgcccatatttccacgcattcatgactcatcacagttcacaccggtccatgaaccgtccgtcgtcgtgctatatgcacaacggcgccccacactccttccaccatcttcaacctacccaccccgcctgggccccaccaccccctcgttcgttccataaccatctacagttagtactactgttactacaccctgccctctgactgcgggccccacaaaccatcaaaccccctcctggtccccacgcttccgcctccggctatctcggtcctcggcgcgtgtcaactgccaccgccactatgccggcaactgtaaacaaggcgggggaggggaccggggccgggcccaccaaccccgatcggacggcgtgattcggccttgggcccttggcctcacctttttttccgccgctgctcgttttgctggcccatccggtgacgtccggtcgctgtccggtcacctggcgacggagggcgagcggcgcggggccggccctccgccgcgccgtcgccggcgatggccacgacgcgcgtgacggcgatcacagcggcagggactccattgattgaccacacgctattctggggcgtggttcagttcagtatgaccgtgaaacagtcagtggagcgaatcgtgaatgcatgtctctcctgtgaccatgagcgattggccggcaagcacggctgcacggggcggatcagcatgggagcagtggggtctcgagcctctactacttgcgtgaaggctacttgagaccccacgaaaaccctactaattattttttttttgccatatgcaaatggtaggggactgtaactctatctagtttgctcagatcccactgctattttttttatggatccgccactgccggcaagtacgtcggcaagtacgtgatgagtcctggataggggtgaaaacggccaaccaacgttcatttccaactttttaccaactgatctatatggaaatggtaatcgactgaaactaaaatggaaatggtaaaagaatatgaaaatggacacgaaaatagttttgctgttataccgatagggatgtaagcggggcgggtaagcgggctttttttatcccgcttatcccacttctagtttattttttcttctaaattttatactaccatgcgtaaaatagactagcaagcatatttttatgcgaatagcgggactacccacttgcatctctatataccgatcgtttccgtatttaccatatttttgtgaaacttaccgttttctataatatggtaattaccgtatgtttccgtatttaccgtattcttgtgaaaattaccgttttctataatatggtaattaccgtatttctaaatatgcctctacttgacccacagtttagagattgattgactctttaatcaaatctctaacttgagtgcatggctaaaatggagttaatttatatatatagtataagcttgaatttatttatacatataacatacttatgtaaagttaaaatagagtatatatgtttttatagtttaatgttttcgtatctgttactggtttctaatctgtactgacatgtttccgtccgtattgctccgtttctgatttttcgatatttctgatatcattttcgttttcgattttactgtttttgatttcgttttcagaaaaatatggttatggaaatggtggtgtctgttttgccgttgtttcggaccgttttgatccccactcccggatatgctgctgcctacaccatcaattattgggggtggtttggattcggttcgtctggattgtatgagattcagtcaaatgggacagccgagcacaatcatggcggatgcatattcagcttttgcagcctggggatgcgatgctggaggagagtactctacctctaccagagtcgtcgcacaaggggagcgtccggatcactggatggatgatggattggatctactggtgtagtactactgtaccagtgctttttctctcccaggtgtacaacgtagtacgaacggattatgctgacgtagtacggttccgtgcgtagaaaacggtgtacgtgtacagtgcactgcccatgtgaggatcgagaggggggtgacgagggacgaggagcagttcggctgacgcaaccgcccaaccgcaccgcatcaccgcggctgattaatttgcctcgttcgcccggggcaaatcaaccgtgcgtgcctgcagcccagcacgtcgcgcgcgcgcgcgccatcgatcgatcgctgctgccgtggcccgtgctacggtgcgggtgcgtccgtttccagcagcccgcggggaaggggggacatggagatgcgtcggcacgggacaccgccacggctgcgcgtacgggcgtgtcacggcgtgcgcgcctctccggtttttacggggaggtgaggtagggggggggggggggcgcgatgcggtccgagcacgggacaccggtgccacggcgtcgcgagcgtggcttggctggcacgagcttggtatggattagtctaatcaatgtactcacatgtgattaggtttttttgacggaaggaatatatccatgttcaaaatgttataaattagcaccgcctccccctacttccctaacctcttccttaaggatccgctttctctctatcagcaccaccgtcgcctcatcttttctctctatggatgtggagggattagaaattgagaagtttcttgaggggtgaataagatatttcgcaaatgagagaatccaacggcttgaaacgtctggagtagaaatcggatggctcataattttttttgatgacgtggcaaattaccatttcgagaatgattagctcttccactattttagatatgaaaaagtacgaattacccctgttcccaaactattgtggtcgtctgaattaccccctgaaccccaaaaccgaatattcttcacctccaactatgcaaaccggacgaattacccccctcgacccaatctgcagtggttttagtctacgtggcatacacgtggcatcctgttaacgaccaaatttggtaatatcagtatcggagataaagatgggatcgaagcggaatcgaagatgaggattgttgcggaaacagagtaaggatcggctggagtccggatcggctacgactgggatcggctaagtctgagttggactggttaagtgatacagccgattccgacaatacgacctgtgtgcgacattaggatcgagttgatgtgcttcaagatgattgccacacatggataaagtcctgggaaggcaattgtatctattaattaggatattttatgtaaattccttagagataaatatgggcaaaagtctgccgcaaagacttatggtatcttagagtttgttagagataagagtcgtgtccaatatggacatatcttgtaattctcgggtataaatagaccccgagccctatgtaatgattaacacacacgttcaatacaatttcggcgcatcgccaccctttttgctttagttttatttcgacgagttattgctttcgggttgagctgcatcggtttcgatcttcaacaagaggtaaaacttgttatggcggcttgtgttctcgcgattagtgcttccatctttatgatactctaatcttgtttatgtaatccgtcaagttatcatatatcttgcataatccttgacaatatcgtcatctaacctacaatcggctaacatctgttaccagaaggcagccgattaggttaaataacgacgttggcttagattatctgagatatccaccactctatgaaacatccagcggcttgattgtctagatattgttcttcttttcatacttaatgctgtatcagttgagtttgacctattaagtcgtgcttagaatttcaatctctagcctgcctactggttgccgattagggtagtatcggagtttcagccgatcgtatctgatctaattgcttttatcttacgtgctcaattaacatgttagatctgccctttatatcaagatcttgttgcatttaagtatattaggtttctgcttagtatattctatttgctttaatatcttaatataaagtagtatcggagtattagccgatacatgctagatctatctgatcggctatgctatgaacatatatataatctcattattaatatatatttcgatctaagtgatttatactgtctcggtaaggtgaccgatctatcccaatcacttgattcaagtatatatcgatataaggattatatatcgttgatatctacagccgatcgagtagatttagttctaatttgttcacttaataattgccgatcgatttacatatgacatcggctcaaagataaataatatgtcatcggcatttagccgatcggctatcatttatggatttaatcacggtttctttgtctttgtttcttgttgattgcaggatcaaatcaactagcacgctcatatatccgatggcgagttttggacctacactggagttaagcagatctcccaggtctcgtgttttctatcaacacatcccagtcagcgttttttaataaaaatggtgggacccacatgtcatactcttccactttcccccctctctcactcttcctctcttctctctctcactcttcgtctgtctctctcacggatcggtggcggcgggagacacggaggggcgggcggcgtcgcggcgacgaccgagcggaggcggttgcggcggcggctgccggcgctgctgggtgagtggcggcgggcgcggctggacgagcggaggcggcggcggcgacgggctcggctgaacgagcggcggcggacgcggctggacgagcggaggcggcggcggcggcggcgggctcggctgaacgagcggcggcgggctcgactgtgcgcaacgccgcctcgcgccccgccgtgcccatggtgcccgtggcgc

SEQ ID NO: 46472 - DNA, 5285 bp, Oryza sativa
  unsure (1)..(5285): unsure at all n locations
atgagcaggtaaatgggtcactcaggaagaggcatacgcatgggcaaaaacctcccaagctaatgctgggcaatcctcaagttcacaaacaaaaccaactgcttcagttgcgactgtccccacaattaaagggggccaagctccaggtttggtcgtcaagaaaccactgaatccgatgagaactgtaaagggtgctccatccgccattgctgttaacaagagaaaaagagaggacggcaagcccaaagtgatctcaaaggaggaggaagccgcccttaaagcgcgtgaagcagcaagaaaaagaatggaggatagggagaagcccttaatgggactatacagatcgtactaaggggcctccccataagaaatgctaatggatggattgttctgtaaaagaagatttgcgagattattagcgttgggtgtcttcaagagcgtcttctgcatcagggaagcatgtctgtagtgtacaatatctctggtaccaacaatatcctgaattggataaattccctttcctgaaactgttatctgtgaaacatgtaaagtactatacattcgtcagcatttcttttgctctttcacactggatacactgtagaaatgacgacctttgcgatcaactttacaggaaaaagaatatctttaccatgcctcctatgtttgaagcctcgaaagctccgaagtggtaatcaagatgatcaccaatagcaactacccctagtactgcagatatcgagctatgattaactgctcttttatgtgatacaccctctgttccatgaaaaatcacatcgtaatattatgaatctggatataattctattcagattcgttgtcatattaagttctagatttttttttttagacaaagggaatacgacttgcagctagatgcctagaacttcacctgtcatgctgcaaataattctgcagcagagttgccaccaactgccaacctgtttcagcggacctccgcttcgtcactggcggtcggcaaggcagaagcagttgaaacgaacggtccccggcgttgaacggagcgagcggccatgcccatgtgagctgatagccgctgctagtacagtgctgttactggtgtcgcccttggcaaaacgtcgtcagcgtcacaatcctagacacggcccgtttttttgttcgtgtcaggatcgcgatcacgactaggattacgataatataatatcgcattgtcgcacagtaaataaacggctcagtataaaagtagtttaatttaactttttaagacacgattttgtttgagagaagatgcttggcacgttcggatgatggtcgcgagaacgtcactgctcctcgtttattttttttctggaagaatttgtggttgtttggtgggcgtttctcccgtggatcgtgtgggggattacggggaacgtcacgtcgtgtttgaccgggaaagttggccgtggaaccggatggatcacattcacgggtggacggctccggtcaaactaagcgtgcggcggtcgggaccgtggaacagctactaactagtctactgctgcacactcccgggctcccggcttggccgcttgggcctcacaagaagaataaataaaattaaagttagagaaagaaagaagaggaataaatcatggcaatggttggtggtgcccaacacatcacagactcacagggccttagggctagactattagtaaatggtcatggtcatgtttgatagtagtactcccctccgtcccataatataagggattttaattttttcttgtattgtttaactatttgtcttattcaaaaaaattagaattattatttattttatttctgacttactttattatctaaagtactttaagtacaactttttttttatatttgcacaaatttttttaataagacgagtgattaaacattgtaagtaaaaacttaaaatcccttatattataggacggagggagtagaaaggaggtggtgagcacttgtacttggggtggctaattagggctagctaaattgcatccctcctatgtaattgtactatctccggttataaatagggttttagggaggcaaatgatgtatcgctggtcttcgtcttttaaactttaagagacacaagacacatttacgagtgtattcatgtgatgttatggttgtttctatcatatacataaattagatcactatagtttgttgcgcaacatttatctcttacgtagtacttcatctattatatactaaaagtccataaaacttcctacaaacgctcctaagcctccacttggcgttctaataaattagagaaatcaaaaaaattctgagaaaaaaaaagcaaaacatcatacccttgattttcacttaatacggtagacccattatttttcactgttagatttaaaaatatccacccctaccctcccaggcatcctctgatccccctcatgtacgtagtgtacatacgtacatttgtccgtccacccctccctccatctcatatcttctcattctttttagtttttaattttatacctagcaaaatttaatatgagaataaaatcaaacattagataacaacctgattataatctatatattatattatatacaaaaagtaaaacactcctacaccatcacgcgtgacgctcttaaaaatcggacaaatcttaaaaatctatatatctatctattattatacaataaaagtccattaaacttcctaaaacgctctcaaacagtcacgtggaactcctatagacattcctatgtttccacatggcaatataataagttattcataaacacaaataagtaaattaggtgtacaatctcatggaacaaaataattgaaaactacatcctcatgacttttctttaaatcaaaaaatatatatgtatactgcaatatgaaaaaacataaattaaaaaacatcaataatacacaccctacatataatttaaaaaatatgactaatctatgtagcatataacctacgtatttattgatatattaaagcatataatcaataagagaaattattgaaaattttatttacgaaggcacaacattcaacgtgtaatttatcgttatacaagtggtcacgttattcgtagctatctacattatagataagcatttagattaaaaaacaatcatccaagtgtgttaataaattagaaaaaaacatcaagatgtatttcacaggtagtaaagaaccatcttaaggtatttagggttaggcaaattttgctcatgacactgtgatttcgtggttttagcggtaggacaccacccgaactcacttttggaggaagacactctataaacgtggtaatttgccaatggacaccgtgtcgattagaataataatttccggttgaagagaagagagaaatcacgtaaaatatcaaaaatgtccttgagcccacatgtcagctctcatttctctcatgtctctctctctctctatcccctcattccaacgtctgatgcgcggagtggagcggttgcggcgacacgggggcgagggtcggagcgacagcgatggcgagacagcacgggtgagttctggctgcggaactccgggatgcggcggaaatccggcggtgggatgccatgaccaccgtccgttactgccgccggccctcgccttcccgcctccgctgccaccgaccccgtccctaccatcatcctcaacgccgcggagttcaccaagcggccggtcaatgggatctcctcctctctctctacgtgtctcacccatggtggagaaggcaagctcgacgtctccgtcgcccgctgctcgccgtggtagccgcaacagcaatagtatgacagcggcgatcttccgtcgccgacaagcccgttcgaccacgcggcacttcacgcggcgtcgtcgccgcgcagcggcgggtggcgccaccgtgatgcgggcggggtcgggctcgacatcctagcggcgctcgaggtcctgtaggaggaggaagcatgaaagcccgtagtgtccgccgtcgccatcgcggagtcagcatcgttctccgccaccacgactacccgacgccgcgcatcagacgctggaaggaggggatagagagaggacagataggagagctgacatgtgggcctaagggcatttttgacatttcacgtgatttctctctcctcttcaaccggaaattattattctaatcggcgcggtgtacattggtaaattaccacgtttatggagtgtcttcctctaaaagtgagttcggacggtatcctacagctaaaaccacgaaatcgcagtgtcctataacaaaatttgccttagggttatagctaatgaggaagaaaaaaaaagaccatgataccccttattaattaaaagagacgtggagggtgggaaggtggttagggtaagattgggtaaacaataaattataaattatagttttttggataggacaagtaatactactctaaaatcccttatattttgaaacaaaatttaactttctcggatttatgcgacgaagtataaatctatctttaattatatgacatagttctattagctatatgtttaatagaaatcttaaattactttatcctaaaatccaaaaagaaatagatagtataaaagcaattattacttaaagtatagaaatacccatagtacaatatatagtttcatagaaacttcatggtgatgacacaatattttcttataaattcaaaacggcatgctttcacacaattttagttaacaaatttttatgttgcaagcgtaactagaataaaatcataaccaacattaatagaaatcccaaataagtttgaaagtacaaagggtatttcaataaaaaaaaagccaactacgcgtaagcattcgtaataaaatttcaaacacattaaagatgcccgcgcatgtgcgcgggctatattcctagttttttttaagaaaaggaaaaattcttgtgcaccaagtggctgtactcacgtttttctgggggacacaagtaagctttttttttttttgtaagaaaggagaccaagaatgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46473 - DNA, 7229 bp, Oryza sativa
agatataataataatgtatatctaatatacaaaaccatctatagtctaacaccttcaagtacagcctctttaataagagaataaatcttaattatttgttactagttacgctgaaaattggtaagagattctgcgagcatcatatatatatatatatatatatatatatatatatatatatatatatatatatatatatattcaattatcatatcatatcatgttcatatatatcaatggaaaattaaactctatatatgattgtctaaagcactctgaatttaatctaatataatgcattttttttgtttcttctgttattgtctataggaatcccatattcaaaagagggtaacatgaaggaaaccagtcagacaccactcaagtacatattgtttattgttgtcagatgaattctggcccattggtctaaactacaatgcatatttttctcaggaaaaaaacataagcatatataaagaatatactacgtacgtattgcttaatggttggaacctaattctagaagtaaacttcaatttgaaaccctgggaattgggattgttgtgtaatcataatataaactgcgttggactaacacttgcacaatattttatatcctttcaaaggggtggaaaaagatagctttggatgttctccaagaagatgtagccagccagccaaggatatgctgagcttgtgtagaattcatacatttctgctagagttatgtgctactcgtaatacgcatgcccatgtttaaagtacattttgatgtcttcatcatatatgctcttagtaataatgtcagcagaatcactgatcttaaattataacagtgtgcatagtttcttatctgacttaaggttgtccagtgatttctgttcaacgttttgtagaaaaaaattaagttatataatataactcccaccgttctcaactaggatacagtttagcagcacgcacttgaacttacaaaaactatggcactaatctagtaatatgtgcacaaaagtgtaaagttcagtcagtaagaaaattagaaatgccaccagtaggttttgatgatatgaattgtccctcttgtacaataattcctactgaaatacatactgaatatataggtgccataaaaaaaactatgccaaggtctttacgttctcgatcagtgcaattgggcatggagatcgaaaagaccagtttaattaccaggtcttcgttaacatttgcccttctgaaaattaacttcacctcaataaatgctatgttactcctatttaattgttgtctgataattgttcactcaaatagtatcatagcggaatgatcttttcctcgtacataatggagttgtacgttgatggagaaataacgagatgacaaattgtagggaagaaaaactagagagcatgatattgggcatataatagataaacaattatacttagcggcttgggacataagattgtgaaagataatggtcttagcgtcttaggtgtattgtagaactgtgtagatgttccaaatgataagtagaaaaaagtatataaaatgaggaccctaaaaaaggaatagtggaggaatagtgtaaagtttatgaggtactacgaccttgatcttctcaccttcattgttagttacacaaaacacataaatgacacgagattattctattataaagttcatggcatggttctaattataagaacgaaacaagttatcatgaactatatatcaagttgtaaattacaagcatcaaatattaagttacacccaaggacagtacgttccaaaagaagaacgcacagttccattatttttgggaaagaagcacccatatgcagtcaactatataggcacataaaaaaatcacacagaaattaaacaaaggagcttcagaaaacgtgcatacaattatgttctctgatgcatgcgctcaatccctaaatgatgcaattatattcttaaatagcttcgactgccaaaaagaaactgatcaagatcgatcacactcttaaaatggagtaccgtactactcatcattatattaattaattaacccccttctctttgggcatgcttatatgcgtatagtcctactatactaaattaacccttttttttcttggacgacatacttatatatggaacatgcaaaggccacgtaccctcttggtacttgaaatgtttatttttctctcttggagaacaccaataatggtaagctagcaagcccaaatacccaaaggctacaagagtgatcccatatatagctatagctacagcaaagtaccagccggccacctgcgcagaccacgagagagagagaggcagtaggagaggatgaactgatcggcagctggttcgttggttggttggttgacggctcatgcatacggcatgccatgccacaccacacataaaatcacaggtacggcggcgccgcgattagcggaggcgcccaaggccgcgcgccgcgccgatcggttttgggatttattttttatcgagcagcgtacgtaagcaaaattaaccggattttagagtgttcctctccacatgaaagcaaatggaatacacgagaaatatgcatatctctcatctgcaaaaagcaagcgatcgaattttccccgtacttagctgtggagattgtgattgaaactacagtagaaaaattccccattttcggaggaccatcccgggtggtagaatccaccggaatcgacccaggaatcagccccaaaaaccgcaaggatgattgttctggaagtagaaaagaaggctcgatcccgaagtggcgtttcgcgagaagcatcgcatcaaccaaacacaaaccctaaaaccgaagaagtaaaactgtagaagagggaggaagccctagcgaccgggaggatctggagccctttcaaacgagagaggaacacagcagcaggtagctagatctaaaccccccaaaaaaatctcgagcggatcgaaaactaaaaaaagggtgagatcatcgggtgagcagtagcagcatcaacagtagagagagagaggggatcagagaacgcgcttacttggagctggcgaactgggagagcttgccggtggaggagaagacgacgagcgcgacgtcggcgtcgcacagcaccgccagctcctccgccttcttgaacagcccccgccgccgcttcgagaacgtcacctgccgcgccgccgcgctctctatcctccgtatctccctcctctccctcgccatctccctcccccctcccctccgatcaaccaccaccccctcctcctccgcgacagaaaactccgacgaaatccaagcagattcacccgcaacaacaacagcacagagagacaaggagagagagaaacgcgcgccgcagcggcggggtgcgcctagtatatagccgcggctcgccaatggcgaggcgaggcgaggcgaggaaagagaaagaaagggatgtggccgcgcgcggcgcctccgattggcggccgcggtaaacccggggcgaataattaaacaaatctggccgagccgagagccaccaccaccgtgcggtgcgtgtgtctcctcttctctcccctccgattgggcgcaactacactggtccttgtttataccaaaaagaaaaaaaaaaaggttaaaaaaagaagagaaagaaagaatccgcacggggcggctgacacgtggggcccgaggggggagggcggtgaggaggccgtgaaaaatgtgacgacgaagcgtgcagtctacggagacggagagtgcgtgtggcttcctgataaggaaagggggagtggggggaacagtgctgcaaaggggagagaaggattctaatcacctggataattgttgctaaccgtttatcacaaatcaactggtaaatgttaagatagattaatatgaaatatatcacactagaagcatttgagattaaatttaacttttgcaagttgtaaaaaataaatttagttgtaaatatatgtatactgattagagttaatttgttattttttacaacttatataaaaatataagttgaatttgaagttgaatgcttgtaaatgaatatattacaaattaatttatcttattaattattttttttctaattatttagtttatacgcaataaatagatagatactgcctccatctcaaaatttaactatttctagcacaatgttctaaaatgaagctatttctctacttacctcctcttaaccaatcacaatcattcttattcacctactttctcttttcaaccaatgacacacttcatccagtccgatcattctcacctactttttcttaatacccacactaaccttaaaaatagctatattttgggagggaggaaatatgtattcggttttagagcaggtacaaatagcaggctataagccagctataaacatattttaaagagataaaggaagagagagaaaagcagcgggctacagatctgtagccagctacaacacggatttaaaagacataatgtgtgtatgacaggtaagaccagatattactagtatagtaagtaactagtgtatgaattagatattacattggctataaatgatttgaagctagtagtgggctttgctattaaacttgctcggggaaaagaagagctgcacgccggggggattccctgttccgacgcgggccgtgtggctgtggatgtggctctacgtacgatggaaacagggataagattgtgaccggctttaccgttctcctctgcattactcgcaaaaaggatggctcgcctatcccctgaatcaatggctaaataaatagaggatttgggacaatatcctactatgtatagagtatgtataaatagcatagaagtattatgtatataaatatgtaacgtacgtactagtgtcctgtatagagtatgtataagtagcatatactaagtatgtaggctcatcgtgattatcaccgtcggccgtcgctcgacacggcatagtcatgacccgtcacgctcgagtttgtgtagattgtcactaatcgtgcttaaatacaacgtgacggcaagtacatgcacacggtggtgggtgatggacctggatatataaggcattttcgagaactagtatattttttctaaaagaaatgacgaaaacaaactgtactcctctgaaaatctcgtaaaattaatccatgacagtactaaaagacttgaaaaaagctcccgtgtgtaaaaaaacacacggaaacttcccagtctccgttagcctgtgttcagattcctggagggaactgatctctcccgcatggaaaacagagcgatcaattaattaagtattagctaatttttttcaaaaatagattaatttgatatttttaaagcaacttttatatagaaactttttttaaaaaaaaacataccgtttagcagtttgaaaagtgtgcatgccaaacacacccttagtgtgagttctacgatgaaccctaaacatttttgcttttcgggcgcaatcgagctacagtgactgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccagactagctatatataggggtgggaggacgacctaggggtgcctagggtcgtgctccaccagcttggggcgcaccccacatgggcctcacctgggccggggtcccaaatgaagttacaagcccataggcccattataggtgatgcaacaccttgttcctgtgattctggccacacgagatagaattcagagaagaggctggatctgttagaaagagggctccgagagctttccatcaagtactcacgggccgaaaacggaggtcgtatgcagattcggtggccgtttgaagtcagcggtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagca

SEQ ID NO: 46474 - DNA, 3173 bp, Oryza sativa
cctcgatacttgtttcgcagcccaatcttgtgagcacattaaggcctccaagagttctggagtaagccggctacgatgctcactaagaacccttccacttgtgctaaatgcagattcagatgcaacagtgctaacaggaatagcaaatatatctcgtgctaccttcctcaatgtaggaaagcttgtcccagccactttccaccaatcaagaatcttaaagttttctgtattaattgaaaccaactcatcctctaagtacctgtctagctctgatttaacacgtattgctgctggtctcctactagtaacacgtgctgtgattgaagacaataaatcagaattgacaagtggaggagctgaagattccgtgttatcctcatcatcttccacttcatactccttcatcaaatcatatagagtgtctttcacctcagcaactttcgttgcacactcttcacttgactgaccagtgatggtttcaatgaacccaaggaggtagtcaatcttaaacctaggatcaagaatggtggccaaccccattggcccttgaatatctttccagtacttatcaaacttttgaatcatttcaactgacatttcctctatagtagaatcaccacaaacagcccacttcctaatttgctctttagcctcacagattttaagtagttgaatattggaagtcacataatttgtgccagaaaatactgcagtgatgtcattaaacaacttgagcctatcaactacctcactagcaaaagcccattcttcttcactaggagcacaatcaaatagcttctcaacccgtattgcacggtcaaaagcacgtgcacaaggtaaagcaatactgagcatcctataggtagaattccacctagttttgcaatcaaggcctaacttgttttccatcttaactttcacatgctttgcaatttcctcaaacttttctactcttttaggtgtggctgtccaaaaggcaacactttcacgaacctttgcaattgaatcttttatcacatctaaaccatccctcacaatcaagttaagaatatgggcagcacaacgcatatgcaaaagtttcccctctagcataagcttacgcttgccgatctttttgatgagttcagaaatcaccttatcatttgtggtgcagttatcaagagtcaaagttgatatcttctcatcaagattccattcaaccaacgcttcataaagatgttcacaaataacttctgctgtgtgtggagcgggcacatatatgaatctacaaatggaatattgcagcaagattaaaatgttgaatttaagatggtgacaagaggataatcatttgtgaatcatgtacctcatgataatgcttctaagtgtccatgaatcatcgatgaaatgggctgtgatagccatgtagcctcttttttgattatcagaggtccacaagtcagtagtaatacccactctagacttagctccagccatatatgctaatgcccttttcttttcttcctcatatgtatccataatgtccttcctatattcaaacattaatcaataaactcactaactaatcaaatttcagaaatgcaaaaccagcaaataaataatagatgaactgaaattacctaatagtgttccgagtcaccatcttgaataatggctgaagtgcactaacaaatcttcgaaagccaatatggtcaacaatagataaaggatactcatgtaatattatcatggcagcaagctctctcctagccactgctggatcaaatgtgtatgtgtccacagaaactttccctccctctatggaattgaacctcaatgaagattgtgcaagtgtctttggccccatcttgatctttctcaatgtgcaaattttcaaatggtcatgtagatgtgaagtcccattgctgctcttccctccaagccgcttgtggcaatgaaggcattcagccttgacatcaccacagactttgactttcttgaaatccttccaaacaacagaagtaagcttcctctttgtgccaaaattctcagaatcatcttctggctcatcatcttcaacttgtattggctcagaatcattaacagactctgcttgtggtggaagtgactgcgattcttgctggctgctactcccacaaccagtaccagcagttgaattcgtggtaaatctgacaaatgacaaataaatatagatcaatatatctttcagcctatagaataatcttggcaaacttgaaatgaagaatctctacacataaatcatactgaaatctgctacagcctatagaataataaatttcttatgatctacactacacagaatcggattcctttaatttcaaaaacttaagttcataacatatttataacttaacaacattcaatgtacaaccatacaatatacatgtaaagatatctaattttctacagatactctaaatacaacattcaatatctaagaaaatcaagcaagctgcaaattaataaattgcacatgctaaattgttaggaacttaggattacgaaagtgaagctacaatgtataaagggttagcgtgaaatcgaaccccatggatttgaataagcgcaggccgttggcggaagatgaagcttctggagttcttggagcagaaggagctcctgccttagtcgaagcagaaggtgctcctgcaatcgcaagacggctttttgacctagtggtggtcctttttataggtggttgcggcggccgacagcaggcctttgcaccggagttggaggaaccagatctgcccacatgaacaatggcagatccagcaacaggcacgacagcgggtgtggctgcagctgcagcgcttatagcatgcgatggctggtccaactccgcattggcgtcccttattgtggaccgccgaacgtgagttagtgactcaacgagacaatgatgcagccatggaagaggaatttagtggagggggagggggatatggtactataggtaggcgtctagggaggggtactgagttgggagtaggacagctagatgtgctcaccttgcatcgtcgtcggagcttagcggtggtgaaggcgaagccatggcggactcgagcggctggtcgtcgtgtggactcgtcgttttcccctttcttgccaccgaagccttcacctgcatccaccatgagcaaaacaaataa

SEQ ID NO: 46475 - DNA, 756 bp, Oryza sativa
atcatgggtgaaatccgcgcgctccacaacatggacgacgacgaggtcttcgcctacgccaaccgcatcgccgcgccctacgacctcgtcatgcagaccaagcagctgggccgcctccccgtcgtgcagttcgcgaccggcaacgtcgccacccccgccgacgccgccctcatgatgcagcccggctgcgacggcgtcttcgtcagctcgggcatcttcaagagcggcgaccccgcacgccgcgcccacgccatcgtgcaggccgtcacccactgcaggtcatcgcgtccaagcacgccgccgcctcgtcgtcctcgctggcacaccttcgccgtggagctctgcccggtgtgccgcgacagagaaagagaggaagagatgaacggagagaaagagaggaagaagaacagagaaagagagattgacaagtgggcccatagacaaatttgcctttaaccaaagtttctctctccattttgaccggaaataataaaataatggaaggagtgttcagcagctaattaccacttttttacagtatccacgagcaaataaacgatctttgggtgtctcacagcaaagatcacaatctttcggtgttctgtagcaaattttgccattgaatgtgaggaccgatgactatgagtgctaatctgtctgtctatcagtaaagagtacggggcatgacgctctttcccacctcctgttcatcaattgggattcatttatcgatcagatgcatttcggggaataaac

SEQ ID NO: 46476 - DNA, 8602 bp, Oryza sativa
taaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccgtgtctcgtgcattgcctctctcgcgaatattccacagaccgagggcttagaacctcacttagcgcccccggccgaaccggcaaaggggggcctgcgcggtctcccggtgaggagccccacgctccgtcagtactaataataatttgattgatataatagacaaaagaatccaacttcttcgcaatgtacactccctgcttcctttagtgtttagggaaaaaaagcatgcagaaaacatcaatttttctaagctttttaccattttaacgtaagttccttttcccctaagaactcatgtaaaaaatattttttgtctatactagaaaaagacgttttccagcggtacaacgactattaggagctataatgacattataattttacactaatttataatctacattggtcaaaaaataaatcacctaatagaaacatctaataaaaaatataaaatattttagagttggaccagggtttcacttatcgtgtgataatcgcatcacttatcacgcttatcgcgggggtacggtaggggaaaccggcgatatgatttggatgaattttgaccaaattcaaaattccggaaaaaatcgaaaaaaactgaaaaaattcatggatgtagcgcgataacatgccacctcatcgtccactagtaataattacaaggaaaaattggaaccatgccattataattttgcaaaatttaagatataccatcctgaaccacatgtcattgactcatatgagttctacatgtcattgagataccgatgacatatcttaaactttgcaaaattataatagcatgatttcaatttaccctaattacaaacaagcttatgcaagcatgcaacatatctataattcattgaattctacatatcaacatccaatcatttttcttcacattattttttcacaatatttttaacatatatatatatatatatatatatatatatccatcatttctatattacttaacatatattcatctatacaattaaagtgtagaatatcatatttcatctacaatctcatactaaatgtatttctctctaaacatactttgacaaaccaattttatttgttgttaataactaatataatttatacttttatacttttagctcgatcattaaaaaaatttagaagttacttggcaatttccgtagaaagcgtgggaaatcacctaatgtgtcccttcggtagacgtgcggacgcgttgtgtgcagtggaagaagggatagaaggacgactgcgctacaaaattccaatgcatagaaaccttgagggttcatagcatgggtttgaacaacgtgtaaattgaattcctgccttttcttactccagtgttttcaaattcctacattcgaaagaaatcatgctttaacagagtactcccttcaacacagagctccctgcccattgcctcaaatcgtgtaaaaaaaataacttaaccttcagattaccatactcaaccgagcaaaagttcatcatgaacaaatgtctacaagaacaatactgacagcaataaaacgagctaacggattctgctgcaagtccttggacattgagcacaggaccattcatcagtagcaaatgctacagaaaaggaaatgtttgttgctcagctatcagcatacatctttggtcgatcaaggatgtaaataaaaaaaaatctgacaattaagcttgaacacttacaaagtatggatgttttccatgagcacattgtcaaaatatctctgaatatgaagttgcatgatcatacatgtattttacagaagacaacgcatacaaagacctccagcatgctttcagcttacatttttcttgaccagtagcaagaccttttttctcccatacgttgccattgatgcaagtttacaaggtggcccaaaggagttaatctgtgacatctcaaaagggaaggaaaagaaacaaacaaaaaataagtctttagtcaacaatgtgcatcattggcgatgtacaacaaaccagttttttttttcttcagagaagaaaataacaaggcacctgcattagtgtccatttccatgcgtctcatgttctgcttcctctgcatcctcaaaacgttggtcattgatctgaagctgcataaggacattatgaggtttttgttcgagttagctcatgagattggcaggggaaggaacaaaagagttttatcttagtatacagatcaaactgttcagaaagtaactgtttgatgtttataataattttgaaaggataatcaactgccaccctgaatcacacggtatatctgtatatgaattaactataccttaacatattatgtgacaaaaacagtaagaaatatacatatggtcgtagtttctaaataaaatgacgtgagaggatgccattaccaattcctataccatatgttgtagtaaatacagattatattcacaggagcccgaagaaaagaaaaaacctttacaaccaagcttataacacaagagttttatttcacttgcaatcgtttcacagaatcatataaagcataaaacataatggtagaacaaaccaacagcatacctcaactacagcatgagtaatatcatgttcatcagtttgacctatcgggttgacatctgaaaactcacattagcatcacttcctgaatgcaagataatacataaaagattatgcataacgtttggatgaacacaaaagagaaatgaacagggcgaattcttaccaccagtcatatcttcatcaccttcatctctatgagcccagccattctcttcatcactctctggtaattaaaaaggcatacatcaaacaaagaacattcttttattgtttattaactattaaaacttaccagcattaggatcggggttcaattcagcacaatgtgagaatgcttcaaagagtccatccactgaaacttctgtcaaggatccaagatataatgtgaatatataatagaagatacaaatgcttcaagaaatagtattagtcaattcttcaaataaatagcatttcaaactgctggaaataaaaaatatatctgccatgatgatctgcagtatgatactaattatgcaaggtagtttattcttgattagctattaatcccaacagagaaccatttgtaactgaataacataagacaagcaaatttttacttgtgaaggaacagaatgcacacattacattcttaaagtagtaccctctagagtgaagacctactcttcaagaataaacaaatctaatcatgactattagttgctacagtcatgagaataaattaaaaataaagagctaatgaaaaatgaacatagagcattagaaatgatagttatttcatgtaaacctgcactcatatcaaaatttagtatgcaagcatcagaggtagatttatacaaggaaaaccaataaatgctcctacatcagacaatttactgtaaaaaggatacactgacaaggatcagatggtatgatacgcatctcagtgactttcgatagctctgtttccacatttacttcggagtctgattcatcggactcctcatcagaaccatcttctgtctcaatctttgaaaattccaacaaagggaatagcaaacattagaatcagataataaaagataacaccgaaaatagacaaagaatcaattgtgatatgccaaattcactaaatacatcaacatcacatttcagaattcaaaatttagcagctacaagagctctaaacaaaaaccacgaagaactccgcacccacccagcatacaggacaaatgatatatccagactaggatcactcttgagttgaaaattatgtaccagctctatgaagattacaaaaaggctgcacgtgataaattacatccatacatttatctttcaactatttgctactatgctagtagcaaaaatcaccttcactggtgtttgctgcgtacaaactgaaatctactaatgctataagatcaaaaggataaaaccaaagagaataaacaatagcagtgtccatccgttagtacccggtgaaccaaaggagaaaatttctgccaatcctctcaaagaaaaggaaaataaactccaccttagtcaaatgggtcatagcctgtagtttgtcacggcggcaacatctgtagcagggagttcaaagcagaagccagcggcccagcctgtgaatcggcccagaagggagaagcagcccaactcccgtttccctgcgagtgtgtggacccagtagtgattggctgggccactgtcagtgagtgagagaggctgtgtagtgcgatgctatataagccggcaggattgagaggaaggggatcgaatcatgtaatcaaacatactcaaattcaattccatctctctcctgttcaattctgttctgttcttcttcttcttcttcctcaagccaactctctcaatctcttcccttctctactcgaccgaatctctcctacgagttcgagaccgtgacaatttggtatcagagcaatttcgatcctggagaagccacgatatacttcccgtttgcaacttcaagtcgaagcgatggagaagcagaacattgatttcggcaaggtgttgatggagatctaggagtccttggtgaggctgaatcgtgctcaaggcgaaactcaagcagcggtcgtcaagctagatcgcgaagtgagcagttggagacctcaagtagaagcagcagttcaggagttgcgtgaggaagtcggcgaccttcgtcagcaactggatctcgtcggcaaaatgaagcaggcttctccggcgacgtcttcccctccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcggtgtgccttgcggcccgcctccaccatggcctccaccgagcattgcccctcttcgacacgcgctcacgccgcgtcgagctccgcccgctctgcctgcaggacctccatctgggcatttaacccatccaacaccgtggtgttcgcagtggccaaggcttgcagaaggggctccgcgctcagtggggcagcggaaggcatgggagagagccgcctcggtgagaatgccgcacggctcggcccgccgatcgacgtgccggactcggggacgtcccccgaacctggctcgtcctgagcgtcgcccgaggagtcgggcccgagcggtgcgcctgcggcctagtcgtgggtggcctcggaagtcatcgtcgcctcgggcggagtcgggtcgggggcttggcaggccgcctggcgtgcgcgtgccacctccgcctcccgggcggactcctcggcccggcggagcctggcctcctcccgagcggcttcctcagcctggcgagcccggacggcctcctgggcagcctcctcggcttcccgaaggcggtccgcggcttctcgccggtcagcttcccgcctccgggcctccgcggtcgccgtatcctcggcctcagaccggccggacttggaatggcgggaggggcgcgacgggatctcgctgaagcagaagaaaaaccagaagacaaaaagaaacaggtaagtgaaaactcgctttgaaagaatgaattcggccgtagtaggcgcggggacgaacctgcgaggaggtcggttaaacgaccaccttgggggggagatgaggtttccccggcttggctcggtcccccccatcttgcggagccgtttctttttccgctccccctcgggctgcggcgttggcgcggcaccttccgagcgcctgctgctagcacgcaccgccccgccccctcggggaggagatggggaaggggtaccctcctgcttcctcttcccccgggcgtcggcagggcggctgccccccgggcccccgtcgcggggcccagaagcacgaccccctcctggggtagattgttcccccctgcggctcccgcccgcgccatcgtggcctcgaggagcccgctcctccgacgccccgaccgccatcatgatggtcaagatgttggcgcgatctggatcgctgcagagggggaggactccttgggggatgagggacgcctccacggagctgagattcagcacccgttggaccaccatcttgaaatcctcaggggcccagtcccatctgcccccctggtgggtcctcatgtagtccttcgacccggtgtactcccaggcgccccgggcgcgccgctggagcggcgcgatccggcgacgaaggtagtcgtcgtacaccatggcccccgtgagcccctaggatcgcaggcccgccaggcggtcaaggacggtgtcgtagccgtctcccagatctaccggcacgcgccagctggaggcctgcgccgggggctggctcggaagtcggaggcgcgcttcgtcggcgaggggggtgtagaaccagtcgctcttccagtcgtcccacttcttgcgcaggacgcagggaatgtagcggctcagcaccggcccccgcggctggaagtagcagccaccgaccaccgacggcggcgacactggctgtacggtgaagaaccaccggaacagccgaagagatgggcgcaccccgataaacatctcgcacaggtgtgcgaagatggccaacgtcattaccgcgttgggggtgaggtgcgccatctggagatcataatgctccagaacatccatgaagaaagaagagaatggcgggactagccctgccattgcaaaagagaggaagaagacggaccgccccgggtaacgtggcgccgggcgtccctcgcccagcgcgaccatctcccggccggtggcagattccggcatgaagcggcgcggtagcccagcctgcctctcgctcacgatgcgggaaggcggcagcacgctaccatcgagcggtgcggagccccgtgccatgacgccggcagaggaggaacttgagaacgagcgagtgcggcgagggtagggcacaggaaacgaagagttagagcgcaagcggcgaaggcaaggggaataatggcgagaggaaggaaacgaatctcttcctcggcgtctttatacccttgccaacgctctgcccggctcctcgcttcccgcgcccactatctcgccccctcgtttcttgcgcccacgcctctgctaatcccactcgcccgtttgcggcgcacgaggccgtggcagtcgagatgggacatatcgtgcgcgcgttaacttcgctcgccgaccgaagcgccatcatcacgtctccaggcgaaacgaactgactcgtcccgattcgcgcgctgctcgagtgatgtggcagtctcgaagaggccgctcattattatcgatcagttttccctgccaatgcgtgcgacttgcgaccgctgagttcctacccgcctgtagagaccggccccacctgtcaccagatctaaagaatggcgtcacgcccgagcgcttccctcgaggggggcgatcgccctggcgtgacgccgggggctactgtcgatgacatggggccgagggtatcatgactagaggttagggtagccgcagtcacccacgtggcccgggtcgggcccgagggtgacgagacctccccgccttttgtctccccgaggggtcgggccgctcccgtttcggccccgagggcaggggcgccccgaccccctgtggttttgacgccacgtgtatggtttaggtgagcacagcagggctcacctaaccgcatttattg

SEQ ID NO: 46477 - DNA, 9933 bp, Oryza sativa
caatggtcacacaatccacactagtcaccaaccaagagcactaatttagaccaggatctagcttaaccaagcatctatacactggcatctatacagtggcatctgtctccaccaatccatttcctaaccacctaaaccaaagctatacccatgagtcgaaacataccacaaaaacaaatggattcaaacccaatcaagcattgcaattagaggtggctgcaactggtcaataccttcaccgcacggcgacttgcgggtggtgatgtggagcaccttggtggggatcctgacggggcccttgacgcgcagctgcttgtccttggcgcccttcaccagatcagcgcaaactgcaaccataaacacacgaatcagcttcgcgctctcagcaaaaaaaaatccgatctaatctaatcctctctgaacgacaacgaactgaaactatagaagaaaaagagaaagaatggattacccttctcgaggttcttgacgttcttggaggagagggtgatgcggatgcggttgagctgcagctcccgcgcctcctccatgccgagcttcccgcccttcatcgcgccgccggcgccgtacaccgcagccgccgccatgtttgcttcgcctcgcctcgcgttctccgctccgctcgctcggggggtggggttggtggtgctcggggatggcggcgcgggtggcgttagggtttcggagggggcggaggttcgctcggaagggccatttatataggagatgatatgggctcggcccaactctaactaacctctgaatgggctgtctctcagactctcactctctcttcttttggctgtctgaaattggaaaagtgtatggtttttttagggtaatatatgatatatatttttttgaggtgcaacataatcaaagattcaaagtggccatcttttatgcttttgtaggattttattagtttattgtcaggttattctctaggaatatttgtttataaaggatatagaacaagaatagattaataaaagggattttagattagtagtacgcaatgctagaaagtcttataacctgaaacaaaggtagtacttgtcgatgacatggggccgagggtatcatgactagaggtttgggtagccgcggtcacccttgggtcgggcctgagggtgacgagacctccccgccttttatctccccgaggggtcgggccgctcccgtttcggccccgagggcaggggcgccccgaccccctgtggttttgacgccacgtgtatggtttaggtgagcacagcagggctcacctaaccgcatttattgcggtttggacgagcgcgccacgccgcatttaatgcagcgcagcgctcatccggtccgtgaccggtcgcagtgtgtgaccggtcacagaccggtcagatcgcgggttaggtggcaacaggcggcctgacacacgcctcgccccgtcccgtcggattgatgagagcctccaggcactcgtccctagccggagccggcgtgctacctcctggagttggcacgtcagtcccgcccagatatattccaggcttcatcgcaaccattgcaaggaagtcgttgtatgaagaagggcagacatgcagcttgctaaactgacacgtggtggacaacaatgaccggtctgtgactggtctgacgctggtcatgtcataggcagacaaccgcgcacccattttgcacttccttccagcggagtggaggtaggtatgacccatcccatcggagggtcattcggacagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccatgtctcgtgcattgcctctctcgcgaatattccacagaccgagggcttagaacctcacttagcgccccccgccgaaccggcaaaggggggcctgcgcggtctctcggtgaggagccccacgctccgtcatctggcgcgccatgtagggggcgcgtgtgtttttctaagctctcatcctctttcgtgtgcgccaagcttctcccgttcaacccaatggccgaacgagcaaaagcgcacaacctctctctgagtgctagcggtgacgacggggagcagaacccgcgccgtcgagctcgtactccaccgcccccctctcgccgaagtcttaggcgggaggaggcgctcgagggggtcgaaagatccgcaactttgccgcccacgagcgatggagaaggacggcgagacggagagcgtcgcctcctcgtctacggcgatggcagcacgccccagggcgtgctccaagctgcgggcgcgctcttgcgtcacccgcccgtcgtccccgatccagagactctagcccgacgttggttggatgacgtggccgacttggtcatgacggcgcagcagcgcctaggtgccggtgggcggtcttccgccaccaaggcctctggcgctgctaccgccggctccgtgtcgtcgaggtggagggcgcggcgagcggcggctgttacccgccgttcgtctgccattctctcgtcaacgcctccgacccaggaagatgtgcgtggggggccggatgcccgcctcggtttcgagcgtcggcgcaatggtcgtcgtgctgcccacgcaacggagggcgcctcctcgtccggagcgccacttcagtacgggcgcgggggccagccctccgtgcccccggttggtggtgttggctgtagagcctttgtggcgagccttcgaaacgtccgttggcccccaaggttccggcccaccatcgccgaaaaatatgacggaagcgtcaaccccgccgagtttctccaggtctacacgaccgggatcgaggacgccgggggtgacgacagggtcatggcgaatttctttcccatggccctgaagggacaggcgcggggttggctaatgaacttgccacccgcgtcggtccactcttgggaggatttgtgccagcagttcaccatgaacttccaaggcacatatcagcgcccaggtgaagaagcggacttgcacgcggtacagcgaagggatgatgagtcacttcgctcgtacattcagcggttctgtcaagtccgcaacaccataccatgcatccctgcacacgtggtgatctacgcgttcaggggggcgtgcggcacaaccgcatgctcgaaaagatcgcctccaaggagccccagactaccgcggagctttttcagctcgcggaccgagtggctcgcaaggaggaggcctggacctggaactcctccggttccggtgtggcagcttcggccgcccccgggtccgctgctcggtcagggcggcgggacaggaggaggaagaagaggtcggcccattccgacgacgagggtcatgtcctcgccgtcgagggtgcttcgcgggccacccgaaaggggaggcctgcgagcgacaaaaagaaggaggccggcgctcccagcagggagcgcccgactggcaagtggtgcaccgtgcacaacacctccctccacgacctcgcggactgccgcgcggtcaaaagtttggctgagcggacgaggaagtgggaagaggagaggaggcaggagcgccgtgagggcaaggccccggcggctccctccggcaaccggcgaagtgaggccaagcaaaagggacccaccgaggacatcgacgatggcgacctggggccaccatcgccaccgtcgatgggggagcgtgcactcacgcttctcgccggagcctcaaggccatgaagcgagagcttttggccgctgcccctacccatgaggcgacgcggcgggcacgatggtcggaggttaccctcaccttcgaccagaccgaccacccgccgtgcgttgcccggggagggcagatcgcgatggtggtttcccccaccatttgcaatgtgaagttggggcgagtcctcatagatgggggcgcagccctcaatatcctttcccccgcggccttcgacgccatcaaggtcccggggatggtgctccgaccgtcccagccgatcatcggtgtgacgccggggcacacttggccgctaggtcatatcgacctcccggtcactttcggtggttccgccaacttccgcacggagcgggtgagcttcgatgtggcggacctcagtctgccctacaacgcggtcctggggaggcccgcgttggtgaagttcatggtggcggtccactatgcctacctccagatgaagatgccgggccccggtggccccatcaccgtccatggcgacctcaaagtcgcgcttgcttgtatggagcagcgcgcggaccacctcgccgcggcgtccaagcccgcgggcagcgacgagaggcttagaccctccgtcccagccgccccgaggcagcggatgatcacgtacgacaaggtcccggtcaaggaggttgccctgggcgacggcccgtccaagaccactcgaatcggtgatcttctggacgacaaataggaagacgcgctcgtctccttcctgcgggcaaacgccgacgtcttcgcatggagaccggcggacatgcccggggtccccagggaggtgattgagcaccgtctcgccgtgcggccggacgcaaggccggttcggcagaaagtgcggcggcaggccccggaacgtcaagccttcatctgcgaggaggtggcgcgacttctggaggccggatttatccgagaggtcatccatccggagtggctggcgaacccggtcgtcgttcccaagtcgaacggcaagcttcggatgtgcatcgactacactgaccttaacaagacatgtcctaaggacccttacccccttccacgcatagatcagattgtcgactccactgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaagacgcacaaccaagagaccttactcttggatttagcggaaactttcgaaagtctccgctccgctcgcataaagctgaaccccgacaaatgcgtgttcggcgtgcctgcgggtaagcttctcgggttcttggtctctgcccgaggcatcgaggccaacctcgagaagatacgagctatagagcggatgcgccccccagccagcttagggatgtgcaatgcatcaccggctgcatggccgccctaagtcggttcatatcgaggctgggagagaaggcgctactcctatttaagctcctcaaacgctccaggccgtttacctggacagaggaggctgagcgggccttcactcagttgaaggattacctcagttctcccccgatcctggtcgccccggagccagatgagccgctgctactctacctcgcggcaaccccgcaggtggtcagcgcagcgttggtcgtggagcgcgacgaggacaaccctcacttcgcgcgtccccaccctgtgtcgactcgacccgggagagagcagggaggagaggcccccgagtcgaacggcggcccgaggcccccgacggccggagctggccctccgcccgcttgtccgacggtgccaggcgcccccgacccccaggatggcctcggggccactgcgggaaggccgcgcctgtcgccctctgaccccgaggtcatcggcgcagaagccaagtgcgccccgtgcggcctctcggacgaagagcgccctggagatgcggcccttagcgaagaggatcggccccgccgaaaggtgcagcggcccgtctacttcgttagcgaggccctccgggacgccaagacccgataccctcaggcccagaagatgctttacgctattctaatgacttcgaggaagttgcgccattattttcaggcgcatcgggtctcggtggttacgtcttaccccctcggccaaatcttgcataaccgagagggtactggacgggtggtgaaatgggcaatcgaactctctgaatttgatttgcactttgaaccatgccacgcgatcaagagccagggcctcaccgactttgtggcagagtggaccccagctctcgagcccgtctccgccctcgaggccagcttgggcccctcacagctgcctcacaccgcctgctgggtgatgtagttcgacggctccctgtctcttcagggcgccggtgcgggggtcacgttgacctcgccgagtggagacgtcctcagatacctggttcgcctcgactttagggcaaccaacaatatggcggactacgagggactccttgcaggactcagggtggcagctggactggggatccgccgcctccttgtgttaggcgactcccagctggtcgtaaaccaggtctgtaaggagtaccggtgctctgacccggagatggacgcttacgtacgccaggtgcggcgtatggagcgccatttcgacgggatagagcttcggcacgtgcccagacgggataacgcggtcgccgacgaactctcaaggcttgcttcctcgcgagcccagaccccaccgggcagctttgaagaaaggcttgcccagccgtcggcgcgacccgaccccctaggggagacggacgcgcctgaacggcccccgaggcccgtcggagtccaagcctcgggacccgaggggagcgctcccagctcccttagattgattgcttggaatcgctcagatccaggcgtacctcgcagataagactctacccgaggaccgcgaagggagtgaacgcgtccagcgcatctccaagcgctacgtgctggtggaagagaccctctatcggcgcgcggctaacggagtcctcctgaagtgcattcctcgggaataaggcgtcgagcttcttgccgatatccatgaaggcgagtgcggagcccactccgcctcacgcaccttggttggcaaggcctttcgccagggtttctattggccgacggctctcaacgatgcggtcgacctggtccggcagtgcaaggcgtgccaattccacgccaagcagactcatcagctggcccaggccctgcagaccatacctctttcatggccatttgctgtctgggggctcgatatcctaggtccgttcaggcgggccccgggcgggttcgagtatctgtatgtcgctgtcgacaagttcactaagtggcccgaggcttatccggtcgtcaagatcgataagcactccgcgcttaaattcatcaagggcatcactgctcggtttggggtgcctaaccgtatcattacggataacagcacccagttcactagtgaactcttcggtgactattgtgaagacatgggcatcaagctctgcttcgcctcccccgcccaccccagaagcaatagccaagtggagcgcgccaacgcggaaatcctcaagggccttaaaaccaagaccttcaacatcctcaagaagcacggcgactcgtggatcgaggagttgccagcggtgctctgggcgaaccgaaccacgccaagccgagcaaccggggaaacgcctttcttccttgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggccctccgagccgcgcgctaccagcagagcctgcagcgctaccatcagcgccacgtccgggcccgatcactctgcgtcgacgacctcgtcctacgccgcgtccaaacgcgtgctggattgagcaagctctcaccaatgtgggagggtccgtatcgagtgattggcgtcccccggccgggctccgttcggctggccacaggcgacggcacggagctgcctaacccgtggaacatcgaacaccttcgtcgcttctacccctaatgggagttggatgtcaggtctcgggctcgggccaaccccgcacccccctcgggcgtgcagggttggccgggggctaccacacatgcatattcttatcttttttcttccgtatttcaataaaagcattttcgatttcccaaggactgcgtctgtgcctttgtttccttttgaaaaatcttggcttgaattagcacgctcgtgctcgatcctgcccttggtggcccgggccggctaaaatcgccaaaaggggcccagaaccgagccgtgccccggggcgtggtgaactcccggggggggaatcggcaaaggcccacaatcgggtcatccataaccctcggtcaccacgttcccggcctggccagtctcgacacgtgaatctccccaggcactagccccgacccgcgccatttgaggctgggacctgggcacgagcccttgttcaagctaagacacagaaggaccgtggcacagaccatcctcgtctcatacacacaacaaaagaaattgacacagaaatttcctctttatttaattgcagattaagttagtctatacaagaagggggcccgaaggcctcggaaaaagaaggaaaaaactatttaaagattggcggaggcctgggggctcactccgacgcacccgggtcgccggcctcgtcaccgccgtcaccgccctcctcgtcggagtcgagggcgaacgcgagccgaggggccgtaccctcgaagttgtggacgatgtggtcggcggcgtcccggacctgcgcgcgcgcaccgtcctcggtcccgggagggaactcgtccagcgctgcccatggggagaagtcagggtccctggcctggtagctcgccagtacgagctccaccgctcctcgggcgaggtccctcgaggatgacttaattgtctcctcgagctcctcggggagccgctggagggtcccggccatctcggagaggcgctgggcgaggcccccctggttggcggcgtacttcacagtccgcccgccccagagacccacctaccgcccggcgcggtctagacgggagacgccgtcgcgaagcatgctgggccctatctcgcctgccaagcggagggcctcgacctcccccgtggacgagttcagcgcgccctgcagatccgcgatggtgtgttcagcagctgcgaggcgggctgctaagtccccgtcgcccgcggccgccccgccgctgcgtgccctcgcatccagctcccttgcccgcgcctcgagctcagcggtccgctgatccagtgcggccctctcggcgcgggcaccttccagattgcggcgcgcttgttcctcccgcgccgcctcgcggagggacaggctgtccgccagcctttgcgccgcggcctcggcctcctcgagagctctctcccgctcggtgagcgcatcctcgcggaggcggagtgtggactcctcttcggcacagccggcctcgtgcgccgccagtgttgtctcccggatggcgacggcggcctcgcggtccgccaggtccctctccttcgcgcgggcgcgctcttccagcaccatggcgcgggcctcaagggcttcttcgcgccgccgggacgccgcctcggtcttcgccgcccgccgttcccgggcagcggcgg

SEQ ID NO: 46478 - DNA, 6632 bp, Oryza sativa
cgatggaggcagaatctatatgaaagttatatatctaaatgagatctataattttgtagttgaaaatattttcatttcagctcatttatagtattaaatagtagtaaaaagactttgagtggagattgaggttgtgggctcgaaccgttctaactccatgcgcttgaaaataatgaaaaaatattgtgagttgtccaaaccaaagtgtgaccatgtataaatgactagtaaaatacaaaatattttttgggttttttttcgagcatgtaaaaataaaatagaggtgcaccttatagggaaatattcatttggtttattttgagccaataaaaataaaaaaaatcatctttataagtgtcgattctaaattatatccggtaaatcttgtgagtaggaaccaaagtatgaccatggatatgtagtaaaatacaaaatattttttttgtttttttagccctaaaaataaaaaaacgggtatacccctatatttgtcgattccaattagaacgggtaccaaactaccaataaggatatcattggtgcccctcgttagtaccatctgacgggtgttggttggggagtcaacactatgtagggtttatgtaataatgacatgctacccataatttgttttttctttacacctagtacctcatgtcgcaccactagctgtgtgacgtggcactgcgatccctctatcaggaacatcagtttatatatattatcatgtgttgttcaagctcgggtctcgcattaggcacatagcctgtcttatgttggtgactgtttttggtcgcagtcatttgtagtttcttaagcatggtacatatttgtttacatccactcgaacacgtatggatcattagttcgacacttcaagtattcaagtcattctgtatgaactcaaagtgacaacggaggagtttcaagcacttttttacgtccattacaacttgtgtgaatcatttcgtaacgaatggagtgcacatagagttcacatcaaattgagttaaatcatgccttgtacactcaaaatgacaatcgaggacttcaagcgcttttctacatcccctacaacgcgtgtgaatcaattcattcacaataaattaatggagtgaatattgagttcagaacaaatagagaccaatcattctatatggattaaaagtgttattatattagaggagattcaagtatttttcctgcatccactgcaacgcgtgtgactcgtcggtccgcaactgaagtaatgaaaattgagtttatacctgcatggatcaaaagttacattataggagtttcaagtgctttcttatatacattcccatgcgaatcattggttcgcaacaaatgggaagaatcattctgtatgtacttaacttgacattagaggagtttcaagtatttcttttaacatccattataactcgtttgaatcattcatttgcaatgaacggagtgaaaattgagtttggatgggagggttttttcctccgtaatttttgtatcttcttaatgaaatgactcacaatactaattatcttgcatgttcgagaaaatatgtggttcaagctatagggttacaggtggtactttttgttgccctgtgcaatctttgggtgattcggaatgatgtacatcatatcgatgttccagagtctcctaacgttgtcatggagaggatcgctttttggttggaagaatgggcaaatctgaatagtggtaaatcaccagctgttcactacccggcgaaatggtggcaaacgccttctagcggctggttcaaggtgaacatagatggagcattcatggcgtctgaacttaaggggtctgggagctgctagctagagtagttctgaggaataacaagggtaagattttgggggcagcatatattagcatgccaaggggctctgagtctggctataaaaatgggagttgcagagttgattctgaaaacggatatgttacatgtggtgaatatgctatctgaagaagagttcaatcattcaaagtataggacagttatccaagagttgaaatgtaagctcaggtacttccacatgttttaatgcaagattgttaatttgttattctcgccacaagaataagggcatttagcgaccctttcccatgacccacggatgaaagagtcaccagaatgtatgcctctattattttgcgactcttcttggttgtgagattatgatagctggtgacacattggatgacttttgcagaagactcaaggttcacaaatctagtgataagagcaaccgcaatgtatactaccaaagtggataataatgtgggcccagggttcaggtggtaacagttattacaaatctcacaatgtgctatgcctattctgcaaattaaggtggggtccaccttaaaaagaatcattgtaaaactatctcctatagccatgctagtacaaaaagattcccatatctacagaaaatattgtttattctcttgttaccggcagtagcacagtggcccggtagtagttattgtctctacccacaatgcttcttacctggttataagtctatattaattacttgttacctgctttttgttcaacattgtggttgcccttaccagctggtgacacattggatggctgtctgtagaagagtcaaagtttttaagtcttggtgaccccttacaagtgccatgtgttgtttgtttaattgtagaaacacttatgtttaattttctagggaacggtttacgaactggtcctcggttcccctatgttccttatgtcttactcccttcgtcctaaaatataaagaattttaggtaaatatgacacatacatcctagtacaatcattctaaatagactccatgtctagaattattgtactaaaatatatcacatccaccaaaatacttgagacggagggagtatcttgatgatggctatgaagagcccagtatgtttgaataaagtgtctttaggctgtgctgtttagggcactcacagtgcgtagccaacactgccacctagactaagaactttgtatgcaacaacctccacagtgcacgtggtcttctttttccttcacagtggtcccacccttctctctcctcactttttacctcctctcctatctctccctgccttccccaaccaggccacaaaactgctccctcctctagtgcgccgccggcgcctcccacacaccgccgtcgcccctctccccctccgccggcgtccctctccccctccggatctggcggcccgccggcggcgacacggcgcgggagccgaaggcggacgaccctgaggcgatctcggcgaagggcgctagcggcggatgaccccgaggcgggctcagcggagcgcgccggcggcaacggggcggagacggcggcgcggtcggcgacggtgccgaggcggccaccctctcctcccctgaagcggcggcggcgccaccgcgctgcttcggcttcgccttgggcttcttcgacgaggaggaggacgccgcggcgccgcccttcggcctccccatggcgcgggcgcgtctctctctctccttccgggcagcgcttgctgacgagacggcggcggcaggcggctagatccagctcgggcggagaggcggcgccgggagttggtttggtttgcttcttctctacttcaacggttggtcgacttcaatgcaagaaagcatcggcagcaattgctcctcccgtttagttaatgtcgtccatggcctccaacgaaggtattcttctcttctttctcaaatattctgtttctcgcatatatgtttgctccttttttttttccttctgctcgcttctctcttcttctgttcgtcttggtgatgacgaaactgaaggagtatttggtgattgaatctgcagaggccggattcccttctctcctgtgggatgaactcaacgacgacgcggggcaggatgaactcgacgacgacgcgagcgcgggagaacgacgaaacgaggtcacgacctccacaatgcgcgcaagtgcctgttcctcacgccgctcgccctggatttggccgaggaacgcgtgaccaaagttggacgcgcggacttgagaaaagtgtgccagaagctaacgtggcaaggaatctatgcgctggcgcagtgaggctgaacgccatctcaccgcattgtaaatggccttagtgtgagttctagctagcttctaaaaatacaataaccagatttgtggcacacggatgttggacagttggagtgctgttttaggagtctctgaaaagtgaccaagaatctggcccttgggttaatgacaaatttgattcaacgataatacatgaatttaattgaatatacacatgattttacaccactgactgtagtgacaaaaaaaatatttcagctctatagatgcaatcaaatcgtaaatgcgttaattttaaaactacctgtctatctgaagaaacaaaatagcaaggtcagctgtaatagatagatgccagaacaactaacaagtcggtcagaagaagcccgatagcatcaaatacgtattttggggcaaataaaccccagacctgcaaagtttgacattgcatagtgtcacataaagtccaccataattaattagcaaaagcaggaatactcgtggtattcttatgtggcgctggggtaaaaattaccatcaagtgacgccgttgaatggtaacacaaatgattgtaagcgttgttgtgattgatgtaattaaaccatacatcaaaagcacctaagtgaaacaaaacagacaaggggccccatcgatcagtaagcaaacaaacagaaaacataatttggtctccaaatggagttccataatgcatgcaagatcagtactccctccggttccatgattcttaacattttggatagggttgaggtcaaacttttgtaactttgaacatcaataactttaaatatatttagtttaaaggaagtagaacaacataaaaaataaatatatttagtttaaaggaagtagaacaacataaaaaagtaaacacgcatttatttattgtatatatatattataatagaaaaacaaagtcaaagatgtattttgaaggccgtgtcattgtccaaaacgtcaagaattatgaaacgagagggagtactacgctttgtcctattgtttatattctgggagctccaaattattttttgtatccaatattttagtgcctaactacttgcagtatatttgaatttggcatagataccttgaagttagtattttaggctgctgctttgtaacgttaaactggtccagaaaaaaataaaactactccatatttctaactaattacctgtattaatctggtgacagtggcatcattcaccttgctgttcttggatgcagaattgtaccagcatatggcaataaacggaagactaagaacaggcagtatgtgagaaacgccaaaagtatcaatggaaagaagaaggccttgtcggataatatggaaatgatcaaacctgtaaaattaattgttgtgataagtaaaccgtgtgcatcatgagagatgcctttcagcatttatatttggaacatgattacactcacccaatgaatgcagcaccataacggaggccatcaaaggtacacctgaaacataatttttgatcaacaatgtattttcaacaactccatctaaaaatatgaattaaatcacatcagatacagaaaatacaaattgtacatgcattttattccagactaggaaacaaattgcatactaaaaatgcattattaacagaaagataaattctaactaaaagataaaggtcagtaacatccacacagcaaagaaattaccaatgacccgtcagataaaatagacaaactgccagaaagctccattgtgttactgaaacagagtcagcagcatgtattcctttgtcaagtttcagctctctctgatttttctgctgtaactttattatacaccatgctgcaaaatgaaaaagaaaatcacatgccatgctcttaattaggacataacaggaaaagaatctcaaatagtgcccaaagtagtaattgccatgttctgagaagcaaccatatgtctaggaatagagctcacagtacctatagtcatacaaattagagccacaaagggaccttgtcttcccaacaagatcaagatagtaggactccaggagcacagcatgacagctgacaaactagttatcctttcattcatcttcaaatgatcagttgacccaaacaaccgataaaatgcagatattgctaatgataaacctccaatagtgtatacaaggcgaggagctaaacttattccagtctctctagtagctttagtatgagagagcaaagtactttcagaagcccaatgaattgctataaatatataactcaagatgcttccagacataacagagtacttcaagaatctatgactgatcgcataggatatgcacttcaaaattatataggccactaaggtaagagatatgatggggaatatttccatgagatcactgcaaaaacttgaaccaaacaggccacaaataatgctgactgggtggtcatttgaaattattgacccagaaatttgttttgacatcccaactcaatcccaaatcgtataaaa

SEQ ID NO: 46479 - DNA, 3783 bp, Oryza sativa
cacatcaataaatgtaggcagaccacctgtcgtcagagcctgagtatagaattttacagcaaggatgttaaagcctgggggtgaagaacacacaaagttacaaccatttgattgcactgaatcgtgcagagcatatcaggtcaactcaattcatgaatgcatataatgcgataatcttatactgcactgaattgaggaaaggacaacaatttttcagggtaactctgttgatgaatgaatgaatatctggattaacaacaacagaaacagagttgatcaccttaagacgttgaaggctagtcgtcggtggatcagcaagcgctttgaatatcctagcagaggtcttctcatcagcagccaatctttgcagaacctgcagtttgtccatccatggttgcctctctgcagcgaatcatggcctcatctcagagttacaaatcacattctcacatgttacacgttgagcattatagtaatacataaaaggagtaaatcaccttgaaagaatgtacttggtgccacaaaatcgaacctgcaggacagtgcattgcacaactgtgtcagctccaaacttatcctactttctcggtaacccaacactgagtataatcgcagtagccaacaagagatttaatttctctcttggggaatctaagattcgaggggtggtgattttacctgagggcgtcgaggacgacgatgacgaggcggtcgacggcgggcgggggccaggaggagcagcccggggagatgccgatgcggtcgtcgcggtggctgtggacgtcgagctcggtgcgggtgaggaggaagccgcgggtgaagaggtagatggcgagcgagtggaacatgaggacggcgaggaacagcagcggccacgcgcggcggcgggtgtggctccccggcgccgccatggatcccgtcagcgaaccgcggcgagatctggcggggggcgggtggggatggtggaggcgtgcgccgtagcgcggcgagcggcgtggcttgtggcggcgtcggacggcgtgttggatgggcctaattagtgggcctacggctttttgggcttactggcccatcaacgctcatgtcttctactgggctggatgcaacatgctgtagttgggctatttaggcatagtaaaatggaataagtgcacttaccatccctcatctttccgtctggtttaattagcatacttattaaacctcgatatcattaaatggttttgcggttttaaaaagatttaggtgaagatgtctgatattgaggtttaaacataatggacagaaagatgagggatgacaaatggacttattcctagtaaaatgcgtgaccatagcccgtcaaaatgttccactgctgatcagacggttaaactgctaatggtggacagttctaatcgagaggctgccctacagtaggaatgcaggatatgctttgacgatatttcttcagtggttcagtggatcaagtgtgtagcgctgcgtcccaaaatataagctactccctccattaaaaaaaaatcaatttagaaagagatgtgtccggagagagtaaaacgaatgtgacattttttttaaggacggagagagtaaaacgaatgtgacatttttcttaaggacggagagagtaaaacggatgtgacattttctagcccttttgtccagattcgtattctctatagattcgtaagaatgtttgaaatgagcgagacaagcagtagagagtatttcatgatcaaataccctcctgtaacaatcaccggattcgacggaatcccacgacagaaggggccgaacaaacaaaaattgaatccaataccaaatttcatgtggttgaagcaaaactggcgagttacacacctcttacatgagaaagatccatagcatccgcgcacatataaaagacccagatacactaaaccagttggatgtccgttacacgcatggcaatcggaaccgagattctaagcagcagagaaacaagacaggtaggtctaaggtagtgctagtttggcagcattacacatcagcgatcgtcacctcgacctcgacaccaggctcgatggtgatggaggtgatctgcttcacaacatctgggagctgatgagatcgatcacccgcttgtggatgcggaactcgaaacgatcccatgtgtttgttcctggtcagaaaagaacgcaaaatagtcctgaattagcacaagaaaacccaaccaatgtgaagttaagccaacaagatgtcagcaaatttccctagcttaagcaactagcatccaaagtggtttcatctaacaaagagcgtccagtttaactgttgcaagcataaactgacctgaagatatattgatgaaagataagcatgaaagtaaaaaaactgtcaatcatcagaacaatatgctacaactacatgagcataggtaaacaggggtacaggatgattggcacacaaaaaggatatacattacaagttaaacatatcatgtactttgtccaattaacaaatcaatgaattcacataataataaatcccatgaaacaaactcacatgtccacttaaatgggcgtaaagtttgatcctttagtttagtgatgtctttttgcaaccaagtctcttgcgcaatgcaggcttcgagcctatggttgctataatagtgggaagagcactaatcttgtttatcaatggattccttctctaatactacctccatttataaatatatgacaccgttgacttttaaatctacgtttgaccactcgtcttactcaaaaaagttatacaggtatcattaattttgccatgacttgttttatcatcaaatataccttaagcctcacttatatttttatatttgctcgattttttgaataagacgaattgtcaacatatatctaaaagtcaacagcgtcatacatttaaaaacagagggagtacaatactacatccatcccaaggtgtaactatatctagctatgaatctagacaagttcatatccagattcaaagccaaagagagctacattttgggcaggaggttttactacactgcgacctttgtaggttaggagccaaaaagataaatagtaccagaggagtaacaaactatgatactccctccgtcccaaaataaacaaacctagtacaggactaggaagtgccacatccccgtactagctttgtttattttgggacagagggagtacctagcaagctacgagactagccagtagtttcttgtgccactggtactcgatcccataacagttatcactagtccataacaaaccttaaatttaaaagtagcattgctattattaccaatcatactaaactatcaggatacaagagggccagcccacaaacccacttataggccatttaagtgcaccaacctatggtttacccacttgaatagcccataaatgggttcaaaagccagcccacttgcattccaatagaataccaacatatgtgccttccaaatccctgctaaacaaaatcttactaaaccttcttgacttcagaacttggcttggctatctttaaaattatgacatgtggagaataataacactaaaattgaagaaacgtctgtatattctgcccccttaatatgagactgtgggggtaacggcaagttttctgagcttgcctctagatcattcccttatctagaagtgaataacataggaatatcctagtttgttgtagcttgacagtgtccatcgcttgctatcccgctgcccatccatctccatgcatgaaatggttgggtgatgaaatggt

SEQ ID NO: 46480 - DNA, 6398 bp, Oryza sativa
actttcatgtagaaagcatatttttattttgccatttaaatggtctaagtcgcgcttgaaagcaggcttggtttatgggccttcacatgttggcccacttctaaagatatttttcttttgtttatttctgttaacatctttattttaacaagtcaatccaaacttaaaaaaacctaaatatcttttaatatacggggtattacattcctcccccttcaatcgaattcgccctcgaattcgcccactgtagagcttgagaaaccgtaagatggaaaggaatacacaaaacatacatataaagtagttaggactctcaagcaatttcgaggacatctcctatattcgcaacactgcttgcgtctaggtatggtagataataattaactagcataagaaagtatggtagccaacaattcaaaagcagctaataaaccaacttggacctactagacaggaatattggcttgccaaagaagtgcaatgcacatactaaaacacccaattgggacatatacaaaaatcattggaacacatcatgaagaatcttactacaaagcaatgaaacaaattgtgaaaacaacctttacgctcaagggaatcgagaatacaacacaagcttttaatttaaaatttaaagaaataaacactcacacccatcacatcttattagtatgttgctcatcttcaacaactaaaagtctatctttgattgcaaattatttagaggtaataaacaatatctacgaagtcaatctcaaggaccataggccacacttgttccacttataatgaacattctgagtaactagaacgaaagcattatcctcaaaaactgctctgaacatcgatagatcttgaattttctaagaaactcaaacattccaaagtaaatgaattaaatccactcaataaaaaacaatttgttgggtgcatgtaattggaaagaaataatcaaatatggaaggtcaagcaacaaaacaaacacataaaaaaatgaatatttagtctcaaacacggttttcttaagaaatctgagatcaggataatgacaatctgtaataaattcaagaatcacacgtaaagacaatggaaatatttagaacatggaccgagtataaaaccactttttgaagaaaatgcgtagaacgaagcatccttttcaacttgatttttttaaaaaaaaacaaaaaggaaatatttttttaccataaactcataaccaaaattcaaagttttggagtttgtttgtcaactcaaatagcgaatccgaaagccattctataaaaaaattcaaataaagattaataatcaaataagtgtggacatcaatccaagaatatcaatactgcacacagttctgagccatgtaatgaaaataaatcacttggtaaagaaattcaaatttaatacaagttctccataacaagatttaaattagtattttcaaatagtattgtgcatatcaataatttataatttatcagtacaaagcaatcgcacaacacttatgtttgaacaaccaagcgaatgaaagccacaaaagtgaaactaaaataaatatttagtgttaattcctttctgaaagtaaaaaaaaatagaaatcaggagaatatttgtcaccaagtgatgaatgcagagtcaaatgttttccttttggaattatttcagaacgtgtaccacgaatgagaaagtttttttttttcattacctcaaccatagtcacataatagaactcacaaaaagaaactaataagccatatcgcctttgaatctcaagtctgaaaaatggaacatcctttttttttcttactttttttctttgcttttcgggtgaagacatcactaccttggtgcatcatgcataacatgtagacacatctcaccactgtaagaaaagaatagaatgagtagatgacatgggggccaatccatcccatacccaaactattaactcggtacagtgatagatgtatcacgacctaacactcacactcggacaacctcacttggcattgggaaaaaaaataaagaaaaagtcccctcctctaaccactttgcattgcctatacggaagaaaagttacctattcttaaaggaccattgagtcttataggatacaacattaattacttctataaaagagattaacacaagttagagccatgatcaaactagtttaactaaggtctagggaaactaaaactttatcatgtacactcacacacctcaagtataactgtaacaccccatgttgttctccctaatagctttccgaatatagttatgcgcaaacgttaatctccacactatacaccacaccaacgaatcaaaactgaataatttttttatacctcctagctttacttattatgcaatcaggtcttattcgtagaagagcatatatatatatatatatatatatatatatatatatatatatagtaacaacataactccagaaatcacaaatacaatgagatagagatcagtaatcgataaaataaatcagaagtgtgatgcaaagaatgacccaaacccatcctactgtgcaccagtgtgtcaaattttattggtttaaatttaactcaaattttacttctatttttcccatcctaaggaaaacatgatcaatattttaagttgtcatatttacttcccatggacctactgcccactcacataccaattgtaacacaccagataaccacgtaccaagagtgccacaccaaaaaccactcaaaccactaacttccaaaattattagaaattacggcagagtctcccctgtaaatacggacatccacgacagacaattataagttaaactaataacaatatcattcccacaatacgatccatccttataatccatggggaagaaaatattagaaatctaaaagattattacaagaccaaaccaggatataatttaagtgtcattttgaacctgagcctgtcgaacaaccttgtgtgatgtactctgacggctcatggtcgcacaagggggcgggcgccgcggcagtactcacttcgccaggtggcgtgccaattcgatatgccacaaggctgcagttcgacacgatcaacaacacgacagagtatgacgctgtactgatgggcctaagaaaagcgaaagcattgggggttcggcgcttgcttatccgaacagactccaaactggtggcaagccacgttgacaagtcttttgtcacgcctagaaatttagcccaaatttctagactattttgtgtattaaattcctgtccaggaccagccagggtacacaaaacgacaagtaaaatatagttccaaacataaataaaagcgtaaaatacttacagaagaagtggggtcgctgggcccacctgtcggggagggagagagggaggagaacccagggggttatttagactttgcgcgaggggaaggggaaacgggccgaggcgagagaggaagagagggggcgtgggccgtgggaggaggaagggacctggggccgaaaatggcccaaggaggaaggggaggttttatttgcttttctttttatttaattttattaaatgatctttgtgactttaaaattatttcttgagctccgaaaattcgcgggaaatttcagagagttcattagggcacagagaatattacaaaatatttccggccaaatgatttttaaggaaaatttcaaattctcccattatttcactttattaaattgctttaacttttattaaaaatctagaaaatgcattatttaatgggttttaatcccgaacgaaaatcggggcgttacatcttttgaggcaaaggaagaaggcatgaagaggtatctggaggctgttcgatctatggaaaagtgtttcgccgcataacggtcgaacacttacctagaggccagaacgaggagccagacaccctggcgaaatccgctgcttgcggaggaccacattcgccaggcatattttttgaagtcttgtacgaccaagtgtgcccacagagagcctggacatcatggcaattgaccaggcagaactgggcgaagacccagaagactggcgaacaccgttcgtgaagtacctcaagaatggttggctcctagaggatgaagtagaagcgaagcgcctacagctcagagccacaagatacaaactcagggcagttgtatcgctctggggtgctccaacgcttgcttcgctgcatatcctttgctaaaggcgaggaaatagcgaaagaaatacactaggggctgtgcagtgcgcatcaagccgcaagaacggttgcctccaaagttttttgccagagtgtatattggcccactgtgctaaaagtttgtgtgtgtcacgaccgaaaataacccaacgggtgttccttacgtgagtgcattattccttgtcccaggaggcaaggtacaccaaaagttgatacagttcagagttcaacaagcggaagcgtaaatagttaatttattacatgggcggcgaaggcccagcacacacaaagacaaacgggaaacagcagaagactagggcgacgaccacaggcgcttgacggtaggcacgagctagacaccaaagccttcatcttccagggactcctcttctgggtttgggaaaaattgagcaagactgagtacaaccaccgtactcaacaatacacacccataagtgcagaataaatgaaagggagtacaagggggttataatataaagggttagggtttgcagtaaacagcattaaaagacacttagttgctcgaagctattttgtaaacacgattctagagctatacaatattattaatcaaggccgtggacccacacgaacctgccttaacccaaggcctacgatgattcagaccgaactggcaacccgaccctgggtcccagctcgtcccaagccaacccaggccaattattccacattttagttgttaagcaggttttaagaattaaaacactaacttgggtacattgctcggcttgcccataaccgagggcgcggcaattcgaatagattgtactctgatcagaggtgtacatctttacccacaagacacatcttcctcacgtgtaaccacgtgccgcagaccaccacggtatacggacggaagacgtgacatagtttccaacccatcctagccatagacaagaataccgacccaaccccacctacggctggaacccctgggacaggtaggcaggactgagccccgagcagcaggacaccggccctgtgccatgacatctcgactaccgggccacagctcatgtagccttcatttgtcctagagatgtccatcgatccccgacttcgtccatctccatctgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcgtaaaaccattttggggattttgaatagagggggaggtgtgaatccaattccacaataatccaacaattccatagtgtccaggtgataagagtattcccaaggtctagagttgtaaaaccacctaatgttgcctaattaaccagtgaagcatctacctaaaatcatactagtggtaccatgagtagagtgtccactagttggggttttgtttaatctagggtgaacaaggtaataataacaataacaataataataaggtcataataaaggtaaataggcatggctaaataaaacagtgataacgcgggaatttaaataaagcggtaatgcaataatttaaatcaaaataattttataaactgggattcaatatgttcaaggacgatgtgacttgccttgctcgctttcccaaacgtcggcttcaacctccacgaagagcggatctttcgaagctgcagcgtctacacgaccaacagaaaagaaaaggactttactctaataaactccatataacaagcagaaacaaagcacaaaaatgggttcttgacttcttaaggaaaaattagagacttgaacggtccaattccgagttcaaatggccaagttatagtcatttgaagtttatatgctctttaaatgaatatttgcgaatttcttcatttaaattttaatttaaaaagggtttattgcgtcagccgaggggagggggcacgcggaccgggtccacgggagtggggcccacgcggctgacggccgggccccacgcggcagccactcggcgcgcccgagggcggccaagcctgtgcagccggcgggaggcggcgcgcccgcgccccgatggtcgccgccggtgaccaccggcgcggcggagcggcggccgagagaggggaagggaagggggaaaagaagcggcagtccac

SEQ ID NO: 46481 - DNA, 12184 bp, Oryza sativa
ggatgggccgagccggcccaagagggagagggagggaaaggggacttttcagagtttttctttttataaaatcattttaactttgtttatttcttaataattattatttgtgctctgaaaattccactaaaatttatttacgcattttaggcttttaggaaatatacaaaaatcctctaagccttatttgacttttaactttgcacattttaattgttggaggctttcacacggattttaattattctaggcaccatttagaggatatattttagggtcgttttgggacgtgacagtgtggagcaagccaagaaatgcaaaagctgccagcggcatggccgaagccagacagcaccccagtacgagctgtagcctatcgcagtagtctggccttacgccagatgggggttggacatcattggccctttcccggtggcacgaaatgggtacaagtttgcaattgtagcaattgaatacttctctcgttggatcgaagccgaatcgcttggtgcgatcacttcggcagctgtataaaaatttgtgtggaagaacatcgtttgccatttcggagtgccgaaagaattcatcactgacaatggcaagcagtttgattctgacaagtttagagagatgtgcgaaggcccagacctgcaaatcaagttcgcttctgtcgcacacccacaatcgaacggggcagtcgaatgagcaaatggcaagatccttgaggcgctcaagaagaggcttgaaggggcggtgaagggcaaatggccggacgaaatgttatctgttctttgggcccttcggacgacccccacaaggccaaccaagtttagcctgttcatgctcctttatggtgacgaagcaatgaccccaacagagttagaggctaactcaccaagggtaatgttttctgaaggagaagatgggcgcgaggtgttgctcgaactcctcgaaagggtgagagtcgaagcactagaacacatgcgcaaatatgccaagagcactttggcaccttacaacaaaaaggttcaaccgatagagctgctgcctggctaaggaagaaggcgaacccaatggcggttggaaagcttgaatcgaagtgggaagggccatacctcatcaagaacaggtccaggacgggctcttttcgcttggcgacgctggaaggcgaagagttcgaccactcctggaacgctgcttctcttaagcgtttctatgtctagaaggggtggcaccccattcgccaacttgtaaaaatgtacatactattatgtaggcccttcggcacaaaaatacaaaaaaagaggaaaataaaaaaaggaaaaaaactggatgtagggctattatccatcctggaggcccgaaccagtatataatccatgtgtctttcacctttttacttgtgtaaatgataattcgtggaaaaaccctaaggcaaacacctgataagcgaaagcgccaggggggcgaaatgaatcgaccgaagcatcgctcgctgaacattgaaaccgcaacatcttgtttcgggaaataaataaccgaacacagtcatattcgatctatgtgaaaaacacgagcatttctttagcgcggaatactacagatcgaaaacggaagtaggaagctgaaaagtcagcagacatatttcgctaatatacgcaagggggccgacatatttcgacctaacaaaatcatgaaaggtgactatgcgtacaatagcgaaaaggaaataaaacacatcttcattaacttcgaaaaaaaatataggccatacaacatggtacaggcgaaagaaggtaacgggctttacagcctaacttacaaaaaaattacatctccacccccaaaacaccctccacgccctaaggtatgatctggcgaacttggttcgtcatcactactaatattatacactaccctaagaggagaagggggcgagacataaactagaccgtaacggcgttgggcgatcgcttcctgacgatcagtcctccgatgatttcaccaaaagcgagccatgtcctcccgatgctccacatggacacggtcgtagtcgtccatggttcgcccggggtgtgcccgcatccagctggaaactttcaaaaccttgtaactattgccatttattatcatctcgcaacatgaatacttaaatttcagcaagccttcaactgtgatgaatttctcattctttttacgccaatctctgaaaggaagccgaacacacaatttctagtgaagaccctgctaaaacaacataaaaaggggcaaatgggaaagcacaaggttaagagagggcgaagctcataaagcgggcaaaaagtgtagcccctattcgtgtacaaaatgatgcaaccatacatatcaaagccctaaaaacgggataattggcgaaacttggttcatctattccatataaaaaaggccattttcggctacagtacaaaagggggaaacatcggccaaatttacatcgttcgccttccgtggccaacgcaaaaaatctaaaaatctaaagagcgggcggagggcctcacacctctgggtgattatggccgatgtctaccccagcgcccgcatctgccccacctccttcgcccgctgcctcctcgccttgatccgccgcctctgcctttgccaagtgctcgagcaggcgcgccttggcagtagatcagccgtccatttgccagaattgtttgcgccaagcacgaagtgcggccgaaagatcctgacaactgacttcccaatcccccttcaccaacttggggaactcggcgatatgctcgcacccattttgttgtagcaggcccatggtaaaggccgctaacacacgcgcgtagcaatcgccgtatgcagtggtgcaatcagagaccacaccactggcctattgagtccactccgagaagtcaaaggcagaagcatcttcgtcggggactcctcgcaccttcgcccacatgtcggtaagggcaaggcaaagcgtgcggcacacggtctttgcggacttagtggtcttcaccatctcccgcgcgaaccgttgtgcgtctctcttagcggctgcttctaccttgctgacctcctgacgaagagcctccatcttcggctcggtaaggttatagtaatcagtcaaggcggtggactaatctcgttcttttttaagctcagccttgaggcgctcgatctcggccttcgctcgctccccttctccagctcaacttggagctgcttattctcagtcttcgtctccttaagggtgttggctaggttttccatttctagccccttgcggcccagttcttcatccttagcccgaagacgacttttaaagctgtcaaggcgagccctcacggttcgctcggtcgaacaatgagctgcgggtatctaaaaaaaagggggggctaaaatgaagaaaattagcataagttgtggaaaagcaacatttaaagcgggcgaacgacatacccagacggctaagcttttgacagcggtacagccctcgttgaactcgttcaactcagtgaacaggctcggacttccagccggagaaacgagatgacttaccccctcgatgaagggggtaagatccacccgggtctcgaaatcccaagggacgaagcagggcgccgtgagcgaatactctgaagccgacgtctcaacggccgccttcttcccgttttggatggccagcggtgaagtaggtggactgtgcggagggctcccgaagagcctggcagcagccttcacaacccggtcagcagaacctgaagtaccagctgcagcgctccctcccgcttcgcccgtgtcggtcgcagcatcgggagcggtcgaaagatcttggctccacccagcggccgaagtagaggtctcatccgaagactcgtcatcactgaaaacacaggcgacatcgacgaaccccttttttttggaggttttcttaactggccctcccttcaccaccttgcccgccgcaatcgaaaccaatgcctttgccctatgcaaatccttccggcgaaggggggagctgttcgactccaccccagttacgacgtggtctgggcttggggttggggtgtagccgtgcgtctcggtgcggttgtcggcgggctcattcgcggccggttcgaccgcaactttcgcctcctcctcatcctccccctcctcttcatcgtactggtcatcgacagtgtcctcatcgtcggcatcagagtcagtggaggcaggggcctttcgcttctgaggggccgattttgcttgctcgcgtttgcgcttcttcgaggtcccttcatcaccatcggccttggagggcttctcccgagaggggagatcgccatcatgcacacgattcgctcggccagccgccttccgtgtaagcagctggctgtattctgtgatcgacacatcgccgaccatcttccgagcttcggtttcagcctgaacaagagttagcactgcaaaaatgaaacgtctcatcatactggccgcaaagcagggaaaaaagagcgaaatgcaactgcatgtgggaaagcaaaagcctacctttcgccccctttggcatgacgagcttcggtaggccatcgacctcctcgtcctggttcacctcgacttgccatgactaggagagaggaaagatccgaagcatgcaaaactcttccaccaggtcacggcagctaaggtggaggcagaccttgcgaagcagggcgaaatgggcttccatagctccatcagtggcaaccctgggtttcctgtttggcacgatcgccctgcaccgccatcggagagctttcgccgcgtcggacctggcctcgaaggggatggagtggtataatcacttcgacatcagtggcaatcccacttggacatagaagcgctgtaatgccctgatattcgtttgggattaaaaatcgtttaataatgcattttctagaaattaaataaaagttcaagcaaatttaatcaagtgaattattgggagaattaaaattttccctcaaaaatcattggccgagaatattttacaatattctttgcgccctaaaataccctccggattttttcgtgaatttttggagctcaagaaataattttaaagtcatgaagttcattaaaataatttaaataaaaagaaaacaaattaaaaacctcctctctccctttgggccgctcccggcccaatccccctttccctcccgcggcccgtgcccctctctcccttcctcggccggcctcccctctcctctcttgggccgttggcccgtttccccttctcctcgcgcaaagtctaaataaccccctgaatcccctccccctttcgccgacaggtgggcccgaagaccccacttgtcaggtccatccccttcctctcgccggccacaaccgccgccatggccatccgttgccgcccacgtcgccctcgatttcggcctctcccgctcgcaccctcgcgccataaccgagtgaaatcggtccccctccacgtcctccaccatctccacgactttcccccaaaaaaagggcgcctgtttgacctccccacgaactccacgtcaccgcccactccatcgcttcccgccggcgagcgctgcttcgcccggccacgtctctgctccatttcccccttccaccacgaaaaccccctcctcaccgtgccaccctagcgccgtcgtcgccctctaactccggcggtcgtgcgtcgacgttccgggcctccttaggcctcgggcccctcctcctcagctccgcaatctcaagggaaggcctggcatcccctcatcaaagctcttcgtcgccagcatccattccccgctgtgagaggtgagcttctcccctcgttgccggcttccggctgagttttcacgtcgcctcgcgcctcctcccttttccctaacccttccaccgcgctccccaggtcgccatcctccacctcgcgtccgcggtacgccgtcggaccgccaccgccgcccgttgccctcgccaccttggcgcatggtgagtgctccctcctcctacccttttccccctccgctgcctcccgtgtccggtgccgcgtcgcgccaccatcgtcagcggccgtctggctggcgagccagccagcctcccccctcccttgccgattgggggtgccgcccgtggaccgcccgtggtcctggtccacggcgcacccgaggccgcggtggacgcggtccaccgtgtgcctgccccttgacccgctgacgtgtggggcccgcctgtcggcgccggcctcttagatgacgtcagcgcttaatcttttcctttgagaaaataattaattattgcgcaataattcgataataattctagaaattcatttaaatggctcaaaacttctaaaattcatatctaattcatccgaactccgaattcggccattcaacttgcaattttcatctaaaattgagatctacatgtttgtttactttttatgtactgtttccatagtttttattagagtttttcctcgttttgcgtgccagcgtgtagaatccgtcgtttcggaagtccacagtcacaaggaaaagagtttggaagattgtttgaagaagcaaggcaagtaacacattccccttgagcatgttgatcccaatttataaatgttttgccgtttgcaaataaatatgcatgttttgctaattacatgggatcagggtttacctatctgcctgcttgtgccatgtttacttgatatctgttctttgtcaaccgtgggtgataattcgactagcttgtgttacttatgttaacctagctataactatattcttagccatgcttaattgtcactagctcagttgatgggataattatagttttagacctgttagtatcaagacgagctgcttgctcgagacatctggccatgtttcatggtcataattatccaactaaaatgcgactgaatggtgggctgtgggtgcatggttttgctagtcgcacccatggcaattaaggaccggttcacgggaaaccctggaagacttatagtgcttaccacaagcgagagtgggtaactgcttgatctaaagtataactcgaccctttcctaggcaccagtggcgagggtgggcatgatggagttgggtcggctggggtatccggttgtccagctgccggattcaccgcggcgcacgaggggactgcctacctccgggatagggggtgggggtgaaaccttagcgtggtgtggatggttaggggagggttatgcggagggtcttatcacaatcactcgacatggtgacgtatctgcgcggacgcggtgacatgccggtagattgtgtcttgtgggtacagttgtgcacctctggccagagtaaaactattcgaatagccgtgcccgcggttatgggcgattgaccagattcaccgtgattagtcttacacttaataaatcaacccaatgcactgtagttcatgtgggttggttgggcctgttcaacgtggtgtagtgttgatcagtggagatttaatattaccttaattattcaacagttttactgttttgctcaacaaaatgttttacaactgcctttatgcaaatagccacaaatcatccttgcgttccccttgcacgtctgcatcattggtgtggcttgctgagtacggtggttgtactcagccttgctattattcccccttttaagaagtgtatagcttctgagccgaagacgaagttagaagaccaaggctcagacaccagttgagttttgcctgtggagtggagctgaagccccgctagtatcgctttttccgctgctactgctttcttttcggtgtgaggactaagtgcctcttctataagtattttacgctttatttacatttggaactgtaaattacttgtcgttttgtgtaccctggctggtcctgtacagggatttaatacacaaaatagtctggaaatttgtgctaaatatctaggcgtgacaagcgttaaccggccagagatcggagcgctcgggacgaacattgaagtttgttaacagtgaaatttgttaatcgacaaagacgtcattggcttagaatcattatcggctgcagcatctgctcgggacgaacattgaagttctgttaatagtgaaatttggtaatcggcaaagacatcatcggctgcagcatctcggaatcagtcgatgagagttatcaagtcgccaatagtcgcattcctgctatattcggttaaggaaatcaatctactaaaggaagcttatctctaagtgaccgagtttaaagaggatgcggcatggcagtttatctattaattaggaatagtttgttagtttccttttatctttaggaaggtgtgtttagtgtccgataaggactttatgttttccttttacctttaggttagtttctttcttgtccgacaaggacttgtatcaacccatgggtataaatatgtacacccgggctctatgtaatctatcgtcacgatcaatacaattcggcgcatcgccaccttttatcttttctactttattttatcgtccggcgggacttgacacctgatgcggggctgcatcggtgttcgatctccggcgaaggggtaagtccaatgttccgtcgccccaggcaattgtatcgtttacgtcggcgtcgttcaaggctgcatcagtacattcgacctcttggattgctctagtttggatgatatatttgcctacctatttattatgtctctgttaatctagtcttagcatatcaatttagctctatcggctgtctctcgctttagggtttctgccggtatcggctaaatcgcgttgctagattagattagcctaggcatctaccaccctgaaaatcagtcaacggcttgattgtctagatattgtgtttcttttcatacctagtgctgcatcagttaagtttgatctactaagtcgtgcttagaaccataatctctagcctgcttcttgattgccaataagggtttcatcggggtttcagctggtgagttatttgaacgttgcatcggctcataaggattgcatatacatataagttggatttagccgatgacaataaaggtttcactgtttaatctaatcttgtggatttcatgacatcggaccaccagccgatgtgtgctttaactttcggatcaatacttgttctactatatcatattgttagccgattggtttctactggattatattgctatattacatcatcatcagccgattgcctttatatcattatctaaattggacatatagccgattgcttaaaccctatcgctatctgctggtatcagcatcgtctattatcggctatcggctagaactactctatcggcttgtcagccgatcggctgttttgatctactatttgcatatcttgtcagttgcaggatcaaactgactggcacgcccgcatctcatcatatttggacctgcactggagctaagcagatctcccaggccgatgtgttcgattttctcatcaacaagatcacgctcccgaaccctgttttcttcgtccctgctggggtgaccacagtctttgagtttacagtggcgtagaaaatggtgccgaaaagctcgacgctcgattcaaacccagtagttcggcacgcccagtcaatcatgctaccagcaacgattcaagccaaatacgtcaagtgtacttaggtgaagcctccatgacgaaggctacggaacgaagacgacgaaggccagaaagccgcgtgggtacctcgtaggaccagccatgtgaggcgaagggtgtagacttcaccttgacaagctcgataccgaggaggtccaataggtcatccggtgcacggcgaagggtatgggccgaaggaaggagtcttcgcctcgacgagctcggcatcaagcaagcccaatgggccatcctggcctcttaggcctattcaccaataagctaacattcgccagtcggctcatggaaggcccatgtatccaaattacactgtgtacccacataaatgtccctttcataagggcaaccgtgtaaattcccctgtaaaacctaaaccctaatgcgggaacctgtaataggattataaatagccccctagggccatgtaaagggggatcccaagaaaaattttaatcaattagtatatttactatttccaatactgttgagtaaccacgtccttcgacgtacgcggttgtcacttcgacaacattatttgtgtgccgagaagaaaatcaagccacaagaattaaattggtgggtagattaaaagaaaggatttgaatatttggatcaagaatcaaaggataggttaacaaataattccaataacatcggaattgcaagggtttggtttgaaggattttccttggaccacaatttataaaataaaaagggtttacaaactaaatttgaataaaatgaattttgccaaaagaaggttttaaattaaaaccaaatcaggaaatatcccaagataaattttaaaggagaaccacaaaagaaatacaagagattttatgcaagtcagtttttaggaggtctctctaattatattttcatatgtttagaaggttaataagaacgtaagaaccggcatgatgcataattagaaaatagctaatttttagtacgttacacccagccaacttggccgactcagtctccatccaaccgagccgctgcatgctgcgtgttgcacagaacgcactcatttctcaatttctcactccaatctccttcgtgaacaccggcacttacacgcacacctcgtgaagcccgttgtgaagatctctctcatacaatgtctatccaccgtgtgccatctgtatccaacttcgtcacccggtatccttgaccatctggacctcaactcttccctgagtctagtctcgatccccaccgttgaccgaagttgacctccaagaatcctgactctagtcaccttgtcacatggtatcccgaccgcactagacctcttctcctccctgagcatattcccggtcctcaccattgactaatgctgatctcaagtcacctgcacacaatcagacaaaacaactgttcctgggcacatatatcacaacctgacccacattaatcacacacactcacatcaacatccacacatcttttcattgattaaattattttacaaagccaattgttcatcacaaatattaattatgacaatgatttcacatttgggagatcaaccaatgaatagtataacaagatgatgaatagtgaaagaggaaaagggtgagcaagggtgatggatagagaatggataaataaggaatatttagaccaatggattttttttggggattttatacccttctggcttctggttgaaatacctagagtattcatagaaaaaacaaaatagagtcctaagaatccaataaatattccacactttgagtgatcgagagaatcaattgaggagcaaagcaaagttataattttgtgttacttaaaaaaaaccccaagttgttcttcatgaaaagttagggtgacttgagtcaagattgttccatttctcaattgctcaggatcgcatggtagacactacaaagacccacaagtacatgtatggctttgaataatttgtttgcataattattagtaaggaagtcataaccctattgtagagtccatagccttcactcgggacgagcaaaggttaagtgtgggggtgttgttgatggtccttaaatcataatatttgatcgtcaatacttacataaaataaaattaaattatggtatccaacttagtggtagggattattactaatcatttccactagtattggtgaaatatgtgtatgcaagtattttgagaagaaaaaacatccgtcaaatgacaaactgcacctccgcgcattcaggacacatttacacatattggaggccctataagtcaattaaacaactctaaatgggcccaaccatcatgccaatgggctgagggcctcaaaattagtgtccacgaggaaaaatgggctgaacagagccgtcccgggttcggccgaacccttttggtggccgttgatctccaaattttacatggacggccttgatcacattctaatggcggttccggggtagtttgctcatttcgcatacgctgtaaccgtcatacctgcctataaaagaaggagctcactttcatctcccacacacaacttgagctgaattataagaggctctat

SEQ ID NO: 46482 - DNA, 2570 bp, Oryza sativa
cagaactgacatgatgaattgggccaaaattcacaagtctgtggagtggagcaatagaggaggccaccagccgaaattgggctagattcggccgaaccaatcctggcgccgttggatccaggttttggaatagacgtccaagattgcatcccaatgacggttggagggcacttcggacaattccccttccacaaccgtcataactacctttatataaggagctcactctcttcacttcaacacacacctcaagcaagagctctctcattcctctcaagtttagtttagtagtatctagctggtggaatagaattagaataggaatcacgagtcctgaagtctcagaagagtttgggtatggctctagcagctttcctttcctcttttgtaagctttgtacttttattagaatactcttctatatagatttatggtattgaaatactttctgagtatatgagtacctactttacattatgttcatgttatactgaatatacggctagcttatctaggagatgctttggtgcgggtatagtgtttgttatgcaattactctatgtcatgacgatgatattagagtagtatctgatagtttagacttggtgtctagattacgggatatcatatttggggttatatattgcggatgagaggtgggccgctgatggtgacagctcagtatggtattcctccgcgcctatatataatcctaagttaatttcctgaggagcgtattcctccgtatttagccccggttgtatggtcatgacgggctatcgtaaggaactcggcagtcaggggtggcttctcgaagtaccaggagggcatcggatagagggtattagctagtataccagttaactagaatgtatgtatactatgtatattagaagtataggaatagatttccttcctcttttctttccacttagcctatatgatatattatgaggacgagtagttaatgcttgtgtgtcactctacccttagattatcttaacccctacttagaatatgattctcacaagtaatatataaattattagttgagttctctctacatgatcttctcacggaataaaataaatacgataccttgaaatactctcggtgaaatgctacaatggtatatccgtgcatttgcggatgaactctgtaaccataatataccagaagtatttctgcactattgctgggaattatatttctagtaatgtcgttaagaaataccaacaaaagacttatacttactgcacaaggtgatttagcaattaatggatgctatacttaccaagtattaaggaggtacttcctgactaatgagagagagatggtaggtgagaagaagctgaccacattgtgtgtatttatccctccatttaaatattctttcttttctcttttcttggtatccatggaatgtaatggaatgtagcatgcatgaccatttcagaaaacactatcattttgcaacgtcatttttttacatatctttgcaaaatgatattttcattgtgttacatttttggcatcaacaaacaatagtgaacatttttttctctgtagattataataaaattattttttggaatgtagcataaatatgtaaaataacaatcatgtgtttttatttaatatatgcctagtgatatatcattttttacaatgtcattttttggacaccaatattgcaaactgatacttctgaattgtcaacaaactgtagtccacattattttctctgtagattataacaagattatattttggaatgtagcatatatatgtaaaaataacagtcatgtgttttttatttcaatatatgccaagtcatatatcatttttacaatgtcatttttggacatcagttttgcgaaatgcatttttgaaattccattatttttgcaaatattgtattcgcatggtgagtggagaatcatcttgatatattatgtcccaataaaaccaaacttagattaaatttcaaaaaatacaaaacaagttgtttagattaactttaaaaaaatcaacatacctaatatctaatcgcgtggagtaatctgaatgttgccaatgaatctaactaagaaaagagtcagttcaccgctctccataggttacctagatacggggaaacggatacgtgatacgtggatatattatttttgaacaaataaggacacgtggatacgtctatatatataaaaaataaaaaaatacatattataaataagggcaaagttagtgtaaaagaatagaaaatcagcacaagttagagtatcgactgtggtggtaggttagtttgatgaagaaaatcaacagaacttaatggtcaaatagagctggaatttactttctgtcagaaaaaaaaaaactcacaggccaaagctgtctcctcgaacatctcacgaatatgcagtggcatgaattggagtgttcaatgcagcagtactactcatatcaacagtacctactatatgatgtgcctatatagcaacttcaccgggaggttcatctttgatggtcattactgacactatggaacacggttgcgaggtgcatatgaa

SEQ ID NO: 46483 - DNA, 6374 bp, Oryza sativa
cctagaatcaaaatctaacaaaaacaagttcaaattcagttcaacttgctttaaactagttagtaaagtagttaatacctaagtaattgaaaaagtttcatactcatttgaattgggtatatactcaatttcaacaatggtgcccgggcaccatggagcaccaaacaaatttaatatatatatatatatatatatatatatatatatatatatatatatatatatatatatatatatatatatatatatatatatatatatatatatatatatatgtattaaagtagttaacgttaatacctaaatatttgaaaaagtttcatactcatttgaattgggtatatagtaaatttcaatcatggtgcccgggcaccatggagcaccaaacaaatttaatatatatatatatatatatatatattatatatatatatatatgccattatgtactcccgggagtacatactccctccccagtattggatcacccgatggatccaataggacctgttgaactggattggaaaaactgccgtgtaaaaataaataaatatttaatttgaaaaaaaaaaccatgaatgtaggcgcattggatcggctagaatttagcggggttcaaattttgaaattaccggccacactccaatcaacgtgcagtatatttcctagctaagtatatgctgttattttctacacgaaagtatatactgttttttttgtaagaaacggtatgtactgattttctacacgaaagtttatattctttttcttgcagtatattcctatataagtatatgctgccatttcaaaataaaagtatgtactgtttttagtaagcaaaggtatatactgttttttattagtagtagcagtttataggcagctgccatatacttctttttcatgtatagaaatatatacggataaatatcccacatacgtgttttttatgacaatatatacttctttttctttacttagtactgtgcttcaccaacctagtataagtactgtgctacagttaagtccagtatatacagtactgtgcttcagttaagtccagtatatactatttcttaggtggtagcaatatatatactcttctttttaaggtggtagatatacctttctttaaggtgcaagtatatactattcttaagataattgcagtatataccatttttaacagtagcagtactcagtgttagtagcagtatatatgctatttttattacttgcttttaccctgccgcagaactcagtgttcgagctgcatgcacgtaatgatgatccaaaagtttcgtatattctcaaagatatatagttccaatagaactagcctcacagacatgagaacatgttcaagaacatgaattgaagtatatgctgaatttctgattgaaaaagaatgtacatccaaatcgcagtttgtaaaaactaggatccttccccttgcgcgtatatatatatatatatatatatatactatctccgctggtgccgttggattgcggcgttgagtcgacatgttctgccgacggccggccggataccatctgcaagcaacaaaaagattaggggcttattcattcagggaactaaacaaatccatccaaaccaccatccagtatgtgcagtatgtgcagtacagcagtagccaagaaatgaaggagatgcacacattcactcatttagtaacaacttgcctacattttgcataagctagattgagatattagactccactgataagaatacacatctaaaacaaaaggcatacttattcaagcagtatatataggacatattttcagcaaagcgcccgtaccccattgacccagaattattagacaaactaacctgggcgtcatatactgatttcttcttacataggtcacatactgaattagaaatacactcgagatgttagcatgcaccgccatcttcagggatctgattggagttgatggttgtgggcatgttaattatcgcagtatcgtcagcctactgaatgtttgtacctgtgtaacgaaacaaaattagtatttttcattctgaactctaggattaatttttatctacatacgtacagagattaaaaggaagatggataagaaatagtgtatactcatctaactgtggatttgtgattcagaatttcatatataaactaaaaacagtacacaccaacaaaaattagaaagaacccctccattaaaaaaaatgagtatatactatcgtctaacaaagttcagtagaaagctccccatataaaaattcagtatatactatcgtctaacaaagagttcagtaagaaccctgccatagaaaaattcagtacataataacgtttaacagagttcagtaagtatccctccaaagaaacaatgagtatataccgtggaaaattcagtacatactaccatctatatttttttttggggggggggggggggctaaaacagcatttactatatccacccaaaaaaccatcatatgcactaaaggggaaatttagcatctgaaactgagagcgtacatgaaccgaactacacataatccctctctacaggcatacatatattcaatttcagccgactccagatcgattacttctgcttcagaaacataggctattgagagaggagccatcgctggaggaaggggacgagtcttcactggaggaaggaacgagctgctatctctgtaccgccgccagccaccccagtcgccgctgaatcactggtccgtcgccgcgccgccccccaaaaccccaattttcgggataagcagttcggcctcttacgagcaaaccccaaatttcgggataagcagttcggttttttaattagaaaaactaatcggatccaccgaggcaaacccgttatgatgagggagggagtataacatatctaatcgatcagatgaacggtggatgggagggggagtacgtactccctaggagtatagatccattttcatatatatatatatatatatatatatatatatatatatatatatatatatatatatatatatatataactactatacagcaccctaaggtgctacgtattaaacagcacctgatacagcctccagccccacccacccacgctcccaccaggtctatagtacgtagttaaaatttaactcaccgacgaccaatcttgatcccacccctgcgccccctcccctcactcctatagtccgagtaaattttttacttcatgctatccaacttcttagtagttctatatatatagttaaaatttaactcatcgacgatcaatctcaatcctacccctgcacccctacccccactccaataatccgagtaaatttttaactcgcgcaccaccaagagccacacccaccccaccctgtcaacgctcctacccaaacgatagtaatttttttactcacaccaatagttctatttataccatccataaccatctcaccgtatccaaacccccattcatactcccgtcctcttccatttttttcggatctgagaaattggggatagagcggcgacggtcgatgggtgactggtctgctcgtcggggcgatggctggaggctgagctccgagtggtggcgaggagatccatcggtgaggggtggtgtcgtcatgcatccaggtaggagagggcgattggcgtcgggctgccctcctcttgaaggtgcccaatctgaaggccggcgccggtggtcattcttctttggagcccgtgagggtggcggcggccggctacgtcgtccatggcgtgcctcatggtcggttcagggagcacgcgagtaggtggccagcggcagtggtggccctgaaacaacgttcaagccggaaaggaggggaaggttgctttccaccttgtgcggcggcaacggtcttcaggcccggcgactagcttccaggccagcgtcgatgcgtatagggcaggagaccgatgtagacgttggttgctgcgccggatctggagggagcctagcgcatgcaccaccaccacgtacagcgtgcttctcgggtcatccgcatctctgttgtttctatcctcccgtggacgggggtttcgtttcatttttttctctttgttggttctgtagtttgttatgcacgggggattttttgtacgattgatatgcatatgattgattgtaatactccataatctaatattgactgtatgtgtcaaaatatgcgccataaaaggatagcgatactagtattttgatggcttaaaaattttcactcactttttttacggacagattgagtaagtatattactatgaacacactgagagtgatgtttaaaatatatggaagtaaaaacattactaaccctgataagtattatagggaaaaatatgtagtgcaaaccctatatataatgcaaacgtagaaaataccgttggatcgaaaaatagacgcccgatattcgtccatgtcaatatgagttaaaattttactcgcaaactgtgcagcaaaagaatccttgtgagttaataaattgctctggatattacgtttacagaagaaatattgattagttaaaaatttactatcatataccgaacaaaaatacccattagtaaagatttcaccaacggcaagaagattttttcactggaaggatcgcctgtcacgtgtatatttcatttaaacgtaccacggcaatcaacccctatgagtaattttttaacttcaattacgcccgctccaagtcaaatctcataatgagtaatttttttactcagttgtctgttgcgggggggggcagggtggtcgataatcacgtgtttctctcataaaccaaccactgtaactgatttgccccacggtaatttttttactctgtttgcacctgcaggatggggatggggtggcgggtctgtgctggggatgcgggctctcgctgagtggcgccacggtttagctggcgcgcatcgcctgtctcgccatgtataccttgataaaactaccatttatatatatactggttaaacaacgtaattttttcactgaggcagagacgtcgatttctttcctaagaaggcacaataattcttttactctgtgttcaggaggacaactcaattagaactgagaatagatgacagagatgagtaattttttaactctctataggagcggtgcaccacaggggagagaagtggaaagctgcaggtggacccaaaaaaccggaaaatcagggccggccacgattaaaatatcatcaaataacctttaaattaaaattttactcatcacaaaacactctatgttcaaacttactgcaccgatgtctatgggttattttttaactctaacctaagagtgtacgataacttgaaactacactacaagtgaaattttaacaagaaatattccatatgtggatttatttcacgagtaaattttttactcaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaatttaagtccctggatctaaacaccacctcaatctacatgcaggcaggggatggggaacgtggcagggggcggttagaagcgctagaaaattcgctggcaaaaaaaacggaaaacaaggacaggacgggcggaggcgcgccaggaaattggtggcgcgtgtgaccccatcccgccggtcaaacccacgtcaaacacgcacattcactccctccccgccaaccactttgatgttcacgtctcgcaggaattccgcagtaacatgacggtcatcgtgcagtaacaggataactttctcgcagtaacaacatcgaaaattagtcatgatatatctagttttgttaagcacttttttacaaacatcatggtacagacagattagaaaaatactatataatgtgagagatattgccctctaaagattgagatctacttttttttaagttctcgtctatctagaacggcgtagtaatgggacaatcaatgtgcggtaacacgactactttccacagtaataacattataaaagaatttttgtctcgatcatcatatagtaacaggactattgtctcgctgtaacgtcgttttaaagtattatggtgaaaacggttctaaaaaacaatatatgatgtga

SEQ ID NO: 46484 - DNA, 1740 bp, Oryza sativa
  unsure (1)..(1740): unsure at all n locations
tatgtatctttgcatatatgtatctttgtccatacatagtatctttgctaaaagatactatgcatggtcacaagttaacacaagtgctaaaagtgtttttctttgtctatacaaatatacatagatacatagtagcaagcttagtacaggtaaacttttataattctaatatttaaacaataatatctctcacatcacatattatttattattttttagaaccgttttgactcactcaaatagaaatatcatttggagtgagagtcatattagtatctgaggggtaaattgagaaaaataataatttagggtgttaagtacatctaagaaatagtttaagtagtaaaaactgcatttaactagggtgttaagtacattgaagattgttgtatgatggctcattccttggcaacaactaacactgttgttccttggcattactcggctggacttgtctgatgtaatgccatgtgatcggaattcaaatgctggaattaaccgtgaaagagatggaaagaaatgctaccctgttagggttgcctgttgtatatcagttggaaggaagtgaacttcatttttcattaaatcctccaagcgatatctaagcaattactacttttaattactagatatctctccaagcaatctctaagcaattactacttttaattaccagacatgacgtctggtaattaaaagtagtaattgcttagagattgcttggaggatttaatgnaaaaatangaggttcacttccttccaactgatatacgacgaaccagaacatctagttggtaattaaaagtagtaattgcttagagatcgctcggaggatttaatgaaaaatgaagttcacttccttccaactgatatacgacaggcaaccctaaaagtgcagcatttctttccatctctttcacgattaattccagcatttgaattccgatcacatggcattacatcagacaagtccagccgagtaatgccaaggaacaacagtgttagttgttgccaagtgtcgaaacatgaattcggcaataataaaagggggtaacgcacgagacctaaaagtggatggatgcggagacaaggatttagacaggttcaggccctctcaatgagaggtaataccctactcctgtttggggatttgaatccgccgggtgtagtatagatctaacgatcatatatgctcatgcccttagagggccttctgcccaccttatataggatggggagcaggattacaagatagaaaccttaaccaatacggtatcggtttcctaaatctattttacaatattatcaaatcaggactttaggccgctccataatataaaaggaaacgtaataccatgccgtgtgggtatggggtacccataatctccacagtagcccctaagaccttcatgtcttgggtcatataaatgagaaacgcatggagaagcttcatagagatggacttctacactcgtttgattttgaatcatttgagacatgcgaatcttgtttacttggcaaaataacaaaggcacctttcacgggtcaaagtgaaagggcaagtgaactattgagactagtacatactgatgtatgtggaccaatgagctcaactgccagaggtggttttgggtactttattatctttaccgatgactttagtagatatggttatgtctacttaatgaggcatagtctgagtcctttgaaaagttcaaggaatttcataatgaggtacaa

SEQ ID NO: 46485 - DNA, 10368 bp, Oryza sativa
acacaatctgaggtttctcgtcactttttgaatggtcttgacatgtctatttgggagatgaaagttacatcaattcaggagtctgttgatatgtttactttgactttggattcgctttacacaaaactcaaaacacatgagatgaatattatttcttgtaaagttgactctaagtctagtgatttggtttcttccttgacttctttggatgttggtgcttcttcatcgaattactactattcttgctttaattaatgccatgtcgaatgagcaactcgaatagttcgaggaggaggacatggttttggtcattaataagttttctcgagctatgaataatgttaggtacaggaaaagaagtggtccaaatcgatcgttgctttgaatgtggtgctcttgatctcaatcgttcgcattgtcctaagcttaggagaggcaaaaaggaagacaatggtggagagaagactaaggagaacaaagtctaagagcacattcaaggggaagaagaccaaggagaatctcaagaagatgtttgagaaagtctatgccgcttttgagccactaagcgatgtagatggagaaagtgaagatgaagataagggaaagaacatctccggtgtttgcttcatggcacatggtgaatcagattcagagtgtgaagacaatgatgtgagttcttttgaggaagctattcttattttaagtacaaaaaataagaagtgtgagaagatgtatagaaaacaggaatttattattgaatcccttaattctaaaatttatagattaaaatctcttattcctaatgatgatggttgcaaaaattgtgaggttttaatgcatgaaatttcaaaaattagagatgtcaacgttgcacatcatttgaaaaatagatcttgtcttgctcttggttttgtcttgcacacacgtactttggatgagttgtttttaactaaaaagttgttgaaaaaaatatcaaatatcttttcatgctagtttgatgtttaacatggtttgtgctaaaaagttaaaacaacaacaacaaagtgtttttgattgctcaatatgcacactaaacaagatgaaactaaaacatgctttaggtcgtgttgagtacatggaagatgttgtgaaaaccaatgaagtgctttcttgccccaaatgtcgaaaaagcaaaagtgtcatggtagattgtgaaaattgtgctaatttggaaaaataggtttcttatttgaaaagttctttgcaaagattttctgatggtaagaaacaacttaacattattttggatcaatctaaagtgactagctacaataggggtgttcgttttgatgttcatgactttttcaataaaaaatcaacccaatgttttgagtgtgactgaacatggctaaattttgaccaaacctagtgctaagaaaacagttttcaagtctgctggagttatgccctctctttctacaacactaaaataaacaaaaacaaatatttcaaaaccatcttcttctaaagaaaaaggatgcttgttctttttgtggtaaagatggacatcttgttggtttttgttttagattagctcatagatagaaaaagcagagagaaattgcttttgcaaaatcaaagtggcaaaaatctggtgttttctcgaggaaaccggtcagaccgcaatgggtcccgcggtcagaccggcgaccagtcaatccggcggctgtgcttcggtcagactgagcaccagtcagaccaacggtacagcagtggtcagaccgacccttggtcagaccggctgtacaccttcggtcagatcggcctcagagaaatttttctgaaaattttcaaactgtttttgtaaggggattgtcacgccctaaaaatcaactaaattaaaaatgcatattttaaatcatttttagaaattattttaaaagcctacaagctaaaccctaattttctaggaaaattttcaatataaaaatgagctagataaaattttattaaatactatacttgctcctctattttctagatttttctgggaattatttgagcaagggaagtatttttattaattgaaacaacatttcacaaattgttttatttgaaaaagttcaaagaaacccctccctaagccgttgggccgaattcggcccaacatcctctctcttccgcgcggcccacgccggcccagccgccgcccgccctcctctctctcgagtcaccgacatgtggggcccacatgtcgggctcgtcttcaacctccggccgagccgcccgagccgccgctttgccgccgccttctacctccaaatccgcctcaatccgaccccgattcctccgggtttttgaggggttttgttcctctcgttctcctctttcttttcccccaagaatcggagcgaatcgttgaggatttgatccgaatcgagttcgttttgattttatccctaaaaccgagtttgaattttttcccgagtcgattcctctcgtttggagtccaatctcttcaatctaatgctttataaagcatcccctcgtcgtcctctcccgtttgccccctttcccgtcctctcccgtgccccatagcgccgccgccacgcgcgccaagctcgccgccgccgccggccgtcttcggcgtcgtcgctgcgccgcctccgccgtcgccgccgcttgccgccgccgctgataggagcgccgtggtgaggagaagctcggccgcccatccttctttgccgccgaccgccgtagcccgccgtcgccgcgcaagccgagccgccgccgttgccctctcgtcgccggccgtcgtcgtgcatcgtttgtcgtcgtggtgagtaccatcgggttcgtctcgatgtcctctacgcgtaggtgtcctccaatcccccggtcgaccgccctagctccggcgagctcgcaaaccctaaccggccgccattgctgacgtcagcatgacgtcatcatctcctttttcttttcttttttccaattttctaatagattaaaacttcggaaaatcataactaaataaccgtagatccgttttaggtggttcaagttgctaaattcttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgcggaagcccaaggcaagtcacacagatcctaaacaaccctttgagcatgttgaacccgtttaaagctattattttatttcaactatgcattgttttcgaatgtcatcgggtggtgaacctttcccagttaattaatggccgaagatgactttattttcctatgggttataatatgattagcatgaaccttatatattggattggttcagctaaatgctatatatgtatgtttgcttagccatgcttagaaacattagctaactaaaggggttaaatctaaattattttattattaattagggttatattcaatggtagctcacgatggtaaatcgtgtgatgttaattaattgataattaaaacctggctaaggtgggttgtgagcatatggttttgatggttgtgctcatgacaattaaggaccggttcgcgagctactgttgtgatacatttatcgtgccaaccacaagccagcgtgggcaacggctttatcttttgtatagcgtgattcattatagtgcgccagactgagaagtggcgagaagtccatgggggtcgctggggagtccataccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggtcagagtttaaactattcgaatagccgtacccgcggttatgggtgagttgagcaatgtttttcgtgattagtctcacactactcattaatggtaataatgtggtaattaatttaattcctagtttggaatggataattcctggttaggaggtttaatttgttcaactggggttggttgttcaaatgtggttgggcctatgcaacatgggtgtgttgtgtggtgtttatttaatattgattaattatacaaccgttttactattctcttaaatatttattaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggtggattaggcttgttctcggttaagatgcctgtggagtggagtcgccatagctgttccgtagtttgttatagttttttttttccgatgcgtagaatgtttttctttgagaggaactatccacctctgtaataatttattatttgcgattattcgatagttatttatttgtactctattatcaaattgtcattgtgtgcctcggttgattcctggacgagggtttaacacacatgtaagcgcttggaattttggatagaaattcccggcatgacaagttggtatcagagccaccttgaccttaggataagccaaatggtaaaccttaagtagccttcaaaatattttgaaaaaaatagaactgctcttctctagtctcttataaattaattaagttggcagcacatgcaaggttatgcacaaaaatttatttaattcaatttcttttcttttaaaagcaaaaattcgtccttctcaaaatgtttctttctctctttaccaagtcttattgatttgtcggcactgtacatccattatggtatcgatacaatcatgatagcactagtactactcatctttcctatggtgacactgtaccgtgcttataatagatcataagtattttagtttatttttgttatttgtcaaaaaaaaaaatttttttgtctctgtccaaaaaagttaaattctaaaaatatttataaaatagctttgtatgtgtcttttcttttcttcctttttggtcaaaaatcagttaagtctagttggtgcagctaacttagaaaaatatgcattaattcttctcttctatgtttctttagatgccgccccattcactgagaaatttgatcaaggtgttaggattcgtcagggagctgaggttgatggcttttgaggtaggctatgaagttgctcccgagtatcgccaaatttcccatgaccccgacgaggagaagtgtcgtgttcgtgtgacgttggctagtgatagtgaagaccttccgtcttttaagttcgaagctggaggaagatcatactgccatgcttgtcaagaagcagcgttggtggccattggagagttgcgtgaacactttgaagaagagttggattcatcagctttccagtatcatcctcacaagcctcatggtcaagactatggaatctatacctgtcctgatggtgaagagagtgccactctgatgcatgcggtgcatatgcttagtgctatggatgcagtaagtgtggaacgagacaaagcagctcatgacagggaaaactggaatcgaggcaagatttgcaagttggagagcaaggtgtaccgtctacagaaggaattagctgaacttaaaggagaaacgccgccgccaacacccaagcttcgcctcactccaagaaagagaatctgtccgccacctcgtctccagttagcttcgaagattcatgtgatgggtgaagctgtgcccgatcgtgctgaacctgtcatcgacatcataagtgatgaggaagaggaggaagatcctgaagaaagagagccagctactccagaggaagaagattcatcgcttcgttccgacgcaaggcgggattagtcgcttagttagaacgttgccgtagttcgctgtgttagattgcttgtttaagtttgcttgtgagtgtgtgggttttagttgttgcttacatcatgggtgggatgtaacagcatgagtctagttcttttgcttgtcagagtgtaagatagttggtgagatagtgttaatgcaacttaaatgtaatcatacacagttaatagcaatatagaatttaaattaattaaataactccgttctaagggtgtctctctgtcgttctttcctgttgtctctgcttatcgtcagatggtgaacacgcgcaccggaagtggaagtggagctactaacaatggaggagatcccacgctagctcagattctggcccaacaaacacaactgatcaatctgttagtgcagcaggcacagaatcagcaggcaaacaatcagaatcagaatccaccccacctccccaaaacaagctggcagatttcttacgtgtgagaccccctaccttttcaagcaccaccaatccagtagaagcaggagattggctgcatgcggtggagaagaatttggatttgatccagtgtactgagcaggagaaagtttcttttgcttcgcatcaactgcatagacctgctgctgaatggtgggatcattttcgccaaggcagggctgaaggagagcctattacgtggcaggaattcatggccgctttcaagaagacacacataccaacgggtgttgtagctctaaagaagagagaatttagagcactcaaccagggatctcgttcggtcaccgagtacctccatgatttcaaccgtttagctcgctatgctccagaggatgttcgtaccgatgaggaacgtcaggagaagttcttggagggactgaatgatgagttgtcgtatgccttgatgtctacggatttccgggatttccagcagttggtggacaaggcgattcgtcaggaagacaagtataaccggatggagcagaagaagcacagggctgcccaattcaaggcacaacagggcagtaaccagaggccgcgtctcgttactggacctcaagctccaccgtaccctcaaggaggatcttcatcagttgtctgcccccaacgccagttctacaacaacaatactggtaatcgtggcaatgacaaccgtaacacggttgctcgtcctgcagcaactccagctcagaaccagcccgttaggaaggaacagggaagcaagccagtgatatgcttcaattgtggtgatccaggacattatgctgataagtgtcctaagcctcggcgtgtgaagaatgccccaaccccgaacaactctaatgttccagcaccgaaggcacgtgttaatcatgttgcagcagcagaagctcagaatgcaccagatgtggttttgggtacgtttcctgttaactctatacccgcaactgtgctttttgattccggtgctacacattcatttttgtctaaaagttttgcgagcaatcatgggatggaagttattagtcttgggagacctttactagttaataccccaggcaaccaagtattttcgacccagtattgtccttccgctaccatagaaatagaagaagttcctttcccatcctcgcttatcttgctagaatccaaagatctagatgttatcttagggatggactggttatctcgtcacagaggagttatagattgtgccaaccgtaaggtgaccttaaccagtagcaatggggaaaccgtttctttctttgtgtcctctcctaaatatcatggtgtgatcttaaaccaagttgctctacaagagattcccatagtacaagactaccccgacgtgtttcccgaggatttgccaggtatgccacctaagagggacatagagtttcggatagacttggtacctggaaccaaccctatccataagagaccatacagaatggcagctaatgagttagctgaggtgaagagacaggtggatgatttgcttcagaaaggatacatcagacccagtacttcgccatggggagcaccagtcatctttgtggagaagaaagatcatactcagagaatgtgcgtggattatcgagcgttgaatgaggtcactatcaagaataagtatcctctacccagaattgatgacctgttcgatcaactggaaggtgctacagttttctccaagatagatctccgttccggatatcatcaacttcgaatccgtgaggaagatataccaaagaccgccttcacaactcggtatggtttgttcgaatgtaccgttatgtcgtttggactcactaatgccccagcctttttcatgaatctgatgaacaaggtgttcatggaatatctggataagtttgtcgtggtgtttattgatgacattcttatttactctaagacgaaggaagaacatgaagagcatcttcgtctagctttagagaaactacgtgagcattagctttatgccaagttcagtaaatgtgaattttggttgtccgaagtgaagtttcttggtcatgtcatctcgtgtggaggagtggcagtagatccaagcaatgtggagtcagtattaagttggaagcaacccaagacggtttcagaaattcgtagtttccttggacttgctgggtattactgcaggtttattgagaacttttcaaagatcgccagaccaatgactcgtctgcttcagaaggaagtgaagtacaagtggacagaggattgtgaacgaagtttccaagaactgaagaaaaggctagtgactgcgcctgtgttaattttgcctgattcgaggaaaggtttccaagtgtattgtgatgcatcccgactcggtttgggttgtgtgttgatgcaagaaggaaaggtggttgcctatgcatctaggcaattacgtcctcatgagaataactacccaacgcatgacctagaattggcagctgtggtgcatgcattgaagatttggcgtcattatcttttcggtaaccgtacagagatgtatacggatcataaaagtttgaagtacattttcactcaacctgatttgaacatgcgtcagcgaagatggttagagttgattaaagattatgatatggaaatccactatcacccggggaaagcaaatgttgtagccgatgcccttagcaggaaaagctactgtaatatgtcagaaggtcgacatttaccttgggagttatgccaagaatttgaaaggttgaatttgggaatagtcagcaaaggttttgtggccgctttggaagctcaacctactctgtttgatcaagtgagagaagctcaagtgaatgatcctgatatacaagaaattaaaaagaacatgagaagaggaaaagccatcggttttgtagaagatgagcaaggaactgtgtggttaggagaaagaatttgcgtcccagaaaataaggagttgaaggatactatcatgaaagaagctcatgaaactttgtattccattcaccctagaagcactaagatgtaccaagacttaaagcaacaattctggtgggccagtatgcgacgtgagatagcagaatatgtggcactatgtgatgtatgtcagcgggtcaaggcagaacatcagaaaccagctggtctgttacaaccgttgaagattccagagtggaagtgggaagaaataggaatggattttataaccggtctacctagaacgtcggcaggacatgattctatttgggtagtggttgatcggttgacaaaagtcgctcacttcataccggtcaaaacaacctatacggggaataagcttgcagagttatacatggccagagtggtatgtttgcatggtgttcctaagaagatagtgtcagatagaggtagccagtttacttcgaagttctggcagaaattacaattagaattgggtacccgtttgaatttcagtactgcttatcaccctcaaacagatggtcagacggaaagagtaaaccaaattttagaagatatgttgagagcctgtgttctagattttggtggaagttgggataagaatttgccgtacgcggaattctcatataacaatagttatcaagctagtttgcaaatggctccgtatgaagcattatatggtcgaaagtgccgtacgccgctcctttgggatcaaaccggtgaacgtcaagtcttcgggacagacatattgcgacaggcagaagaaaaagtgaagattatccaataaaggttgcacgttgctcagtcacgacagaagagctatgccgacaatcgtcgtagagatttggcttttgaagaaggagattatgtataccttcgggttacgccgttacgaggtgttcatcgtttccaaaccaaagggaaattggcaccgcgttttggggaccttttaggattgtgagggaaattggcaccgcgttttgtgggaccttttaagat

SEQ ID NO: 46486 - DNA, 870 bp, Oryza sativa
gattccctcaacacaatatcctagaaggcggacaagattcttatgcctgacgtggccaatagcctcaacttcaaccctgaactccttttctgcctggcccctgcagcaccatatcaaaagaaaattaatatgatggcatcagaaggagtcacaagttctgtaaaacgcagaatagatttcaggatctcttacatattattaagaagcttctttattgcgacgtcagttccatttatgagtcgaccacggtaaactaccccatatccaccctctccaatgacattctccttggaaaaccgatttgttgcatgctccaaatctctcagagtaaaccaatgaccccagcccagatgagagaattctgggagaccaaccagaggggatgctgagacagttgcatattgagaaaagtgcctcctagcattgcccgagctgccttcatcaccagaatacgagctaccagccctatcacattggtacaccgagctgcattggctcaaattatcggcatcactcgatttactcctaaccaagtgtgccagcattttccctgaatctttctcgtaatgtttctcctgcaccgatatcgcgtggctttcttgcacacggaagttttcgacaacagcatgctcacgaacttcatctactgcaatctccttggaaacatccgggatttgagatactggaatcttatcaaaggacttcttcggcttccttcggtatatggaccagaggcacatgaaacctagtataaagaagatcaccacccaaatactgattccaatcacaatccatagcctcaaaccgaaaggcggcgtcctggatgatagctctgcacgcagggtttcacctgtcgacatcttcacttct

SEQ ID NO: 46487 - DNA, 11709 bp, Oryza sativa
aaatatatttatagctggcttatagtctgctattgtacctgctctcagatgcgtcgaaagagagtttaagcagtttaaaattcgaaaattaacacctaaagtgacttaaaataaatacctaatattattaatttattgaacaatctagaatttttgttttccaaacaacctagaattttagaaaaagaggcaataaaatgttactaccgtactagcacaatctatcatgcatgtgtctgtctgtctgtctctctctctctctctcagagagaggagttgagtggatctccatggatggcttgccgacacatcacagatggatgaacaaaaatcagatcctgtagcttttggaccttttgtcagtgtcatcaccttgtagtggaaggaaagtgaaagacaaaggtgacgccgaatgattttgggtcaacttaattggagaaacaccttggggcatgtttagttaaaaaaagcttttcccaaacatcgcatcgaatctttcgacacatatatgaagcattaaatatagataaaaagaaaaactaattgcatagtttgcatgtaaatcttgagacgaatcttttaagtctaattaggccatgattagccataagtgctataataacccacatatgctaatgacggattaattaggctcaaaacattcgtctcgcggtttccaggcgagttaatccgagatgaaaaaacaggccccaaatggcacaaccgcacaaggaacagggaatagagtaggtataaacagtcttcgcggaaacgtattgtaatcgtatctatgctacgcttttgtgatagtggacttttggatatatgtttttccaatatatgtttaaccatctatcttatttaaaatttcatatagacataagaaaataaaatataaaaaatatccttagagtatttttaattataagccaaagtcataacaaaataaaaattattcatatatttttaaataaataaatagataaatatatgttcaaacgtcaacagcgttatctattcaagactttaccaaacctaatttcctaatttcagatgagaaacatgtaaaaaagaactgaacaaaacccaaaaaagttgaatcgaataaaatccaaatgaactttagtatacctatctcaatattggtatatgcccaaactcaaaaggagagaaccaaaactaaaacttttaatgccgtacgtgagcccaatggaaaaaaaagtgatagtaacagcaaaatctcacttaacaatgtcgttgatcagcactatatatttttaaatattacttaaaaatctttatatttacctattgaaaaaaatgaaaaacagaatatgtttcttttttatttctaatttacagcagctgcattcagtcatgtcctacgctccttgaagagagaaaagtgaatttaacggaaagaagctcgaaaaagaaagaaaacaggggccaccacaccagtaataatccctataatcccgtcttctcccaatagaaagaacctcggaaaaaaaattctcccaccgcaaatttctccgtgcgagaaaccctcagccgcaactaaccaacaaattcgcatcctctccgtgtaaaaaaaataaaaagtaaagtagtgtgtcatctaaatccttaaactctcaaaatacatatccaagtcctagaacttgtcatagtgtgtcatttaggtcccaaatcgccacaaccccttcaggatgctacgtggcgctgatgtggcatgtcacagggatatgatgtggcataattttgactgacaaatgggacccatttaaaaattttcttttttctttttttcttctctagcattttcctttcttttcctttctttgcgacccgagcagaagatggaaaaaaagaagaatgagaagaaaacggaaaagaaaaagaaaagatgaaaaaaaaagagacttgtcacgtccatgtgacaagtcacattagcgccatgtaggatccaagagaggatgcgtcggtttgggatctagatgatacactttgacaaattctaggacctggatatgccttttgagagtttgggaacctagatgacagaccgctacaagtttaaggactgcccgtgcattttactcaaaaaaaaatctcgcatcctctccacaagcgcaacagctgagcaagagaaagagccggggtgcgaccgcgcgagtggataaggtcacgcatccttattcactcgtccccctcctctcactcgtccctctctctcccactcggtccctccctctaaccctctcgtcccccgccctcgcccccgcccctctcgtctctcccttgccggtagcagaggaggcggcggcgatggcgtcagtggctcccaccgaccggatccggcggcggtggtggcatcggcggctcccgctaccgaatccggcggaggcggtgacaccggtgtttccggcaggcggatccggcggaggcttttccagcggatggatccggcgattctctaccccctcctcctcaccctccgtgcccaagcttctcccgcgatggcggcggcggcatcggcgctccctcgggcagatccggcggaggtggtggcagcggcatttccggtgggcggatttagcggtcctctccccccctctccctctgtccgaagcttctcccttggatccggtggcggcggcgacgtcagtggcacccgtgggtggatccgaccgagaggatctgcccgctgccacgccgctgtcccctcggctggatccgccggtgttgttgattgtgtatgttgtttgtattgtttttcttatgtgataatgatgtcgttgttgtgattgattttggggtttttatgcgatgatgatgttgctcctgttcacccctccatctcctataatcatctcttgatattttggatgattttgcgatgattctgattggattgagattgagattttgtttttgggtcggattatgatgatgtgggatttggagaggaggtgcgcgtgatgttacagacggacgaaagatcggtgtgacgaaaggaaaaatacgaatcttttaattagttaagatattgcatagtgcccgtgcgttgcaacgggaaaaacttccgtttcatagtgtgacacctcgagaacctcaaatcagtaaaaatcaagtctaatttgatatattaccaaattggtagaaccgagtctaatttgatgaattagcataggatttaggctttagtcttagatttacattgcaatgcggtggtttggcaacaacggtggcacccgatctagctgcatgggaatttttggatatatttgtgtgtatatgcttagttttccctatctttgattctatttgcgtgtatgcttcagttttccctgtctccgattctcaggatggaaagtaacgactgggatttttttttggggaaaagtccattttacgcccttgaactcttatgcttatctaaaatacacccccaaactacaaaaccgggtataatacacccttgaactgtccggtattgatagctcgagggtgtattatacccggttttatagttcgggggtgtattttagacaagcataaaagttcgagggtgtaaaatggattttccctttttttttgagggggaggggggacggacgaaaaattagcgtatggacaaggtgacgatcggaaagatacgaatcttttagttagttattaagattagttaaggttaagactagaaaaaaaaacatgcgttgcaacatgtgaatacaatttaaaagaattggacaaaattgaaggattagcaatgcatatacgtgtatatataggcaatatagctattgcttatcacagtctgctgtaacctggatttttcacattttggttcttttaaaaaacttatttcgcaaatagacccctaaaaaaaattatgctagaaatggtccttttttgtggcgccagagtggctggcgccgccgtccttctgccgacgtggtggggcgatgctgaggtggcaggggaagcgcgccagagtggctaggggtgaaaatagagcggattcggacggatagtggtcataccatatcttaaaccatatttttaagcggattcggagtgggtgcggatagtgtacggatgcagatgtcggaaatggtgcggagtcggtgcggaatcggttcagaaacggattaaatttatcagatgttacgtgtgtatgcaatcaatacaacattgagttagcaatgcaagtaaaaataatacaatgtcaataaacgacccattgtaataattatgtgcttaagtgctaaacaacataaatacatgatgtccattttataaaaatacagctacgcaagtgtgacatgaaatggtgaaaaccacatagtaagaaatctagggtaattgatgaattaggtcattggatggaccaacttgtgttcataatttcggattatccggtaaagggcctatcggacaaaaatgtcggataatccgtcgtatttcggagataccatatcctcatccgcatccatatccgccggatttctaaaaacccataccatatccttatttcggatggattcggagcagattggatcggatattatctgatcgttttcacccctaagagtggctggcgcccccccccgaatttttttatttattattatttttttgatatttttttcacgcttaggaacacacaagaaccaaccatagaaaaaatgaactcaaatggacgaaatatgtgacctgtagaatttttcctctcctctcctctctagtgcagaggagaggatgtgcaacttttttatttttattttatttttttttcacacttgggaactcacatgaacgaaccataaaaataataaactcaaacggacgaaatatgtggcatgtagaatttttcaaggctatcatttcatgtagttatattttgaattagattaagtaatttcacctagtggtagagtgcattatgtttaatatgctgatcaaagggttttactaaagaagttatggtctaattttggtgaaggtgcaaagtaggtaagtggtatgctatattttcagacttctagctatgtgatatattccgttcgagtttaattttttttttgtagttggttgtatcgtgattctaagtgtgaaaaaacatccaaaaaaataaaacaaaaataaaaagtttgcaactctatatagagaaacaagaatagaggcgggggcggcgccagagaggttggcgccgtcccgttggaccacggcgccagccactctgacgccccaaaaaggactatttctgggataagttttttcaggggtctatttgcgaaataaatttttcaaaatgaccaaaatataaaaatccagctgctgtaactaccgatccatcacctaatgaactacggaacatgtgggtatggtcggtgaatattttttttagacaggatgcctagtaaattaacggtcgatgaatataattgtaatgaaaaattaacgtcattctaacatgttagttttgaagttatggtgcatagttttttcgtgcagtagcgtgtgtgtacttgcattgcatggactaatatggatcatgtcgtagaaaatattgttatggcagtctattgatttctaggaggcatgtagcaacttagtcaatagcgaggactcaagagtcaagactatacaaggtaagagctgaaatagacatggtaaattgacaatgtgtggaagggtaacaactgatttattagtgatgtacgagcacaaaaatcaagaaaaaactatttttccaaaattgaaagagaagatgtggagaaaaaaacatttctaacaatcatcaaaggataaattttaactcagctaatgttcatcacatgatttgtgaagagcgtggctggctgcatccactaatgtgggccgtgatcggtcaatgtaacccgctggccctggtggggatggtggaaaaagggcctgccagaccagggagaagcaagactctagcttcatgtattggaacgggagaacacacaacgcgtgcgcggggtgtacaaaaccgatattgtaacggagtagaaccgatattgtaacggagtagagaacgtatggaaatttttgaagaaacatcttcaatttttataatagtagatattaagacaagatatacaatgtactagatttatttcacccaagaacagtgcagatccaccgctcggctatcctgtatggtcactcgggcttgttggcgattacgacgttgtatatctatgttgttgaaggattgaagattaaagttttgcgaacaaatattaccatcatatttaaatatatgacattgttgagtttattcgacattcattgagaaattttggcaactatttttctatattataataataattctaacaaaattataatatttttcttttttacattttataattttttgtgtttttttatttcttctttaactagaaaaaatgcccgtgcattgcaacgggtgaagtctattttaatcttattattgttatatggttcagttaaaataaaattcactgtgggagttcgtttatctctactattataaaaattaatcatctgtgcatgagtcggtttttaagtttattcgtttttggaaatacagatccatgtttgagtcggtttttaagttcgtttgcttttagaaatatagaagaaatcgtataagaaatatctttaaaaaaactcgccctcctgctaacttgagacgattggattcctaattgcagctcatgatttttttaaaaaaaatatatatccaaacaagttcccacaatagatttcttgttaactaaaatatataacaataataagattaagatagcttttaacacacatatattttttctagtatatatatatatatatatatatttagaaaatcatgagctgtagttaggcgtctgatcgtctcaagttactatacgagtgtttttaaacagaattcttatatgattccttctgtattaccaaaagtgaacgatcttataaactgaatcaaatacagatatgtatttccaaaagcaaacgaacttaaaaacggattcatacacggatgacgtaccaaaataccggcaaaaaacatcttcaatttttataatagtagagatttgtaacaacatgtttaattatgaaattaaatagttataattatatttatattgtacaaggtaccacgcttgccgcgaggcaattagcaatccaagagaccatcttttaaacagccccaaattcagctgcacaagcgatgtggtataaatgattcaacgccaaatgttggtaaggttgatattggaaataaagtgaacaaaccccttttattttactactgtcaacgttttgagcttactgttaaacccatgtcttccttttttttttcttttactccagtctgatccagaaatactacaatcacaagtctgaatccatgaacacaaggagagacaacattgggcagtaacacacaataagttatgccactcgctacagttaggtggcaactatgtaccgttctagcaactacggcaaccgatctgcaattttctgcagttgaactgaagaacaaactcagctttgcagtgaccactgacccccctgttgcgaatgtcctccagcttactaaaaataatgggccatgcgagaggactggggcgcctgcctgctgttgctgcttgcgccgatgaagccttgcagaaggctctgtgcggctttcacttgatccggaatgccctggatctccacaatggactcggaagaaccaggatgggcttcgtgcaacttcactctcgcaccagagatctgggatcaaggggagattttcacgaggaaaactattggtggccattggggcatggttatgactggggatagtgcataatgtttctcttacgctataccagacggatctcagctagattgacaccaccaacaccaatgacagactccagttaactatttggaatccacaattcgaagagccacctggatacctgcaaagagatcatcactcaatgattatgaggacaaaattcatgtttgtgtcctgtaaaaattcagtctgcgtaagccatacccagtgagacctgacagtcttcggtaatcctcacgtccatggatctgctcagcagcctgaaaagaatgaaattcaaatctattaagcactgaagagaacaaaaatatacattcagatgcatcagagaggcatcaggtgaaccaggaaacaaggaaataaaaaatgagaaaagatcaacacccaactaagaaaactggtaagcaacagcagcagagaacagctgaataactgaatctagggtttgcaacaacatcgtaacaattgaatagtgttaccaatgatagatattagagtgggcacaagacagaaggatatatttggatcaccatgacatattctagaatatttttgtccttttttcagacgtctgaaccatcatggaagaaaatagacataatgcaacagtcaaatatatggtttcatgtttctaatggaaacatatcaggcgagggccatttgcaaagaagaggcaagctaacgcattggaaatgtacctcagtataatcataagcattggaatttccagctctggtgattcctaattgttgcacattactattcccggctctcgagaggcctaattgtagtgtaaccctattagagtacctatcagtaggtacttggtcaagataagaacggcaggacatataatcggcaccaggactaatagatgagggcagttctccattaggcaagcgagtagttgctgcatatctttcgtatgaagcagatggtgcaactttgctacttccactagggtactctcttttagagaagtactctacaggatacacggtgtaaggatcatgagcagggccggtcctgagattctgaaggcccagcgtgaaactaaaaacggaggcctttattataaaccttcaaataataattaccatataatataaatatctttaaatagcaatcaatattcgatttaaaaaatcatacgcattatattaaaattttctttgaagatttgtaggcgcagaattattgatgatgtcctgataatatcagaattattgaagtggctgtattactcttgagcatcctcaacacacctacttgtttttgttatctattgcatactttctcaacagcataatatcaaggaacaggctaatacttaagaaaatattaatactagattcgtaaattacaaggctacagaagtaccaaattagttgaaacaaatctaaccaatgtgaaaccagcaaatcactgaagtttgtacggttataaccttaaattatcaattgataccttgtaattttgttataaacagataattccactatgtaatctcgatctagatctagataggcagtatagcgtacttactgatggcggctagagcccagcaggcagcagtgccgtggttgttcttcacttccgcgacgacaatcgatcgattcagcaccagcacatatatagcagtcagcagttgatgcgacaacagatgtgctcgtccagcatgccgatcaaccaagataaggctgatatgctgcgcttgcgtgtggcatcagcatggcagtcggcagatgagatcgatcggctgatcgttatactcgcgatctcgcagttgcaggccggcgaaatcacggagaaacatcgcctcacgttgcgcgctggaagatcgctactactcgttgcacagataggtgggggccctgggaatcgggggcccggagcgatcgccccattcgacccccctcaggaccgggcctgatcacgaggcccatcattgtccaaccctcaatatgatgtatcattgacaggtcttctatatggtggatcattggcaggtcttccatattgtggatattggtcttccatatggtggatcaatggcaggtcttccatatggtggatcattagcaggccctccatatgggggactattagcagatcgtccatatagcatgaattccttgttaggcaagatatcaacaggaggaccatcaacaggggcaaaaggtgtcggattattggaagaacttccatctctgagtgtcctagttcaaagcctcgaagcaatctctgtcagggctcctctttcaatagctggaagcccagcaacctgaaagcttggaacaaatgtaaaagcacaatgaaatgttaacaagtaaaaactgcagttataaaagtaatatatggatctctggtgtaggtatggccaaataaattacctgcacaagctcctcatcaaaagacaggtacttaggtttatctgcttttgagtagactcggatttcagccccagtccgtcttctcatttcagtaattacctttccaccttccccaagaatacaaccaactttgtttgatggtacaacaagccgtgttgtcaactggtggttctcagcaagtgtacttgctttactatggagcaaaataagcgcctcaattgttggagacactggatcatctggaatctggaaagaatatgtaggaggatataaaattgtaaagactcgtgataaaaatggcaaggcaatgccaattggaataatcatctgcatattacctcctgagatgaaacaacaattaacctttcttcagaagcatttttgccaacttctttaacctgaccgcaagcacctgtctgcacctaaaatattggattggatgcaggttcaaattgaatgaacaggttttataaaatttagaagcgcggaaatgcaccatgccacacactaacaacttttattcaggaaacaggatttagttctgtatttattccagaaaagaatgtcttccatgtaatcagaaaataagctaatggaataaatttagttctttgacaaaatccattcacactggaaggtgggtctccgccatgatcaagtgccacaatatattgaaagaaattaagggaggtagcagcgaagaatcaagagagtgcttaaggtgaaaaaaaaaaggaaaggagaagtgatccgtaccagaaattgatcagttcggagcagttggccttgatgcagcggagtcccctacggacgggaggccttgatcttgccctccactgagtatgccttgtagctcaccacgcgccgtcccctcctctctgggtcactgaagatctgggggatcacatgccaccatcaccgtcaccaaccttggccactactatattctccttcaaagcaacagatcaagtggtcaacaaggtattcactgcagcttcatgaaaattacaagcagagaagcagtagaacctgaattttatctgtggatccttccataccagaacagcaccaaagaagcattctcttcactctcttaaatgctcgcacaacaaaacatggtcaaaggagcttccactagcattcaaacttcatagatacaatcatttaatcagaatatttgcattaacccttctttataagactagcaaaatgcatttgcgttgttacggaattaaaaatcataacagcacaatgcagagaggaaatctattttgaatcctagagcttaattttagaattaatttgagttttttgcttgccaagtttacgctccatttgttattaactcgcaaggatgattatggttgagagctccatggtctgtccgtgatttccactgttctatcatacaattggtttggagaagggattgacagtgat

SEQ ID NO: 46488 - DNA, 2596 bp, Oryza sativa
ctccccaaaatataacaacttctctaccaacattctcttcccaaccaatcacaaccctccaccattcacttttcccacctacctccactactcatgcaatcacaaccctccactactcacttctacctactttcttaataatcgtgtccaactctaaaacttcttatattctaggatagagggagtatgtggtgttatccatctcactccttgctgcctcacacaggtaaatagaaacatcattccatcagatatttcatgattagtacatgtgcataataatacgttgagataagataatcagatcggaaaccattctatacaatccaatcttgttccataaaaaatatattgtgatgatcagtactgcatttggtaaagaacaaagcttcagacatatcttttgttcagttaaaaaacaagtcaaactattcaacacctaaacagtacacatagatgaaatttaatgaaaccctataaattgttttggatctaatgtcaaaattactgcctagacacattaagtttgaaactccagtcacaaatccctttatgatccgttagtagagataacgacaaacttttatgttttttctggcatcaacagcataacataattgcttgtttacagtctaggaaccacagtaaaaataattcggagaggtggcatacatacctcgctatttacacatacagagaagatccctcctctaatcggactgtaggagaaaagaattccaacacagaatttcaaagctgcaaaatgcttcagcagctcaaagattctataaaggacttgtatttttcagggagaaatatatgatattcttgatattttcccccagacaaaagatctataaacaaggaagcagtggatgcttcgagggaaaagtgcttctcatcaatcatggaaaggtaagtgccagccctggttatctcacctctctgcaacagttccctaacaatgaaatttagcatgccagagtcaacagtacagccattgtcctccattgaaagaaagagttgatccaattcttctagcaacccctgtcctataatattttcagccatcaacctgtacgtccaataattcggcactaaaccgttagacgagaaagcaacaaacaaatccttggcttcatcatttctgccaactttaagcaatgcatcaatcataatgttgaaagtcctagcctcaagcttcaaatccatcaaacataggttctgaaacatctgaagtgcatcatcagtgagtttgtttttgcaaagtccatgaaggattatgttgtatgtgctaagttcaatctgcgttccactttcggtaatcctgacatagagttcttttgcagcagcagttcttctggtttgaaataaaccttgcagaattatgttatacgtaataatatcaggactaacaccactgctctccatctccttaaaaagaactaacgcgtcttccatcctactaattttgcagtagccattaatcaaagtgctataagtaacagtattaggtttcaacccaactgagaccatgccagaaagtaacttcattgcttcatccatcttacctgccaagcaatatccatcgatgagtgtactgtatgtaatgatatcaggcttcacaccaatacgtaccatcaggtcaaagagtttttcagattctataaccctcccttctttgcaatgactgtcaattattgaattaaagaaaatagtgtccagacaaatgcctcgatccaacatttcaagaaataactattatatgtcatgcaatcaggcatgacaccattcttaaccatcgtggtaagtacctccatggcttgtccatagcttgacccttgcataacgcagcaataatagagctgtaggtcacaacatcaggtaaaatcccccggtccagcatttcatggtatgtactgtaagctttgtctgaatccccctctttgaagaagccattgatgacagtggtatacgacaccacatcaggtgggctacctcctcctcgatcatcagccatcatgtgcagcaactcgagagcttcttggcttctgttctcatcacacagcccgttgagaagattattgtaggagaagacatttggtatgcaaccgagctcggtcattctgcggagcactatgtccattgcgtcgctcgtcctcttgtcggcacagaggcccttgagcagaggagtgaaggtgatggcttccactctaaatcccttcttaatgacattgcccaaggccgcgaaaccgaggtccaagcggcccgcgcggcagcagcaaccgatgagaatgccgtaggtgcacaagtcgggagttacctcgtcggcgccagctcgggccatgcggttgtagcgggacacggcggccgcggggctgtgacgcgcgacgtcggcgagggcgcggttcaagccgtagatcgaggcgcccctgccacgccggagcaattcgtcgaacacgtggcgtgcgtcctcggcgccactgccccccgcgcggcctcctcgcccttggatcgagccgtccgagcgaagggcgccaacagcgcgggaagcggcgcggcgcgccatgcccgccctagctgacaggtgcagcag

SEQ ID NO: 46489 - DNA, 1329 bp, Oryza sativa
tttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggattaattgatataagttaccaattccttaatcaaatggattaattctcaaaactcttcatcccattgatatcccatagaagaatgaattcacatgaattcctagcataatgagccttggaatttatttgatttaattgatttaaatggattaattatccaattaaatctaacaaagttcaatctgcattccactttcggtaatcctgacatagagttcttttgcagcagcagttcttctggtttgaaataaaccttgcagaattatgttatacgtaataatatcaggactaacaccactgctctccatctccttaaaaagaactaacgcgtcttccatcctactaattttgcagtagccattaatcaaagtgctataagtaacagtattaggtttcaacccaactgagaccatgccagaaagtaacttcattgcttcatccatcttacctgccaagggtaatgatatcgggcttcacaccaattcgtaccatcaagtcaaagagttttccagattctataacctcccttctttgcaatgactgtcaattattgaattaaagaaaatagtgctaagacagatgcctcgatccaacatttcaagaaataactctt

SEQ ID NO: 46490 - DNA, 7569 bp, Oryza sativa
ttaatttttaattaaattaaccatgattaataaatctcttttaatttttttttgaaattttgggagctttattgctaattttcataataaaaacatctttcagcatttatttaaataaaaatctaaataacagttagtgatgctctaaaatgaaagcacagtttaaattctatagtctgctacatccttcgtttcatattatatgtcactagcaaatatgcccgtgagttgcaatgggtgaactaaaaattaaagatttgcactggttttaggagtttgaggggacaaattaagggagctaaagcgaaattattctgtgcggagcgtacacatggcctatggggtggcccaatagtgcggccggcctgggaacaattcagaggcaacttaaaggacctaaagtgaacttatttcacgcggagcgtacatgtggcccaatagtgtgggcaacctaggagtggcacccggcccaacgcgggagaagccgtagttgtccgatctgatggacggtcctgattgatcccgatctatataaaaactcagcagcccaaaccctaactctaaaatcatttttcctcccccctatctctctcaaagccaccactccccttcccttcctcaccggcgtcgccgctcccccccgcgcgcgcgccctcaccggcggcgccgctccatatccccctcttcctcctgtctcgccggcgcggccacggggaggcggcgacggggagggcaccctactggttcccctcgaccactccctccccctttctccaccggcggcgctctccctcccggcgtggaggcggtgatacattctagtataatgaatttggatagatgtgtcacattcacctaaaatctcttatgctatgtaacgaagggagtattgcaactttgcaagtttgtaaatgtgccaaaaccggtgtgttgaatgaaacatatgttaacgtgctaaaatgatgttaacagtttaataatcggtgaattgatttttgcgtagttagtagtagtacatgctaaataatgaacgtaagggcaagctattgctcgtgcacacttgccatgtgcactgatattttgtttttgacattttggtttttagtaataccccttcttttttttaaaaaagtctttgttcctttataaaggaaaggaacatcgtatcaatatcacacgttatactgtcatatccgtatacaatcgcttgtgcgcataccatataagatcgcttgacacgcagtaactgatatgttgagctgaccatggaatctcgtcaaattcatacccagaacgcagaaacaaatgaaaaggtaaatcacatgcacgtaacacaagtgaatccaatacaaaacattattacacttaccgaatggtgtacccggacacaatcttaaagaaactaaaattaacaataaatcccttaccttactcattaatattcatagtcactaggatttgaacctagtagataacgttatgcacccacaactccttcacaataattcctttggtgcttccccaaatttgatatccttaacttaagccaagtaatcgagcgtctaatatcaaatcttaccaataaatttgtggagtatataattaccaagtttccccttttcttctatcttttggttcattttcacttcgattttcaatgaaatataactcatttgtgcacgacaaaattactttgttctactgcttaatcggcgtggcagcaccagtgcacaaatgaaggcagaagcagtcttaccattcagtgttcgatcctagcctgccctacaccatatcttcaaacaagaacacaggattgcattgacagactcgagcacacatttttacttcacagtttaatttaatgaaacgagcaacttctcctaaattacgataagttcttaggatacgttatatatttgtattgttaaatataaaataggggctaaaataaactacatcagagtctatttttacaaatctgactaacaacggacagtcctgtatttctcctctcttcagtctgcaaaaatggacagcactcagcacctagtctgctaccagccatactagaggctcaggaacatgaagtagataaattgtggactagaagtctagaacatatataaattataaaacatggaaaaaaattcccactcaacgtgggcaagcaaattagcatgatatgcatgaaaataaggtgctaacattcaaagatagaaataaacaaaattcattatgtggtttggccatatgtgtatgcaacaaagttcttcattttaaagaaggtgctataactgtgtgaatagaactatgttcaaggcagccaccaaagagagtttggtgttttccccaaaatcatatatgattcataaaatcttgtttgtttaccaaattctgtaattgcatatatgtctacttaagaaagcagggatgagactacagccataccagctggctcctgctgtccatacgccgcaaaggaattactcctaagagatacattgcccatcaaataattcggaacataaatatacttgtcttgcttataaacttgaaacaccttcctagagttagaagggtatagatatccaaaaaactctgatggttcgcaacatagatagcagggctactattcggtggcaggttctccattccctcgacgtcaagcttgtagaacatggaaattgtcagagttgcccaaatctttgcaatgtagtgctgagctctcgaaaaaaatttgcaaatatacttattttttcaataatttatgtttatatacatgcatggagaggttttataaaaatatacgcatcccgcgaaacggaaacgcgggacagcgacggttccgcagattcaaaatacgggaccgacgatcctgcgcggaaccgtcatggtccggcagctccaaaacgcggaatcgcgacggtcccgcggttccaaaacgcggaaccgcagtggccagcgactccagcactgtgcagcgcagtttatacactgttttaaccctgtgcagcactgttcacacattgttcatggtcggtgccgcgcctccattgtgcggaactgacccgggaactgtgtaaaacagtaccagaaacagtgtcaaacagtattaaacacagtgccatgcagtaaaaaaatgttggcgccgcggttccgcacactggcgctgcgggagcgtaccggttccgcgttaccggcaagcgagactggctcggtcccgcagccccattccgcgcgaacgcctcggccgtccactccgcgccgccacgccatacttttgtgcgctcccgcataaccgatctgcggattagttatattttcgcaaattcttcatactagtgtatataaacgtaaatctttttcaaaaaatgggtattttcaaatttttttcctgaactctcctccggtatcggtcaaataggagcacaagtggatgaaccacaaccatggcgacaaacaaaaagattgctgcaactgcagccaccgcgtagaagcaaacccctctgacccttgaaatcacatcgatgtctggtaaccaaatcaacaacaaaagtaaccacataagaaatgcaattctggaattcggtatgaatcccatgagtttgtccatgtacatgattttatttgcatccgcacattacatgtaaactgtatagacatagttttttgttttgcatcatacatcttagtaagaaatatccattgctgctcaaattccatgaaacacaaatgcacaatagctagtattagctgctacaagttctttagaaagtcttaacaactgcctgttctcctcaatttatactaaacattctattgacaccttcaaggttggtgtggagctaactgttataaccaacaatatatcatggtggttaacaagaatgatgcgctggcaatgattatgtttgatttccacaccttcagttttaaaattagagatggcaattttgtcactgcaggttcaaatgatttttctcccctccacaattccacattttgtcaagcaattgccaacaacgttccaaatgtaaatgttccagcaaactacattaatggctatgaggcctgcccagcgagacgaacatcacaacacattttgcgagaaaaaaaaataaaaaagggaagagagtggaggaggctgcaaacctgagagcgcctgcggcgaatcccccatggtagcgacaccaccagcggcgaaatccgatctcaccacagtctccctccgccgccagctcgccgccaaagcctgcggaccagggcggagcagcgcggccgatacaccctgatgcggatggcactccacgcctcggccacggtcgccccccgccatcaccactgcaaaaacgccaaaatcacaaatcaaccggatgagaagatatcagctagcggcggcctcgagatgcgtgtgattaccgtgcgcggtcgacgacgtggcagcgggggcagcgacgtgggcgattacgtggtggcgacgccgacgcggcggtcaaatgcaaaagggtcatcaccaccaccactgtcggtgattacattttaagatagacggagtctttttgccatttctctggagttcccatcagaactgtgcgctcttattgaaatccatccagttgagcctctaattggatttgcattgccacgatccttttttatattcaacttcaaaccactaccattgctgtgcctctcgcctaatgaaccacttgatgccccattgcttgatataaatggagaacaattgaatgccttctgtgacagaccagcatcactaccagaagatatagtaatatgagaaacttctgattttgaagataagcaacaatgacgtgtctggttcgacaaaagtttttttttttcgagttcttgctctttccatcattaaatgaagttccccccatgacatctgctgcataacaaagcttcaagaatgtcactaattaaacttatacgaggaaccaacaagataatctgggtcaggaaacatgaaatattaaaaatatcaggtagcattttataaatatttggtgtcaggccaagttcaacatctgtagtgagacttgaatggcgaccaaactatattgagacagtgcatagaaaagccaacgagatcaactgatcaaacaaaattggtgtttgttattaccagagtaactctgttgagagactttagacgatttcggatatgtagagctggaaacaacagaagaattctgaagtattgaaagagctgcagcaaaacaaaataggcgtcagactgcaactttaacatactggatgtttaaaacattttattgtgttagcgaacacattgtattattaagaaaaatacctgataataactcaatagtattgataatgacaccaacaaaagaaagcaaggagcgtttcgggttcaattttctactcatattaagcaaatgggtctgcaagaagcaaaatgaatgtaagagttcatattgctttttcaggaagaaaagaaaattgttaagcagacatacaaagtcgcactgtttgcacattttgcacagaacaaatcaggagagaagatagtacagaagaaggaaatgggtactaaactgaaacagaacatataaggagcattaccttgttatcatcgcttagaaatatggcattttccaatattttcaaacatttcaagaggagagcagcactttgcaaagatgttccttcatttcggtccaaagctgaagtggatgtatcctttatgagattctgatacacaaggtttgccaccagaagtatattgttaatttatttattcagtttatcagcgtaatatgattgcattattagttggggaataaaaagtacacagataggaacaccaagcatttaaattaatgcgcaatttactccaaacttgcttacacatgcaagaacagcaagtatagctggaaaagtaacatccaaatgaataatgttcacttggtgtagatatgtcaagtgttattatcgtttcaagtgttattatcgtgggggatataatcatcagaggaactgtaagatactaacaccacatgcagaataaaaaagtattaaaaaactatttttgcaacataaaacaacataatttgtgttgcagccaattttccatgtcctgatgaaaatagttactacctcaagcattttccatgccccaaaatataacaacctttggctatgtatctggacaagcattactttcatgtggcttcaagcacattaaagctaaaatggcgaaaaggaacaagcctgcacaatccattagagttgaacaaaggaaatgtaaaatatgcgatgttagcgagatctcacctccaatgttgaatgaaaatccaccataacgtcaaaaatactatcaagacctcccatctcccttaatgtctctttaaaatttcctccaactctggacactgtgtcagaagtctctgtaacaatcaaatatttgataagggaaaaccttcctagtatgacaatggccataggtgcttctagtgcagtccactactccaattcaattctgcaacacagatggaagtcatcaatcaaaagcaggtgaagaaaagggctaagcaaaccacccatgaatattgcaaataggtgctatgtaacttatgacaagttgacaactgcttatttggctcatataaataaatataatggtcataaagggaaatcatgaccaagaaatttgattaaaacttaccctctactgaaacagcagacaagcatgcattttccattgtcaacaaagcaagccactttggacacagttctggccttgttgttttcttgtcatctttgtcgagcgacttgatcacttgacagcttaagagaatctcttcaacttttgaaaggatttcctctgaaatgcagtcagaatccttatttgatccattaagcatttgaactttactgattccaagaagtttggaacctatcgatggtgctttggaatcaacaagattcactggaggatttaataatttaagaagaaaatggacaccagattctgaatccaacaaatgattttcttgaacctgaacaacaagaagggagatattggagaataagcacaagtgaagttataccattaaagagtacgagctgctagcaataataactgaaatttacaccataaattaaagttcaacttcaaacaaaatgatgaaataaaagcatggattttctcaaataatcttctttgtaatcacatgccaaaatattcatggaaaactggtgaatacttatataactatactgtagaaataaataactttgtcatgatgtgattatctttatggactgttatataaaagaaaacaatcgatatgcgtaaaaaattggaatgaagcatgcacagaagcataaggatgggattgagaggtactcacatcacttcacaaaatgaatagaagagcagctgcaccaatagtgcagggaggatcatcaatgttcaaaaccaaaattgaatcaataatttgttgtaccaatctataggatataagaaaagaggacacttgtgagtaagaaaacaaaaggtaacgtacaataatttcatta

SEQ ID NO: 46491 - DNA, 1564 bp, Oryza sativa
aaaaaaggaaaacgagattagcaaattgaactgaaactgtggaccaggaaatcaaaagaacatgaaacacagtatacctggatgcttaaaagtagagctgggtcaacagtcattttgtcaggcccaatgctagataacatgtcactggaagcttgccacggttcaggtagcagagttgatggatttatcagggcagactcaattcccttgccaagcatatccagaagcaatcttgcttgcatgtccaacacaagtgctctgacatcttgagcatttgttccttccaacaatctacactttatcctatcaagattctgcaataagtaaaatagactaatcagtaacagaagaaagcaatagccttgcaacttcaagtcctcaaaatctgaagtaaaaggtaaacacacaattagaaaaacaaatcttgtccaactcacaaattacaatatattgcattatgaataaagtagcaaactacatactaccgtaaatggtctctgaccaatacatccagagatataatttatgttcatagaaaagtttggcaagcttcatgctaaaatgttcattcagaactgcaaagcagtgctagtgacttgtcacaagaatactaaaaaactatgtccaggaaagaaaaggaaaaaagtcatcttgattatattttgattcgtatccccctttcaactactggtggaataaagactggtgattggtgaatgtacaatctttaagaacccaaaaagatattgtgacatgcatgtcacatagtaatggcagtaggcagtagatgatgaaaaattgaaggcctgtgcttaaaactgcacataatgtactaaaagcacagcacacttacaggacagtgttgttgcctctgttgtatagttggaagacaatggaagtccgcgtccagcaaagctatcacactgttcagtgagactggaaggaaaagcaagagatttagtttatcatggacaaatataaatgttacaggtgctgaaatagttaaccaaccatatgtagaaaatgatgaaacttactgaaaagttctgtatcagcttaaaaagatgtattgcaactcacaccaggaaataatgttaacatattgagacatccaaatgggaaaaatgaagcaaaacacaattcatcatactgcagatgcacaatgctttcaaattgggagcataaatgtgcaatcagctttaaagtcttaacattataaacaaccaaacagagatttgcttggttacactgttcttaattactccctccgtttcacaatgtaagtcattctaacattttccacattcatattgatgttaatgaatctagacatatatatctatctaaattcattaacatcaatatgaatgtggaaaaagctagaatgacttacattatgaaacggaggaagtatatactttaagaggttgagtgacagttgtggaaattctaccgtgtagcagataatccctacttttctaattgtggggacagctagaacacaattgaaatgcaaatactatacacaaattttaaattgcatctgcataagcatccttaccaa

SEQ ID NO: 46492 - DNA, 1038 bp, Oryza sativa
agcagaataaactatttgggccaattgtctgacatcatttggaagatcataagggtcaaagctaagtcggttcgccctgtcaacactgcactcagaagaactccgctcatctgaagttgttggcattggaacatatgattgagggttcttaaggtcctcagatggtgggatgcttttgttaactcttgtggaccaaacagtctgtgtaggtggctgtccaccaaagtttgcagggcttccaaatattggatgaagaacaacaggttggactgaagattcccagcactggactctccatccagtgatggaaggtccttcatcaggatcataaggagacatgtactgccctggaagtatgtggtttaacaattgtcagaaaaaataaataagcattagccaagagcctaagatcaaccgattcacttaataaatttcagagaccccaaaagtccttaaaagaatatgcatatagcatttacagacaagaacttttattaccatggcacaagctaccagagcaaatcaaagaaacaacaaaagcaactaaagggagctaaaacatgtataagcatgctctggacatacatagttagattaactctcctactattaaagctgttggatgatcataggattagtgtggtgattatgaatggcattgatgttcatgccattcatcagaaacaaatagtcatagtgagatgtgacaattgcatcatactaattcatttcccaggtgtcatatacgcaccttcaactattacaactgtaataactgatccccctcgagtgggatcaaaagcaactgaggtaaccccagatccccatgttgtggtagtggctgactgggcagcagcttcaggactgacgtaagctgaaaagttggaaactggacaacaatggatcgatgctacctcagtggtctcattatctacctgtgcctgtttttttgtctgtgcgccctcggaaacaaggtagtcttgcaaagagaagaggtaagatgcaagtggagcaaaaccagcccagagtgggggattt

SEQ ID NO: 46493 - DNA, 1734 bp, Oryza sativa
ggatctgtattgacttgccaggctattgttaagagcactattggcattggtgttgatgaggaagacagaaaacgcacatgggttgccgatgctgaggaatgcaagaagcgtggttcaattgagacagcccgtgccatctatgcgcatgcactcagtgtcttcgtttccaagaagagtatttggctgaaagcggctcagcttgagaagagccatggaaccaaggagtctctttataatctcctcagaaaggctgttacctacaatccacgtgcagaagttttatggcttatgagtgcaaaggagaaatggctggctggagatgtcccggctgcccgagccattcttcaggaagcttatgcttctctccccaattcagaggagatctggctagctgccttcaagcttgagtttgagaacaatgaaccagagagagcaagaattcttttgtcaaaggccagggaaagaggaggcactgagagggtctggatgaaatctgcgattgttgaaagggagttagggaatgtagacgaagaaaggaagctgttggaggaaggtctgaagttattcccctcattcttcaagctgtggttaatgcttggacaaatggaagaccggcttggccatggatccaaggcaaaggaggtttacgagaatgcactgaagcactgcccgagttgcatccctctttggctctctctagctaatctagaggagaagataaatggcttgagcaagtcacgtgctgtcctcaccatggcaagaaagaagaacccagctacacctgaactctggcttgcagcagttagggctgaattgagacatgggaacaagaaggaagctgatgctctactagccaaggcattacaggaatgcccgacaagtggtattttgtgggctgcagctatagagatggtgccacgtccccagcgtaaagcaaagagctcagatgctataaaacgatgtgaccatgatccccatgtcattgcagctgtggccaaacttttctggcatgataggaaggttgataaagctagaagttggttgaatagagctgttactcttgctccagacattggagatttttgggccttgtactacaaatttgaactgcaacatggaaatgctgatacacaaaaggatgtcctacaaagatgtgttgcagcagaaccaaagcatggagagagatggcaagcaataacaaaggctgttgagaactcacatctgtcaattgaggcccttctgaagaaagctgtgttggctcttggccaggaagaaaatccaaatgctgcagatccctagtttgtctcacttttaacttttgataaggtattgcaatctgttatcattatactcttctgataaagaactttgctattgtgttcccgtatttccatgctttatgatgtctcatattgaaatgcttttcagtgtctattctattggtcagctataagatcttaatatttgagtatcatgtaataaatattgcgaagagttcttaatatttgagttgcaattaatttgtttgagacaagcagcattatcatttattttgttggttatcattaagtaaaccttagcttaaatctactaggtgcatgggtagtctaaaaatatgagttctgtatgtaaactatgcagaatctgttcatgctgtattaatctgctgtgcacatatgcccagttatctatgacatataaattataatcatgttgatgctgtcatggccttaa

SEQ ID NO: 46494 - DNA, 1770 bp, Oryza sativa
tcttgctaaatatccgagccagatgttcaccaacgaatcacctaccataaatggtctttccagaaatatcacaggtggaactttcacagcacgaagatcaacatctttgcttgcagtgggctgctcaaaagaaagagttgccaaagttatagctaacacttatatatagagtaacttaacaggtatagccctcgacacttcatataaaatagttcaaaccataagtcaggaactttactgacagtgctatgtatgttttgagtttgcaaacggccaggctccccgagatttgtccgccatgtgatctgaaatttcccgagtatgctgcttccctctgcctttgtttgaccagactcaccagacgatggtctgagttgatataggtaattgtatattcctcctccagctctgatgagaatcggttgcttgcacaagtccctatatgaaaaatagaactcacattagcaatccttttgcatcgacatgatatatcaacatccttgcatcgagacactatgttccattctccaaatagggtttgttatcagagctcaacttacccgattatagacttcactgttgacggatgttcatcggcttctaatcttgtagctgcccattgttgggaaggttcaaaatcaacttggtccatataaagattagattttgtatgattctctatgcaggcttccagataagtggtatcctgtcaaagtggactagctatatagagttcaagactgccatgatgaataaataaatgcacagtaaagggataaataacattataacaaacagtagtacagtagaatatatactataatatcgaaggaaacaaggccaaccacatttacatagaagtttgttcaaccagtttggaataaaccaaggataaagtataatgaggttccccaaattttatttttggggaattcaagacgctgataaacttcttatggaaccaaaaggatgattctgcacagatagaatggcaagtaaagaaagaaatggctaactggtaactgctgcgatgacagaacatattctaaaaaaaatgcaaatgtgacagcgtaaagttttaaaggtttccacaaagaaaccaacatttagttacaagacttacaatattgtttgcatttgtgaaacaagagggtacataccttgatggtgcgaacctgaaacaaaaggtgaacacagattatttatgtgacctactctgtaatccgaatatgctgggattacattctaagatagagggacatagagattatacatatggagtatagattagccatataaaaaatgagagaaataagtaccttcgttctaacagacaatggatttgaaacagtgaacttaaagaattgaggaagatatttacgctccccatcaccatcattatataaagcagtgcagacaagcctggattcaatcaccacatgagcaaatcaacaataaggtgtgcttcactaatgtctaatgcaaccaatttgtaaataaaataaaaaagaggatagtgtacgtatgtgctcccagttctttgacatcatgttccacaatgaaatcatatctacccccagatctgattgactcaacaggggccttagatgtatccaaaagaagtatcctctgtctctcggtttgtatttctgcctaatgtaaataaacttccggttaaaacttatgacataatatgaagaaatgaaggcttcaaggacagctaagtcctgcatgcatgccaccaaaggggtgtctaaagtatcaaatttg

SEQ ID NO: 46495 - DNA, 4175 bp, Oryza sativa
tattgttgatgctgatgtagctgcagaaggtctcccccaaatagatcgccctatcgatgcgtccccgcacgatcacatcaacacaatcattcgctgcaatctactactggaatggaagcgagagagagagagagacgaacccgaaggattgcgggaggacgaggaggccggggagcgcgagggcgtcgacggggtcgcggaggaggaagcggtcgcggaaggtgaagtcgccggggacggtggtggccggcgagtcgagcgggtggaggaggccctggaggaaggcggcggcgtcggcggcggaggaggcggaggggtcgggccccgtgagggcgtcctcggggaggaagacgtcgcgcgggtcgaagcggagcgcggcggcctggtcgggctgcagcgaggggcgggacagccgcatcacgcggaacgccagcgagtggttctgctgcagcagcgcctgcgccggcggcggcggctggtgcgcccccgccggatacggcggctgcgcgccggtgtagggcgacgccatcgccggagaacgagggagatctggggggctcgctctcgcgggcagtcgagtcgagactagttgtagttcagtttgccggttaagtttgagcaatttttgtatatgtatttgggacatttaatcgagactagttgtagttcagtttgccggttaagtttgagcaatttttgtatatgtatttgggacatttaattgtttgtcacttttaagataagttaactaatgatttatcaatcgttgtctataacatgtgggcaggggcgtacctatgtgtatctacccggtgtccacggacgtgttttaggtcatattaagcattatattactcaaaaataaacctataaacatatcaagcatccccggtaatttttgttctgggttcgccactgcatgtgggttcatatgtatctatgacatgtattcgagactagtttgttgttttttaaacaaaatggggaaaaaaaaaagcttggcgaggtaacattattagggcgtcctatactacttattcccaacttctctctccctcattttccacacgcacgtttcccgcctttatacccccaacaagttaatcaaataactttggatcattgttttttttgcagacatatattgccctcatatcttgtatattatattgagatattgtatattgaagtgattatatataatttttgacggtcatgaattattattttcatgcaatatgatattattgttctttgtctaaatctctactattgtaaaaattgaagatatttttgctgagattttagtaagtcatccgtgtttaaatcggttttcagttttaattgaggaatcggttttaattgaatatgttttttttgtccgtctatttttctcgccagttttttatgtccgattaggcttctttttttttcatcatctggtttttttatcaccgtatttttccactcagtccgatccaatctcctttttttaccgctcttagggcccgggccaaaccctagcaccgccgcgatctgcctccctgtacgtttcctcctattatttattgcaaaaatcgattccctacttctaactcattattttctccataattttctctttcaatttggttttaatttgttggatttaatctccatcgaagatggctgaccgagctttgcctttttgtcccgtttttttgtgaattctctctgatattggggaaacggggagaagagatcgagtggatcaaaagccctcaaccaaatcaagaaagattggttggatttgatgacgaggaccggctccggcatcatgcatgcataggatatcttccgaaggttgaagatcgcagtaggctatgtaagttgggcctatgactccacttatgcttgtggcttgggcctgtttgtgtgttgggccaaagagatataggccgagcgtggggaggtattgaactgggttatggctaaaaacaaaggaaaaggtacaccgaaggtccctcaacttgtcgtcgaattacaaaatcatccttgaaccgcaaaaccggatacaatgcatcccccaatttacaaaaccagtgcaaattaggtccctcgacggttttaactccggttttatcctatgtggcggttgaatcagcgtggaacccacgtggaccccacatgtcagggtcgccacgtcataatcctcccttcttcctcccttctctctatccctctctctctattcctcggctcctcccacgtccttaccgacgacctcggcgtcctctggatcgaccctatccgatacctacagaggccggccgtagggatctagcgctgtttctgatctcgccgggcatggattcgaggaggaagactaccctgtcgtcgactatgagtcagatcttcagaccgccatgtcgacaacaattagatatgctactccaaatattatactggtgtgattatggtgaataagagcaacgaccgcttcggccaacaggatgtagggttattacctgacaattcaggggcccgaacctgtataaaaatctctgtcttcgtctcttttacctcggtctcgcgtatatcctagtaccaacgatctccatactatgcaaataccggaatcgcgacatcaaacgtcgacaagtactaaatagtctgtcttttattaaaaagtaggaaagttgatttaaataatcatatcaatttatttctttaaattatttactaatatatttattagctatgccctaatttgttgctctgttttgcgtgaaagggacaagttctaggtcactagcatccaacacacccttagcatttctttattacacgactgaaccatatgcacgaacgcacagcactacgcatacaacaccacacttgcacactcgcaaatgcttctctaacacaattagaaactagcggcaaatcctattttcacgatatttatattgaaaaccaaattacgcgtacataatattcgtgggtataagatttaaatattagaccaccacaccgctgatacttcccaatttttagcaaattttgtagtgtgtatatttcgagaatatattttgttaagtttaagcaaattctgtacactcgataatatttttaagcacttgtaaatttttgcaagtgttctaggatgacagtattacaggtagctctgtaaatatcagaaccaagcgcagtttgaatactttctacccttcgaaaagattcgaacagaaattcaaatttcgtctttattttgtcgaccacgttgaacgatgatctaaagccacaagttgaacatagcatagcttatgagagaaacacccaattgaacatgctattacatacatggtcttttcaatcaccagcaaatattattgacatcaagcagtatctaacggagtttcttttccaatgttgcaaattagtacactacatttatgtacaaaaggatcgcacaacacaactgctgactctgacagtgtttgggcatgtcctaatcctgttttttcctaccgttttacacagctgctggtgcaatctgctctgactgctgcaggtaaactatgataccataccagggagggcctgagaccaaacaatctaaagttagatacaaaattgtccaaaaaccgatggcgcctacacagatttggccgagaaagctattggcagagtggttagtacggtgaaggtgtcgcccggaggcgtcaaattcaaacgactttcacccatgtcccaccgcacattgggcaagcatgggtccatcggctgatccaccatgcctcaagctcattcgacgtgttcggagctagagcaccaggctgagcaaatgcacaggtttgcctcaaacatcgtatgcactgcaaaagatagcatgtctcggtgtcacggcaaatggtgaattggatagagtgcgtcgataattaattctgaaagaatactgaagttagagactactactatcaagtatgcttaccttgtaccattcaccttcgaggcctgttttccacacagctgtaataacatctctccgagaacccatcacacctagaaaagatcccagccccacggatgttttcagaccaaagctgcatctctttcagacaaccggcgctttcttggccaaagattttgaatcccaaaggagctgtcgccatcctcttccatgtccgataagt

SEQ ID NO: 46496 - DNA, 1322 bp, Oryza sativa
ttgatagcagactcgacgccagggaacttgtagacataatctttctcccccatgacaacaaacactgggacttggaattttgcatctccaattggtttcctcttatggagagacctaacaagcatagcacaaaatctcgaactatcaaatattgttaagctcagtactacttagtatggacaattaatgacttgatgtttacctatatggcatctgtagtggatatcgaaaaccggatttctcatagagagatgagtatacatcaagatcctcctcagtaaaccactcaggaaggggtgttgacaagtctgcaagatccatgatctcttgatcttccttagccatggggatctcgctcttagaaaagagaatatagatagtgcgcacaactctcttaatattatacctgccaaagtcagcctccgctcttcctggttgctgcaagatgagttttttttactgtcattacaagcaaaccatgcacttattgttttatcatgacagtctgacaattaccgcccaacgaaaaatgtagagtccttctggcaaggtgttaatggatgaagcatcgttaccgaaagggatgcccaaacccatcacaccacatgtgcggtttgggtgacacagagcaaaatcataagctaccaaggccccaaaatcctttgcaacaaggaatgcctgacacgaagaaccgtataagttatcacaagaaaataaaaaaaaaaagaggaattggtttagtagggaataattgatatccttccatcctttatacagaaaaaaaagtgccccttaatatcttgtaatcatttttcaggcctctaatatactcttgattgttggtgctacatctaccagcttcagatcaattcggtagaactgatagtgttatcaattatcctctccaaatctctcccttacgatattgaaagtttgtttgtttggtcacaacctatccatgactcaaacaatacactacaaaaatccatcgaaacttctaaactttgtccaaccaattatgaattttgcctctcatttactcagtaactcaaagaggataaaatttgtgaaaaagccaaactgatccaggcgcttaccttgggcacggcgagggcgtcgaggatggcgaggagatcctcgatgaggtcgtcgtactccgccgcctccggctccggcggctggtcggagagcccgtacccgcgccagtcgggcgcgacggcgcggtacccggcggcggcgacggcgagcatctggtggcgccacgagtaccatatctccgggaacccgtgcaggaacaccaccgtcccgagctcccctgcatg

SEQ ID NO: 46497 - DNA, 3510 bp, Oryza sativa
tatttctaattaggatgtgtttagttcacgacaaaattgaaagtttgattgaaattggaacgatgaaacggaaaaaatggaaatttgtatgtgtaggaaagctttgatgtgatggaaaagttaaaaatttaaagaaaaagttaggaactaaaccaggccttattgtcttaaaatttgttctttttgcatgtaatcaagtgacccaagaggtaacgtgagtttttcatgtggttcaagatataattggaatttaaacgacacaacatttaatttatagatttgttttttatttatatatgtacgcttatagggtgtatttagttcaaagaatgttaattagttggattttcaagaatcatatagtaatcctagagtactaggataggtgacctccttaaaagtcctttgttgcatccctcttttgagaaacactcaagtagtcttccgactagctccacaaggtggtggaatagacgacctgggttcgaagcctcaccccttctaattatttgatattaggtccttccctaatattcgcgtttttttaatcctagttgggtagaatcgccgggagtgttaattagggatataggatcggatcctgggataacccaaattctggaaaatgtggcactaaaatcacccagattatcgggagtgttaataagggatataggatccgatcctgggataacccaaattcaggaaaatgtggcactaaaatcacctagattattggaaccctgtatttcaaagagtccctaagaacatcactaggagattatgtataatcttcccccaaagatttcttttttggcttattgaagtgaaaataggtagccaaaaaattgatctctccaagagaaagcctaaaatatcccaaaactaaaggtgggcacttctgttaaactaacaccaattttcccgttttcctccctctcacacgtgctcctggcgctcacatgcgctcgtgacgctcacccttgagaaaaatctcgtgcgaatgagagataggggacgacagacacgacgtcgctctccctcaagtaaatagaacaaaggatgcggcaaagggtttccaaacaattaggattcaaataggacatctattggaggcattatttttcaccaaaattccaaaaaactaggattgggatggaataagggaaccgttggtgattctctaagcatgtttttgtgtcaaagtactaatgccttgatttgctaagatcagggtataacattaacagccaggagaaaaaaacaaaaaaaatcttcccattgctgacaacactagccgcagacacagggtataacaagttcaaacataactggcgttgctgaaagtaacatcaaccataccagttccttcattgataattcacatcataatatcgaacaatatagtgttcttgtagcgaagttgtagtaagggtgaggcacaatgtggagtttctaaacagccataggatggtctttcaagaagctaagaagaagctcattcacaaactcagggaactgctcctgcacaaaatggcttccttcaggaatgtaggtgatctttaggtctggtgcatgcttctccatgctgccgtctttcataacagactcgataccaggtatcttgaagacataatctttctctcccatgacaacaaacaccgggacttgaaattttgcatctccaattggtttgttttgatgcatggacctaacaaagcatagcacaaatcccaaactatcaaacactgataaacttagtgttatgagtgctgacaactgatgaattgatgtttacctatatggcatctgtagcggatatcgaaaaccagacttctcatagagggatgagtagacatcaagatcctcctcactaaaccactcggggaggggtgtcgataagtctgcaagatccatgatctcttgatcttccttagctatggggatctcgttcctagagaagagtatgtagatagtgcgcacgactctcctgatatcatacttgccaaagtcagcttctgctcttcctggttgctgcaagacgagttcttccactgtcactataagcgaatcttgcacacaatattttggcatgatagttagagaattaccgcccaacgtaaaatgtagaatccttctggtaaggtgtttaaggatgaactattaacgccgaaagggatgcccaaacacatcacaccacatgtacgatttggatgacagagagcaaaactataagctggcatggccccaaagtccttcccaacaagaaaggcctgacagaagaaacatataaactatcaggagcaaacaacaaactaaaggatttttttactgaaggcaagacatttataagcagctggtttcattatggagaaattgaaacccttatcttttatcttttactcagaaaaagggcaccttaatatcttgcactcatttttcatgcctctaacatactcttgaatcttgattgttggtggcttggtgcttaccgacgtggtaccaactgaatactagactacagtactagttaacgacagaaaacaaattatcctctccaaatatctcccttgctgtgtatgacagtggaagtttatatgtttcgttacaaattgctaaccaggatgcacacaagaagtgaaaaattctgttttgaattatgccttccgtttgcaagttttatagcaagaaggccttacacagcttcacagtctgcatgcacgagtaggactcaaaactggaaacctgctaaaaaaattcgtaaaaggatcgattaaactgaggagcttacgtaccttgggcacggcgagggcgtcgaggatggcgaggagatcctcgacgaggtcgtcgtactccgccgcctccggctccggcggctggtcggagagcccgtacccgcgccagtccggcgcgacggcgcggtacccggcggcggcgacggcgagcatctggtggcgccacgagtaccatatctccgggaacccgtgcaggaacaccaccgtcccgagctcgcctgcaacgaccagcagccgaacaatcgttcacccgacgatcgccggcggcggcgaggcgcgcgcgcaggcaacgcaaattgaggcggccaaacctttgccggcttgcgcgacgtggagggtgagccccgcacggggaggtggacgtgctcgatctgctgctgctgctccgccgtggccatggcttccgggcggctcgagctccctcctcgccgcagaagttcagattgcagaggcgacgtcgtgacagtgcgagtgtgaggtggggatgcgtcatctctacgggttgataataattgtcgttttggataaggatacggtctaaaaaaacaactttgaccattattttttattataatatatatatatatatatatatatatatataaatgttaacaaatatatgattttattaatcaaagtgatatttgaaaaacaaatactttaaaaataattctaatcaactattctaaagtttgacctcacccttatctacaac

SEQ ID NO: 46498 - DNA, 2468 bp, Oryza sativa
cattttagtatttaaaaaaagattcaaccacggcccccaacccccaccaccactcccccgcacacgcacaagcacgcgcacacacaaaatttttgggttaaagtagacttaagtctatatttatttatttattgggttgatgaggctgaaagagggatgacagtttgagttattgtgtttggtacaaggatgaggaagggaggaagcacggccaccggaataatatttctctaatataagaggattaggtcaaaatttctctaatatgagataggtgatctacaaacatttctctaaaactaaatcaatcataaaagataagtacttattacagtgattgttaattttttaattttttatataattatgattaatcatccgtatacatagtaactacgtactccgtcttttacagtaagactttctaaaatcatggtataagttcacatcattggcttgcaaaagtcatggtagaagtatagcaatgggtttagtctttacattgctagtaacaccagcaggacaacctagatacaacaagctcaaataggcattactgaaagtaacaaactagccatagctgatccttagtttgttgacaaattcataccatgatatagcacaacgttttctaagccaacttgaactacgggtgaagcacaactgaggctacaatagcatttatataaccacaggatgatctttcaagaagccaagaaggagctcattcacatagtcacggaactgctcctgcacaaaatgccctccttcagggatgtaggtgatctttatgtttggtgcatgcttctccatagttccgtctttcatagcagactcgataccagggaacttaaagacataatctttttctcccatgacaataaacactgggacttggaattttgcatctccaattggttttctctggtgcagagacctaacaagcatggcacaaatctcgaactatcaaatattggtgaacttagtaccatcgagtacaaatatccgaagaaaatatttttacctatatggcatctgtagcggatatctaaaaccagaattctcatagagggatgagtagacatcaagatcctcctcactaaaccactcgggaaggggtgtcgataagtctgcaagatccatgatctcttgattttccttagctatggggatctcgctcctagagaatagtatgtagatggtgcgcacaactctctttacatcatacttgccaaagtcagcttctgctcttcctggttgctgtaagatatatttttctttttcatggtcattataagcaaatagtgcactaaaaaaattatcatgacagtttcggagttaccgcccaacgtaaaatgtagaatccttctggcaatgtgtcaaaggacaaaccagcagtgcctaaggggatgcccagacacatcacaccacatgtgcggtttgggtgacggagagcaaagtcgtaagctggcattgccccaaaatcctttccaacaaggaatgcctaacccaaagaaacatataaattatcaagaagaaaccaaataggcattatttattttcaaatttataaggagctgatttctttattagggagaaattgatatccttatcttttagacagaaaaatggcactttctttaaaggtaggcggcaaaagcattgccgattatattagaatgaatagaaaaatggcaccttaatatgttgcactgaattttctgaccttcaatacactcttggttgttggtgctaccaacgtgggttttttaccagcttcaaatcaattcggtggaactgatagtagtatcaactgacgaaaataatagcagacaaattatcctctccaaatttctaccttacggatcacgacactgaaagtttatgcgttctacttacaaattatccaggattaaaaaaaaactacaaaaaaaatcgaaatctcgaacctttgttcaaccaattatgaattataccttacattttacgagctatagcaaaaggccacgcactcaaaactgaaaatctgaagttttttttcttaatctgaagctacgaaaagaggataaaaatctgtgaaaaatcaaacttcatcgtcaccttgggcacggcgagggcgtcgaggatggcgaggagatcctcgatgaggtcgtcgtacaccgccgcctccggctccggcggctggtcggagagcccgtacccacgccagtccggcgcgacggcgcggtaccctgcggcggcgacggcgagcatctggtggcgccacgagtaccatatctccgggaacccgtgcaggaacaccaccgtcccgagctcccctgcaaaccaccagcagcccaacaatcattcacccgacgatcgtcggcggcggcggcggcggcaaggcgcgcgcgcgcagggcaaacctttgcccgcctgcgcgacgtggaggctgagcccacgcacggggaggtgggcgtgctcgatct

SEQ ID NO: 46499 - DNA, 3890 bp, Oryza sativa
gtactgcacctgcagtacgtgtcactggcatgtgggtcccacctattccgggcccacatgtcattggcactgaccgcacatacattacaggagaggatcccaactcacgggggaggtgaggtgagtcgcgcggggtcagatggggatgccgcacctgctgtacgtttttttttctttgtactggctagctgctggtgcatgtccaactcgtggacagaaggtggagaaggtttcgttcgtggtgtgtgaattatctttacgtttttaccgcatatactaccatcatccttaatatttttgacgctattaattcatacattaaaaatcaaacgttgttattatactcacttagttctaaaatgagtttatttttcatccatcccatacatactgacggagcgtggggctcctcaccgggagaccgcgcaggcccccctttgccggttcggccgggggcgctaagtgaggttcttcgccctcgatctgaggaacgtcagcgagagaggaagtgcacgagacacgggcgacgtagacaggttcgggccgctgagaagcgtaacaccctactcctgtgttctggtggatctgtatgtgaaggaatacagagagccggagagcgagagagagttcaggctctagaacccattcgccagagtcccaactcccctctccttttttttctctctttctaagcctgggcctcctttttctctggtcaggggtcaccacatgggcctctcgctgcctaagaagggaaacatgctttttacaatgagggctagtctacagccggaagtgacctctgacaagcagtgcgcacgcctcctgccccgctcgcccgctttcccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgctgcattaaatgcggcgtgacgcgctcgtccaacctgctataaatgcggtgctcacctaacccacacacgtggcgccaaaaccacagggggtcggggcgccccagccctcggggccgaaacgggagcggcccgacccctcggggagacagagggaggggtggccacgtcaccctcgggcccgacccccccgagggggtcaggccacgtgggtgaccgcggctacccaagcctctagtcacgatacccccggccccatgtcaccgacacataccaatgcgaaataaaaagataaaataccctatttatcaaatcccaaagcaactattctctattttatctactccgaattcaattattatctaaatttacaaatttagatgcaatgattacttaaaaaataaatttattttggaatgaatggaagaagtcaaaatatgaacttaatatcacacgggagagtagttcatttactaatttttccataatagaaaacggtgcattaaatagatcggcagatagctggcaggaagctagccctggttggtgctcaccatctttcttcttccttaattgagatatatttgtctccatcgattcatattataactcgtttcaaatttttcttatcaaacattatataaatttatccaaatttataaaaaagaatatggtaacacctataacactaaataagtttccttaaatttaacaacctataacactaaataagtttccttaaatttaacattgaacttgatagttttttcgaaaatattactatatttttctgcaaagttagttaaatctaaagaagtttaacccaaaaaaattaaaatgacttacaatataaaatagaggtagtactaattttaaactttaaaattattaaattacaaattattcccacggtcacattcactcccactattacacgtggattataaattgtgtgcgagtacaatacttgatcccaatattacactttgcttctagacgtccctattttattacgttaagatagtctatcttgtaagttacgtgactttattactaacatgtgagtgagtccagtaaactctagattcacatgtcagtgataaacgcgtgatcacttcgaaggtagagagaggatctcaatcggcggcaaccgggtgctcggtgaagaagccgaggaggagccggttgacgtgctccgggagctgctcctgcgcgaagtggctcccctccgggaggaactcgatcttcagatcgggcgcgatcctctccatggctccgcccagcactcgtgcctcgaaccccgggaacttcaacgctgtagtccttctccccaatcaccatcagcaccggcacctcgaacctcgcgtccttccggcttggcctcctatgtaccgccctgcacgtacgatccatccatggagacatgcaacgatcagcaatggccagtgacgatctcatgttcaacatcccggggtcataggatccatgtaaattatccaatactccctccgttttattttaaatgtaaccatgagtctgtataaaacataaatagttgtttatgtgtgacttatgtttttaatttttttttcaaaaattttttaaataagaaggatgataaaatcatggctgcacttaaaatggaacgaagggacaagggagtactaactaaattgcataatagtaattactactccctctgtttctaaatatttaacatcgttgatttttttaaatatgtttgactgctcgttttattaaataaatttaagtaattattaattcttttcctaacatttgattcattgttaaatatacttacaatcacaaaagtttttaaataagacgaatggttaaacatgtgctagaaagttaacggtgtcaaatatttagaaacgaatggagtaatatataagtcaataattaaataattactatctattggagccaggtaatttttttcgaggttcgtcgctgacaatggtggacacggtggctgcgccgccgcggcggcggcggcggcggcttgtgtacctgtaaggcatctggagggggaagcggaagccggagttctcgtagagcgaggcgtagacgtcgaggtcggcctcggtgagccacggcggcagcggcgtggaggcgtcggcgaggtccatgatctcctgcccttccttggcgacggggatgtcggcgccggagaagaggatgtagatggtgcgcaccacccgccgcacatcgtgccgcccgaagtccgcctccgccctccccgcctcctgccaccacacacacatcgcgttcgcgtcagcagcaagaacagacggcgacggcggcaatggcggcggcggcggcgagcacgtacgcgccagcggaggacgtagaagccctcgggcatggcgtcgaaggaggccggggcggggctgaaggggacgccgaggcacgccacgccgcgggtgcgcgccgggtggcggagcgcgaagtcgtaggcgggcatggcgccgaagtccttgcccaccaggaacgccccgggcacggcgagcgcgtcgaggatggcaagcacgtcggcgacgaggtcgtcccatgtcgcctcctcctgctccggcggctgccccgacagcccgtacccgcgccagtccggcgcgacggcgcggtacccggcggccgccgcggcgagcatctggtggcgccacgagtaccatatctccgggaacccgtgcaagaacaccaccgtcccgagctcatctgcatccagaaaaaaaaaagaatcaaaatca

SEQ ID NO: 46500 - DNA, 4240 bp, Oryza sativa
tataaataaaatcatcaaggtttggcaccttgcaagttgggattcagtagaacctgctcaatcttctagagaaactcataaaaatatccagacttctaaacatgacctatatcatcatatttatggattaacttttttttttcaaaacacaaatacatacgcctacacatacgtgcacactcactcctataaacaagctacccctacgaacacctccgaaaaccgagccggcgtatcttaaaattgatgaaatcaccacaagcgacttgttgtcgatggttacgttaccttggttggcacttgtcgagttaggtttcagttgaacttgctcaatcttctgcagaaactcataaaagtatctagcctttcgaacatgacctatatcatatttatggattaacttttttttttcgaaacacaaacgcatacgcctatatgcacgtgcacatttactcctataaacgcgctacccctataaacacctttgaaaacagagccgacatatcttaagattgatgaaatcaccacatgcgacttgttgttgatgattacgttgcctgagttggcacttggcaagttaggttttagttgaacctgctcagtcttctacagaaactcataaaaatatccagccttctaaacatgacctatgtgatgtactgatgttcatggattgactttgctgcaaagtggagtgaaatgcttatctttgcctgttacatgttgctgcttccatcttctttatcctcatttgtgactattggacgctgtgattagtgactataaccatgggtaattatagcttaaaataacttagcatatgtggttgaagattattgcgtttgataataattagatgtatttaggactaaccatcatattttgctgtaacgttattgtttttccggtctgcaaaaaattgaattatagacccgtcatgtgcattaaaatcttctactagttggttatgtacttacataccacaccggctatttattgaaatgcactgaatgtcaaactgccaacatttaggtggtgtttacatccagggacttaacttaagtccctgtctttagacactaatttagagtattaaatatatactgcttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaagcatccgatgtgatagggacttaaaagttttagtcccatctaaacagggccttaattaaagcaacatatgtcatactcgaaaagcctaactcaaacttccgtacaaactcgcaataaaaaacccaccttctaagcatggcctaaaccatattcattgattgacattgatgaactgtaacattagagcgaaaatgacattaggggcctgtaacctgttgacattctacagctgcttccatcttcgatcgtcatttgtgatgactggattccgacattttgaaattgtgattagctattacttttcaatttaagggcagtccaaacccatagtattcataagcagtgtctatagtgccatgtcaataagacatcacaatagaaactacactctacaacccatggattcttaaagtatgccattaataaatacatcatctcttttctctaccaatcatatttattcttcatctattatgaagacactattctctccaaatgtaaaacttgatagtgtctagtgcataggttctcgtgttgaagctgtgtcttgcatgagacccagtttcttcctctctccactctctctctcttaattaatatagtgtcacataaactaaaagtcctacatgacaatgtagttaatgtcatagacaccattctaggtggagggttagaaatgccctaaatatagtaaactaatcagattaaagacaacgctcaatcccctatacaaaaattcactcggtcgtgtctcatttattactcggtttctattttaagataatggtaattacatctttaaaatagtcaaggtgaggatcacgaatgccttctccccttcttttattgcaaatgtcttgatttgtttgcaaccatcaactgtcagtcaatcaaaatttgccaattgcttgagaatttctcaaacttttcattatacttagcatgttagtactatctttgcaactgactatcaggataaatcttaaaagacagactttatcaccttccaaaaaaaagagactttatcatagggctgtcaacgagccgagctcgagcgagcttacctatataggcttgagctcggcaccaactcaagccgagctcgagtcgagcctgtttaaactgcaagcttagaaatgggctcgagctcggctcgctcgagcctcgagctttcttgagcctaactcgtgtgccctcaaataaccaatacagatgaaaggaggctgcatgcatgcttgtcgagtactactagtactagtagctttttcaaacatgatatgacaactagtagtactattaaatagagctgcatgcatgctagtagtactaataggctagtgctgcagagtaaagtagtactagtaggctagtgcctgcacggtgcagccctgcacgctctgtttctatacagcttttcattgggagtaggagtagtactagctgttgtattgaaaatttaagaacttgacagagggaaatttgggctcgacgagctatttgagctcggctcgtcaagctcgcaagcttggagctaggcttgagttcggctcgaattgttgacgaatcgagctcgagccgagtctacagcgagccgagctcaagcagctcgcgagcttcgagctttttttacagccctactttatcagaatgaagcagatagtaaaacgaactgtttgctatttgttactgctggtttctttatgcaaacaattgcttcaaaccaaagcttcagcacatgtgaaagataacataaatcaatttaatgactgtatttgaacaagtaatagtcaaaatcgagtaatatagaccatgaaaattcagtaacgttatttgactgatgaacgtacagagggaatctttttcagttaacattttgcagcgttgcttggagtattaaaatacagacagcagaagacatcagcatcttgtctctggctaccacaaactgacaaaaacagcagaagacatcagcagaagatgcttcacacaaagtgtgcgcatctttgtgccatccatccgttactagcctgaccaaaagttcggcccataaattgctataatcctatataatctcaagcaaatcagactgacgttggagagaacatatcaatggatcagaggattgagcactcctacctgcccatcagaggcctgaagcttcacatagctcacattggaaaaggtctgaatcttacctcatttttgttgacatcagcatctctctgcttttttttgctcttccgaaagaatgcagctcagcttcttgatttggttattccaggtgaagctgcaactctgctcttcgttcatggcttccctgaggtgtggtactcatggaggcaccagatgattgcagcagcagcagccgggttccgtgctattgcacttgatttcccaggctatggcctctcggagccaccggctgacctaacacaggcgtcatggcagggcctgatgaatgacctcttggccattctagactcgctgtcgattcccaaggtgagtacaggcaggagaaaacattgagatccaataaaagtttatgcaaatgctaagatgaaccccaagtctctaacgcattttgataactatggcaaacatgaaataagtcagaagctgatgtaaattagaacttgccccattggcaaaattggttatggtttcatccatgcattattttacttgattattgataagtttgtaaattggcttaatttttgaaaagaagtactgtatcctgacgagtgacgatcatttcatggttgaaaggtgttccttgttgcaaaggattttggagtcaaaccagcatatgatcttgccctctgccatccggaccgcgtatgtggtattgtgagcttaggtgtgccacctcttgtggaaagcctcagtttcagtggacttcctgagggattttacatacacagat

SEQ ID NO: 46501 - DNA, 4687 bp, Oryza sativa
caccgacctgtatgagaaatcaggtctcatgactgctatccaaattccatataggtgagcacatgcaaaaaacacaacaaaatatgacaagcaattctcagtgtcctgatatgatgctattacaattactttgatacttgtacaaacctaaggatgttactaacacttgtgttgatttaataggaccaaggctgcaaaagcagaaggtgctaatccaaggtttgaaatgccaatgtttgtgattatgggtcagaaagactacatcctcaagtttccagcactgaaggaatatatgtcaagtgaaaaactgaaagaaattgctccagactacgggatcacttacatcccagaaggatcccattttgttcaggagcaattccctgacctggtgaatcagcttgtgatagacttcgtcagtaaacatgcatgagatagcaacaaaaacaaggtgcaatttgacaaatccccagactgcaaaaggtaacagttgagcactgcgttcactgatgtgcaccactaaagagttgacgttgtaacgtcgtgctcatgatggtatcgcaaactattttagtgttgtataaataaatgtgcaactgaagaaaattatcctctttttttcagatttaatactacaaatttgtaccacctagcaggatgtgatgcaagagctatttcaacttccagtagaataactctcttgtacattatgtcaacgcatggggcaaaagaaaatcaaaaacctggaaacttcaaccacaaactactaaaaactaattggtgtgccatgctagatatacatgaaaggttctaataacctgggtgagcctgctctggcatgtatgtacatctattgttttcagctaaacaccatactgaaacatcaaccatatactgacttgctaagaaaatacaaactccttttaatctcatgactttagcatggcaaaaatttggtgtttgctgaacttatccatggaggcaaaactatattttattcagtaaacaaatagaggcaacaaccaacataaatattatcatatttcaaggaactccctcaaacatgtattttacaaaggttcaagcttgcaccatctggatactgaactttacaaagacaacaaattacaatgcacacattactgggtacgcaagaaaacacaatacagctactttggatggatggatcactgagcatttgatcctaacaggatacatatatttatgatgcccttcaaagctcataggccgggaactttgattctgatgggctaaccatgtctagaaggaggtaagccatcccagccctcccttcaaacaatgaaaatgggtgatcacccccatgcatggccccatcagcaatcaactgatcagctttctcaagcagaaagcaagcaaaagccttagcccggtacaggtactcaacattgccagttagccggtagagtgagagaaatacataggcgttcccacttacaccatggcatattccaactctcttgagaagtccccggttccagacaacttctgcagcctctgcagccgtctgcttgaaatgttcatcatggaagacctgaagtagaaacattcagttatctatgttggatcacacgcggaatctaatcttcaaccaagaatttcacaagatgtcaaatcgctgacatttttgttgatgcagaaaacaaagctacaccatgtatgcatattgcacaaccaccaagataagtacacatagatgctttggataaacatgtgtacacactttaatgatgtgatgtaggcagtcacctgataagctttagcgagtgtaagagcaacaccaggggcaccatggcaccaatgcaccaagcggtcagattcactgccttcactcgatggatagttgccagtaggatacctgttcctgatcatgtatagcagagtgttcttaacatcatccttctcatctagcttgagttcagtgtgcatgaggacatgcataatgccagcaagcccatgagcagcaccccagtacttctttccatgccattcatacatcagggggcagttcccctttttagccagctttcttccctcatcgatgatgtcctttgccacagaagtctacacagttgcagtaatttcacaaaattaggtaagatgctttctatagcactatggaactgacaatatgaaagaaaataacagaatcgcagtacagacatacaatgtgctcatggggaattgtcttctcgccgagatgcgtattcaagaacaagcaagcccacaaataccctgctcttccatataacaactcattgggaactttctcagtgactattatctacagaagtacaaacaaagatagctcagtctacaatgttagaatttagacataacatctgctgttttacagccatggagcacattaggacagaaatgtgaacacatgcattggctcctcacctcatcaaatgagctcaggtagtgtgtgagtagcagctggtcattgcaatgttttgcaatcactgcaccaagagcgcaaaccccagccctcccacagatgaatgtcaagaacctgcgtcttaatttaacaccaaggaggccatgacacccaggtgtatcaactcatcaactggtagtacaagattatctaaccaacagaagtacagaacgaaaacaaaaaaaaggctcgtcgtcttacggcaggccacgcgacgcggcgtcgcactccttgacgatgtcgccggcgagggcgaggtcggcgcggttgccggtgacctggaaggacttgaacagcaggagcgccgtgccgagcgcgcccgtgtagagcgtgtagtccgtcacctgtcgccgcgccctggtccacgtctcctccatgacctgcggggggggcagggagcggtcgggggaaatcagccgaacaccttgcgtgcgtgcgcgcgcgcgccacccaaacccaaacccaaacccaaaccgaggcacacgcatgcctaaccttgtccttgatccggagcgcggcgcggaggagcctttcggagaggctggagtaagggagcgacagcaagccgcggccgccgtcgggggcctcggcgacgaagtccgggaggtcgttggggaagtagcggtccgccatgcccgccacgcggtgacgcttggtggcgcgcgaggaggaggacgacgacgtcgacggcaactcgccgcgcgggggggtctcgagcggcggcgacggcgagtctctcctccccttcttgttcccaccaccaccgtttcccatggccgccgcggctggggctttgtataaaaaatgctcgcgaatttgctggagtcgccgcggcgctgggcgatgacacggtggcacgcgcacgtgtactatatgtcagagttgagagctacacgtaacacatggagttcgtagcctcaacggctactgttttcttgtacacttccttttttactaaataattttacgaaaattttaagtttgtcagttggatgataagtttttttttcagaagtcaaaataaagttcaagtatccaaaccccaaatcccaaaaaaacaaatacggctgtgtgcagtgtgcttaccgtgatgaaacttgctggctcgttggattcgatggcggacgctcgaggaatcacggccagatctttgctctagccacactacttactcctcttcaccagcctactccatgactcaagccctgacgaaaggaacaaattaattagaatctggatttgaaggaaaggaaggaacatatggatctaaataagatgaaggggatggagatgatttaggaaaaaaacagattgctccatggcttgagcactcatcagtgaaacagattacttgtgtgatttaaagaaaaaaaagaggatctgaaagggatggagcagaagatgaaaaaagctaatggaataaagaggggaatagttgcctgttgcttggagctgcacgggagaatgaattggagagagaaaagaggaacaagagaggataataaacatgggagcctcggagataccgagcttcgcgcgtttttttccagattgttcgcgccaaaacgtcaaatgtttcgcgctattcacaaaaggattttcacgccgttcttcacgaaggtgagtgtagcgcgctctctctccgcacgcaacagtcgtgccgcaagcgtggcgaataatttgctcgccgcgtctttgcccaaaaaaccaatggcaaagcaactgagttgtggcagactatttgtagcagccaaaaatctggtctctaaacaaacggtaggctaagcaggtgtggcatgcctaatatgtggcttggcaggttgaggcaaccatccaaacagcccctacttcctccgtttcagaatataagtcattctaccattttccacattcatattgatgttaatgaatctagacattttccacattcatattgatgttaatgaatctagacatatacatcaatatgaatgtagaaaatgctagaatgacttacattgtgaaacagagggagtacctctgaaacaaaactttctagcattgccacattcatatagtagatgctaatgaatctaagcacacatatatatctagattcattaatatatatatatatatatatatatatatatatatatatatatatatatatatatatatatatatatatatatatatatatatatatatatatataaatgtggacat

SEQ ID NO: 46502 - DNA, 3322 bp, Oryza sativa
taaatcaaacaaattttaaatgaatcagaagggttgatcacagacatttgaattgcgtgaagaaaaaaaccaagtgaacagacagtgctacgtggaggaaattgcagagcagctcactcgtacctctgaatctctagtttctgatgtctatatcttgtactcatgaacacgcatccactttgtcgatgaccatttgttaccttttatcactggacatccacctagaggaagttgaaggtaaatagaaatgtcatcatgttgtggcataaccattcactacaaaacaatttgacattgtaccaaagtattggaatctcaccatgaaggcttgtggcatccaaagacccatcaggcctcatgctccagaaaagcaaagcatctcccatcttgggtttgacagccaaacccttcttagcacattcagacagctcattataaaatggtgatgagctgctgttagctttagaagaggggaaaatagtctcaccaccctcttcaacatcagaactaataaatttcaaataagacaaaaacaaatgtcaaatgaatcagcggcgttgcattatataagaattaccaatattatagtacatacagatacataagaagagttgctatacgctgccccccgtttttggtgttgaattcatcatggaagtaatcgaagtgaggttcatacttctgtccaacttcatagtggaggacttgaagaccctctccgttctctgcgaaattatgagtatgaacagaaaggaacaacaacaacatttgcaacaaacttgaaataaaaaaataatgtgatttctatgataaaaaatttgttgcacttgatgatagttgaatatatttaggaattattaggactatccatcagatttggttgtaataataatattattattcctgactgcaaaaaagaaaaaaaaaatcaataccggccatgtacattgcatcttgttggttgtgtaccttactgactatttattgaagtgcgccagtgtcaaaccacccacgtttaataactcaaaaggtatatgtaatgtttgaaaagcctaaagaaatttgagtacataataagtacaggacatttcagaaattggtgtgtagatctttctgggtttctgttcaagtatgcactggcccttttttgtaaatatgagaagtttgactttcacatgtactacaacatgctcattatgtaccattgtacttgcaaaggccttgtgttattggtcacaaatgtcagctgccgaacagaattcaaggaatgacagggctcaggggtaataaaaaaatctgataacagagactttctagctctaatatgctctcaatatagggtgtgtttagttcacaccaaaattggaagtttgattgaaattggaacgatgtgatggaaaagttggaagtttgtgtgtgtaggaaagttttgatgtgatggaaaagttgggaactaaaccaggccatagtaactcagtaaatctggattattgtgcttattgtgtttttcttggtggttctgcttattgatctggatttataaaacaatagttaaagtgttaaaccattactggcaagtgatctggatttaacatttctctatgggcgttgctctgctaatatcagatcaaaaggagagagcaagagcagtacaattgcactctgtaaaggcaatgctttttcatatttggttccacagcaggtagctaagtgttcaaatgcatcactataaagtgtaagttttggtgattcagtgacataaggtattgcaagataaagaaagattcaaaaccttgcactgtttcatgatatagggatatcaattatctgtattagggccaaggaacgaagtttaaatgtatggtttctgcaatgagtaaagttctgcactttagcaaaaggaaaactgcactacttattgtatttttcaggaggtcgataagttgactgtgttaaaggtgccatacctacaggtatgaaggtgtagtgtgatatccttttgtcgatcgtacggataattttgtcctgccctcttccaaggaacattcctgaactcgttcgaaccctgaacatgtgacatgccattaagcctaaacgagttgtaattgaggtaacatgttttcaagagaataatctacgatatccaaacctgctatctttactccctccagttgatgcatcaacaacagtagatttcttcatgtgaggctttgccaatgaaatcagatactcacattcttccttcgactgagaaggaagagaagttagtcatttcttgatcagtaataaaccaaacaagagtatatgagtagttgcagtaaaacaaaagttgggctccacgcaagctcatcaacaatcaacatgaacttcaattttattgcttgaaacttaaaaaaacaaagattgaaactgactaagaatgccagtgagtattgctacaagaatactctctaacctcaaaaagaaataaatagaagacgacaaattattcggcgcagctcaaacatcgagacaagaacaacacatccatgtacaacaactccctctgtaaaaagtgcaatgccaatggtgcagctgctcagatctggaaagcaatcccactctgcccgtctctgattcacaacaccactaaatctcacctggcattcctacatctaaagcaagacaatttccaaatttacccaccccatccagattctttactccaataaggaacaagcgaatctcccaaaggacggacggaaatcgatcatatcaaccaaaaaaagaaaagaaaacacctaattagagggttatttgaacctgaaaaaaaactgaagatctcatcaagcaatggagtgaaatggcgtcgtagaatgaacatatcatccaacatgcgcggtttgttccccccaaaaaccaaaagagaacaaggaacaaggcaaagaaaaaactcacgaggaaattgtgatacaagaacgcccggggctcccacgacagcacctccgtccacggctcccccttctcgcccccgcgcatctccagccccctgcacacacgcacgcacgcacgcacgtcagccacacgcgggggatcccacggagagaggggatcaatcaatcacgggggggcgggcgggggaggaattcaaaaggaacgcgcgagagacgacgcacgactcgaacgcggcggatctgcggaagcgcgggcgcgggcgggggaggccgatgccggcgtggccgacgccgacgccgccgcccgagggcagcgagagcgcgccgagcgccacgaggaggagcagcgccaccgacgccagcagcagcgccgccaggatcaccgtcgt

SEQ ID NO: 46503 - DNA, 7792 bp, Oryza sativa
gaccggtttgggtttagcgctttctctctctttgtgacctgtggaggatggagtcgtcggagatgggagatgaatgaagggagctggctcgggtcggtgtggtagttgtacggaaaccgctgcgtctctgcgtgacgtgtccgccggggggagatgtgggcccggttttttttttcacatctctaaactttaatttcatttttggttagcacgttttttcgaattgttaaatggtgagtttttatgaaaagtttctatgtaaaagttgtttgcaaaattcaaataaatctattttttaattttataataactaatacttaattaattatgcactaacgaggtttctcgatttacatgcgccgaaattttctagtaaaaaataaatttaagatgtaattacattgaagtataataggagtgtaattacattgtaactatattttaaatgcattgtaattgtaatataactttattgtacctacgatataatttatatgaaacttgtattcaacgatggtttggttagctagcactgagatatcacgcgtgacatgtgtaaaaatttctttctagcaaattttttctttatacataaatctcaaggtgatccgatggtcataaatctgaaagttttggaggcaaaaaagacttgtggaaattttctagcaaattcgttttttgatttttcttttaactttttaccttgggaaatattttttagaaaaaaacaacgctacacattcacctatgcaaatgcacatagacgtatcctatcccaataaactctcgtgagattgggccggcatatgttgggattgtcagaatcattataaatgactcgttgtcaatgagtatgccgaatcaatgattagttatagatgtgagcattgagccaagtctaaaacttgaacggtagcagtaacttttttaatataaatactaatgaaaaggaatcctttattagtttcgttgtgtgatcaacgatggaagtgctgaccttcgaagcaagaaaatgtttagccttctgcttcgtttaattatcatgtacttcctctgtactcctttgtactcgtaaaggagatcgtttaggataatgtttaagtcaaacattgagaatataaatcataaataactcttatgttgttgagtttgaaaatataaaaattatatgaaatatatttgttttgaaaaataattttcataaaagtatacacatatcacttttcaataaatatttttatagaaataagaaatcaaagttgtgttttggaaaccgtgtcactgtccaaaacgacttcctttatacttcctttataagtacggagggagtacattacagtactgaccactgaatgctacagcgtcatatttaaagagaagctaacggagtattatatgaaaaagtcttagtgtacttatatactctctctgtttcacaatataagtcgttctaccatttctcacattcatattaatattaatgaatctagatagatattgtctatattcattaacatcaatatgaatgtgggaaatgctagacgacttacattgtgaaacggagaaagtagtataaattgtcccaaataaaaaccaaagaaggttcatgtgttagctgccaaatcttcagtcacatgcttcaatgccaaattttcgccgtgcaggacaggcctgaccaagcagatatttttttttttttggagaccgacgaccaagcatattgatttttttttcttttcagaaatcattgtttgatctgatacatttggaaggtggtgaggttgctgaatactgagcttcaagctggggcttgcttcgagctgcaactgaccaacaaaaccaacagttaaaggcgaaccataagtccatgacctacattatttttttgcgggtttttcattttgtgtgtatttatttcaagccactgtatgtttttcatcttatgggtattatggatggtagtacattttgtcctctgaaaaactgatccctgaatgcttagagttcagagtagcagcatcagtcccactcccatgaagcttggttcagacttcaaagcaaaaacatttgttcttgcatgaatttgcaaaatcaatttgctaaactgtactttccgctgtactccttcggggtttctttttatgtccttcgctttattcaaaaaaacttcaagcatggaaaaatatgaatcatgttgtttgtttaaaattagagacgaatgtcttcaaaatcaacggcggtaaacattaaaaaaacagagggattagttaggttgtttctctaattttcgagttacatattctgtcggtcttacactgtcgtttcctttttttttttttggcccctgccacgaatctgctatggatttgatatctttgacaccatcgaagttaacataggcagaattttatctacaagcaaaataacagacctctgacaatcttaatactagttggagattcaatttaattatagttacttctaatcttcaataggcaagacaatacactttattcatgaccccataaatatagtaatgcgatacaatcatcttgacgatcgcctctaagccgtaatactaactggatatgcatccggaggcggcatcacacagttatcaccgttgaagtacacacggactgggaaggcccttcccttgttattgttagtagtggaagaagccctgaaatcctttctcacaatcagttctccttgcacatttccaagcggaccagcttgcatgagcaaatcatagtagggctttactccccatagcatcgtagtatcatctaacatacaaggagaaaaaaaaaacttcgtgagcaaaagatagagagatggtatatacaccttctgtccttaaaaaaaataaattttggctacgaatctagacataggtcagaagtatatatacacacacatacacatgcatttttttttatcaaaaaaggatggttccagattgacttacttattttgccgacttggattgacttgtaattgaagccagatatctgggtgatatcgaggatgggatgatactgaacaaccaggttccattcggtgaaattcatgcggtagttcaagttagtgacagtgattttcactctgtagtgttccttgtctttgagcatcaagtgccagttaattttcactgggcacatgtgtgaagtgcactggagaagaggctgccaggtccatctgccagggccgtgaatgatggattgcaaatcaggtgcattcttcctgtcaaatgcaaaggaaattgttacaattttttggtgaaaacaagaagctaggatcccagtggaaattgtagttaagatcagtaacagttatattaactcactttacacattttcctgtagtagatttttcatttcggcagccacaagagcatgttgggcagtcaacagttttgtcattgtcgaacgacgagagagaaacacagcaggatggaaccttttgtgcaagaaattgggagtatgtgcagatcacattccatgtcactgtgaatagagatttcctttttgttaagaagtactactagtagtactgaatataggaattttttctactatagaactcaaaacaaacaacaagtcctatatgtaatcatggggatgtctgtctgaatttgacatgtattagttgctagataacaaaattgattaaaaaaaagatgacaacatttgttaagtaggctcagccttgtaaagcctagcatgctgtaacttgttttcaactaatatcagatcaaccagtcttaggtgaccaactcctgtcccttcctcactaaacctatgcctaatccaacttagcattaagaaatcacaactgagtctatgttcctaatgcatttccacatgacatacaagcaattgggcatcaagcagcaattcagaaaaagaacaacagatggactacttactcagaacttgagtcgccctcctcccatccggacttaaaaacctactaggcttcacaatcatagcacggctacaggtataccccggaccaggcgccataagactgaagttcttcggcaccctaacagtctcattgctgttcccagaatggcctacaatgatctgaaacgacgcggcagaatttgccgggtcctggctgaatgcgctcagtgatccagccttgcagcagttggcgatctgcaggtcgattggggcgcccgggaggaggtcgacgacggtgggatgcttcttgcagctgtgggggacattgctgccctccttggacatggagcagtcgccctgctcgatggcctgcgcgccgtacatggaccagatcacctccttctgctgccatgtccaccccagctgccaccccggtggctggatgtgccggaattgctggtagttggacagtgtgacaacggcctgatgaacaggggacgtttcagaggacagatctttgatacagttacaagagggaaaccggattcgatatagattttgctcgttgttattgttgttgttgtttgcgacatactccctccgtttttcaggttataagattttatagcattgcccaattcatatagatattaataaatctagacgtacatatatgtctagattcattaacatatatatgaatgtggataatgctagaaaatcttataagatgaaacggatgaagtatacatgaagagatgtggctatgctgtttaacttcaagtctataagttcatacttcctccgttcagtaatcattagacgctttgaataagatctagtgtagtcaaacttttgaaaccccagccttcaatataacttataaaatatactacttaatagtatcaaaacataaaaccatgtgtagctttcctaatctctagaacttaatagattttaaaacatcaaatatatttttttattagaggtagtagaacaagatagtgtaaatgtacaggttgagacgaaaataaaggtagagatgttggtgtactgccaccgctacttacagcatagccatcaggagtccattgcatcacatcccattttatcgtgatgttgccgtttggatccagggaatcataagcatctgcaagagcaacaagccaaaaaagtgatacacataaaaagaaaaatccaaaacaagaaaacaaaatggcttaggcattggttagtgtcacgacagtgtatccatgtgtgagtgatctttttgtcagctgcggctcatttccaaaaaaaaacaaagaaagaaaaaaagaagaagaagaagatgggcgtgcttacatgtggtggccggagaggagaagagcagcgccgccgcgagcagcacggcgcagcagccaccaacaccaatcgccatctataatatatggctatatccttcgccgctacgaactctaactccggcgagcgatgactcggtgtgtggggggtgtgaggcgacgatgtattatatatagccgcggccaccgacggatctcggccggtcgcgtgcgttgacgcacgcacgcgcgcgggtcgtcgtcgccgccgccgtcatgggcgcgccgcttgccagcttgttccttcctgcgcatcttcgcgtcacgcggcgcgcacgcggcgcgcacggcgcttcactggttgtctttgtcaggcaatgcgcgacaagggttcacaatctcgataccggatcaaaaatccactcacgagcgatatcatcggatttcgctgaatccgttgacaaacctaaaaacacagacgaaatctaaatagatttttgtcaaaaaattaaaattcagtttaaaattttctgaacctgacaaaaagccgattggtttgtgtttttaactcaatccaataatgtttggattctattggaattgtgaaccctgccgccgaccactgctagatgaagtagcggaccaccggcccaaccgaaatgggtcgcacgtaagtcgcaatcccgatccggcccatctacaacgggccgaacaatcccgatatagatgggccgtacgcccgttgctacagtttcggcccaagatcaagaatgggccacacagcgtgaggtcgccgccgcatgtcagcacaactaaacagaagccggctgcagccatggtacttaatgctcgacctcatcaagtaaattcgacatacagaacgagcatctacttgtccaagtgcagctgaacacgtcagttatgtacagtacatgatagatctcagcaagaagaaagcaagtcgtagtactagtagtaaatattgataggttccatgttggtgattctagaaaagagacagcggttcgtactggtaatccaagagcctcctaaacaaaaaaaccagaagaatgaaaaaatggaacagacaacgatctgtacaagctgcttgactagcaaacagaatactgaatgggaattacaggtctccgggtatccatcatcagacactgtgctctctccagtctctaccgccatgcagacctacaatacaaaatgcaatgccctccagaaatacccctttttctctgccaaccaccatgttactgcatagagttttgaagccattgttcttgactatgatcaccgtcttcttagggttgaaaccttgctgatggccctgagtcccttctatcgccacttatctcgaattcgcttgagcttgtcttggactcggtatctgcattggcagtgttgcccctccggctcctccggtccttcagtaggattacagcaaaagcttcagatttattgcaatgatataatatgatgaatgttattgcaggaaaggagaaagcgttaccacctcacgggatgggacatcttctgcctgagcatccgaacaacatgacccatagtaggtcttttctcagagtctgggtcgacgcacctcagtgccactaggagagcacgcttaagagcccgaatggtcggtttgacctccatgtcagggtcaactacctcttcagatcttcttgtgccaaccatcattttgagccactccactagatgcacctgcaaggcatccacgttacaatgttgttatatatgacaaggtatacagctagtcagctcctgaaaaataaaacaatagactgtaaaagtgagacaagggtaactagacagtagacaactgccagacagccatacacctgaagcaaattcgtctctcctagtatagacgttattttgccgtaaaataatttccaatagtacggacttttgtaacatacataatacgcatgagattgtaggatatatgctcacctcattagcaggccggccataatcaactggatctctaccagtcctgcttccagtaatagcacaccaaaactgtagacatcactcttctcgtttaacagacctgtgttggcatactcaggggccacatacctgaaatgaatcaatgatagcaatgagaaagctacctgttataatatacgaaggacaaagttcgcagcatgtaaaattttatattgtatgaataagcgaagtactgcacattccaacagtaaaagctaagcataggaaagattaatactaactccaaaaaaatatcaacatacccaaaagttcccataactcgagttgtgatatggctcttccctgcacccagcatcttagccaagccaaaatcagaaagtttgccattgaattcttcatcgattagtatgttgcttgatttgatatcccggtgtacaacttttggctctattgcttcatgtaaataagcaagcctgtataccaattcagttatggaaaatgggttatgcaactaaacatatacatataaaagagctaaagtgaagaacaattcttttctttttgacggggacg

SEQ ID NO: 46504 - DNA, 12930 bp, Oryza sativa
aaccacataatgaattttgtttatttctatctttgaatgttagcatcgtttttgtttaatgcatgatcgccttcctatatatttgtagtatgtcaacattgtattccatgctgagcataacaaatggtttgttaaaattcaggactgtcttaaacggtgtgtggatttggtgaaaaaaggagcatctgtatttttctttccagaggggactagaagcaaagatggaaagctaggtgcatttaaggttcagtaaccaaacttaggttacattacatctaatgagatttttatattcagtatataatgttaaccttctcatggtgtactgacgtggttataaatgtccccagagaggtgcattcagtgtggctacaaagaccggtgctcctgtgatacctattactcttctcgggacagggaaactgatgccttctggaatggaaggcatccttaattcaggttcagtaaagctcattattcaccatccaattgaagggaatgatgctgagaaattatgttctgaagcaaggaaggtgatagctgacactcttattctaaacggttatggagtgcactaaagaaagatggtgtttttttttattatatggaacctattcaaaggcacagacaggctttcaaggctaagcttgttacaggtactgatactagttactaattactttcgtaatcagtataaataagcttgtgtagtgtaatggcattgtacatttctgcacttggtaaatttacagaagaggcaagtaatattttagaggattgagtttattcacccagtcatatagttgaagaggcaagtaacctgtaagagaggactgaacattaacacctcttgttcgattaaaaatgaccaaagagcatcaaacatgtattcgaggctgttactttagatatggcccattaatttgtttagttgtctatgtacatcctagttggtgtaaatgccagttaccatttctatgatctaaaacaatcaactcttttagtatattttcaaaaacgaaaattcagtacacatgtatgaatcttaatattcttctctagctcgttacaaaagcaacaaaggcaccgtgtcagctggttcacattagctagtttgtacttagcattatccactagcaccttattttcatgcatatcatgctaatttgcttgcccacgttgagtgggaatttttttcatgttttataatttatatatgttttagacttctagtccacaatttatgtacttcatgttcctgagcctctagtatggctgatagcagactaggtgctgagtgctgtccttttttgcagactgaagagagaagaaatacaagactgtccattgttagtcagatttgtaaaaatagactctgatgtagtttacttttgcccctattttatttttaacaatacaaatatataacagatcctaagaacttatcttatttaggagaagttgctcgtttcattaaattaaattgtgaagtaaaaatgtgtgctcgagtctgtcaatgcaatcctgtgttcttgtttgaagatatggtgtagggcaggccaggattgaacactgaatggtaagactgcttctgccttcagacgttattgctaaatttttagctacttgcagttagtgctgccacgccgattaagcagtagaacaaagtagttttgtcgtgcacaaatgagttatatttcattggaaatcgaagcgaaaacgaatcaaaagttagaagaaaaggggaaacttggtaattactccataaagagagtgcattttattggtaagatggtatccggaagctgtgagctccgggctgtatgtattctggcaaatttgatatgagatgctcgattattggcttaagttagcgatatcaaatttggggaagcaccaaaggaattattgtgaaggagttatgggtgcgtgacgttatctgctaggttcaaatccttgtggctatgaatatttatctgctaggttcaaatcctagtgactatgaatattaatgggtaaggtaagggatttattgttaattttagtttctttaagattgtgccatcggacgccattcggtaactgtaataatgctttgtattggattcacttgtgttacatgcacgcactaaacatgtgctttaccttttcatctgtttttgcgttctgggctagaaactcaaacgttgaattttccatggtctgctcaacttgacaattactgcgtgtcaagcgatcttatacgcatactatgcgcacaagtgattgtatacggatatgatgacagtataacgtgtgatattgatttttttaataaaaaaatgatgttcctttccttgatgaaggaacaaagactttttttaaaagaagggtattactaaaaacaaaaatgacaaaaacaaaatatcagtgcacatggcaagtgtgctcggcaattttttctctgtactttaaacaaaaatacttctatatgttcttttttataagggtggcacaaatcttttaaatgagccaaatatctacattggatttattaaaaactgtataaattataatttatactctgaaaggttgtgtgcatctctcttggagaaaatgtataagttgcaaacaaacattaatccacgttatgtaactttttttcgccggaaaggccgaaggaggcctgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttggggggatctgtgtatgaaggagctacaaagtatgagccagcctctcccttgttctgggttccgaatctggaaaagtccagtccagtccccccctctaagtgggcaaggtcctccttttatatcttaaggggataccacatgcaccatctccctcctttctgtggggacttaccctaccttttcataaatggacggagatttgtatagttgccgtccgaatgaccttctgataggacggcccatacctacctccacttccgccgaaagcaggtgcgacgtgggattatggctgtctgctgacgacatgaccagtgtcagactggtcacaaattgctcattcctgtccaccacgcgtcagtttagcaatctacatgttggcccttcttcacacaacatcttgcctgtaatggttaggatgaagcctggcatatatctaaccaggactaacgtgccatctctaggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcacttcgttacatgccgcgtgacacgctcagccaaaccgcaataaatgtggttaggtgagccccggtgtgctgacctaacccatacacgcggagcaaaaacccacgaggggtcggggcgcctcggccctcggggccgaggcgggtgcggtccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcaatggtaactctactatcaataatgagcggtctcttcaagactgccacattactcgagtagcacacgaatctggacatggcgattcgtttcgtctggagatatggtaacgtcgctttggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaaaggatctgtttccttcctttcgccatcatttcccttgtcttcgccgcttgcgccctaactccttctttcctgtgctctactttcgccacacgcgctcgctctcaatcttctcttcctccggcgccatggcacggggctccgctctgctcgatggtagcgtgctgccgccttcccgcatcgtgagcgagaggcaggctgggctgccgcgccgcttcatgccggaatctgccaccggccgggagatagtcacgctgggtgagggacgcccggcgccagactacccggggcggtccgtcttctttctcccctttgcaatggcagggctggttccgccattttcttctttcttcatggatgttctgaagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccatgggggccggtgctgaatcgctacatcccctgcgccctccgcaagaagtgggacgactggaagagcgactggttctacacccccctcgccgacgaagcgcgcctctgacttccgagccagcccccggcgcaggcctccagctggcgggcgccggtagatctgggggatggctatgacgccgtcctcgaccgcctggcgggcctacgatcccaggggctcacaggggccatggtgtacggcgactacctccgtcgtcggattgcgccgctccagcggcgcgctcggggcgcctgggagtacaccgggtccgaagactacatgaggacccaccagggagtcagatgggactgggctcctgaggatttcaagatagtggtccaacgggtgctgaatctcaactccatggaggcgtccctcattccccaaggaatcctccctctctgcagcgatccagaccgcgcctccatcctgaccattatgacggcggtcggggcctcagaggagtgagctccaaagggccacgacggcgcaggcgggagccgtaggggggatcaatctaccccgggagggggtcgtgcttctgggtctcgcgacggaggcccgaggagcagccgccctgccgacgcccgggggaagaggaagcagggaggaacacctcccccatctcctccccgagggggcggggcggtgcgtgccaacagcaggcgcccggagggggccgcgccgacatcgcagcccgagggggagcgcaagaagaagcggctccgcaagatgggggagacagaaccatctcggggaaaccttatttcccctccaaagtggtcgtttaaccgaccccctcgcaggttcgtctctcacccatcgtggctgtattcattctctcaacgcgagttttcactcacccatcttgttcgtcttctggtcttttcttctgtttcagcgagatcccgtcgcgtccctcccgccattccaagtccggccagtctgaggccgaggatccggcggccgcagaggcccggaggcgggaatctgaccggcgagaggccgcggatcgcctacgggaagccgaggaggccgcccaggaggccgcccgggctcgccagggcgaggaaaccgctcgggaggaggccgcccgggcccgccaggccgaggaagccgctcgggaggaggccgcccgagcccaccaggccgaggaagccgctcgggagaaagccggatttcgccaggacgaggcaatggcgacttccgaggcagctcgcgatgaggtcgcgggcgcgtcgcttgagcccgcttcctcgggcgacgctcaggcgacaacttccggggcagctggcgacgaggctgcgggcgcgtcgcttgggcccactccctcaggcgacgcccaggaccaaccaggtctgagggacatccccgagtccggcacttccatcggcggcccgagccgcgtggcatcctctccaaggcggctcttccccacgccttctatcgccccgctgagcgcagagccccttctgcaggccttggccgccgcaaacatcgcggtgttggacgggcttagtgcccaggtggaggccctgcaagcagagtgggcggagctcgacgccgcgtgggcgcgtgtcgaggaggggcggcgctcagtggaggccatggtggaggtgggccgcaaggcacaccgccggcatgtctcggagcttgaagcccgtaagaaggtgttggcggaaatcgccaaggaagtggaggaggagcggggggctgccctcattgccaccagcgtgatgaacgaggcgcaggacaccctccgccttcaatacgggagctgggaggcggagctagggaaaaagctcgacgccgcccagggggtgcttgacgttgccgctgcccgagaacagcgggcgggggagaccgaagcggcgtcccgacggcgcgaagagacccttgaggcgcgcgccatggcgctggaagagcgcgcctgcgtcgtggagagggatctggcggaccgcgaggccgccgtcactatccgggaggcaacactggcggcgcacgagtccgcctgtgccgaagaggagtccgcactccgcctccacgaggacgcgctcaccgagcgggagcgagctctcgaggaggccgaggccgcggcgcaacggctggcggacagcctgtccctccgcgaggcagcgcaggaggagcaggcgcgccgcactctggaatgtgtccgcgccgagaggaccgcactaaaccagcgggccgctgacctcgaggcgcgggagaaggagctggacgcgagggcgcgcagcggcggggcggctgcgggcgaaaacgacttagccgcccgcctcgctgctgccgaacataccatcgccgatctgcagggcacgctaaactcgtccgccggggaggtcgaggccctccgcttggcaggcgaggtagggcccggcatgctttgggacgccgtctcccgcctagatcgcgccggtcggcaggtgggcctctggagagggcggaccgtaaagtacgccgccaaccatggaggcctcgcccagcgcctctcgaagatggccggggctctccaacggctccccgaggagctcgagaagacaattaagtcatcctcgagggacctcgcccaaggagcggtggagctcgtactggcgagttaccaggccagggaccccaatttctccatggatggcgctggatgagttccctcctgggaccgaggacagcgcgcgcgcaggtccgggatgccgccgaccatatcgtccacagcttcgagggctcagcccctcggctcgcgttcgcccccaactccgacgaggaggacaatgccggtggtgcagacgacagtgacgatgaggccggcgacccgggcgtatcggattgatcccccaagcccccgccattcttcagttttttcttcttttccttcttctaaggccttcgggcctcttttttgtatagatcaacttaatctgtaatcaaaaatgaagaaatttttgtgtcaatttcatcttgctgtgtgtatgagatgaggatgatctgtgacgtggtccttttgcgtcttagcttgattaagggctcgtgcccaggtcccagtcctcaaaaggcgtgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaaaaacacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgacccccccctcaggggtagaagcgacgaaggtgttcgatgttccacgggttaggcagctcaatgccgtcgcccgtggccagccgtatggagcccggccgggggacgccgaccactcgatacggaccctcccacattggtgagagcttgctcaatccagcacgcgtttggacgcggcgtaggacgaggtcgtcgacgcagagtgatcgggcccggacgtgacgctgatggtagcgccgcaggctctgctggtagcgcgcggctctgagggccgcgcgtcgccttcgctcttccaagtagtcgaggtcatctctgcgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttctgaattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccatagccgcgcgccgatagagggtcccttctaccagcacgtagcgtttggagatgcgatggacgcgttcactcccttcgcggtcctcgggtaaagtcttatctgtgaggtatgcttggatctcggcaatccaagcaatcaatctaagggagctgggagcgctcccctcgggtcccgaggcctggacttcaacgggcctcgggggccggtcaggcgcgtccgtctcccctaaggggtcgggtcgcgccgacggctgggcaagcctttcttcaaaggcgcccggtggggtctgggctcgcgtggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattgttggtcgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggattgagacgggctcgggagccggggtccactctgccacaaaatcggcgagagcctggctcttgatagcgtggcgtggttcaaagtgcaaatcgaactcagaaagttcgattgcccatttcaccacccgtcctgtaccgtctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccacagtggctttggggccgtcctgggggtcaggggctcctggcgtcgtcggacaagcgggcaaagggccaactccggtcgtcaggggccttaggcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggcctcgggccaccgttcggctcgggggcctctcctccctgctctctcccgggccaagtcggcacagggtggggaagcgcgaaatgagaattgtcctcatcgcgctccacaaccaatgccgcactaactacttgcggggtcgccgctaagtagagtagcaagggctcgtctggctccggggcgaccagaactgggggagagcttagatacgccttcaactgggtgagggcattttcagcttccttcgtccaggtaaacggtccggagcgtttgagagcttaaataagggtaacgccttctctcccagcctcgatatgaaccgacttagggcggccatgcaaccggtgacgtattgcacatccctaagtttgctgggggggcgcatccgctctatagcccgtatcttctcggggttggcctcaatgccccgggcagagaccaagaacccgagaagcttgcccgcaggtacaccgaacacacacttatcggggtttaattttatgcgggcggagcggagactctcaaaagtttccgctagatctatgagtaacgtttcctggttgcgcgtctttacaaccaagtcatcgacataagcttcaatattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgctagccactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggcagcacttcggtcattacgccggcgctcgatgctggtgcgggcgtccggccccccacgcagatctttctgggtcgaaggagtcgacgaaggagtggcggccgaatggcgaacagcggctgccgctcgtcgtgccctccgtcttgacgacgcggagccggtggtagcagcaccagaggccttggtggcggaggaccgcccaccagcatctaggcgctgccgtaccgtcatgactaatttggccacgtcgtccagccatcgttgggctggagactccgggtcagggacgacaggcgggtgacgtaagagcgcgcccgcagcttggagcgcgccctggggcgtgctgccgtcgccgtagacgaggaggcgacgctccccatctcgccgttcttctccatcgcccgcgatcggtgaagtcgcggatctttcgaccctctcgagcgcctccccccgcttaggactttggcgtggagggagcggtggagtacgagctcgacggcgtgggttcggctccccgtcgtcgccactcacactcggagagaggtcgtgcgcctttgcttgctcggccatcaggctgaacaggaaaagcttggcgcacacggaagagtacgagagctcagaaaaacacacactgagtcccctacctggcgcgccagatgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttggggggatctgtgtatgaaggagctacaaagtatgagccagcctctcccttgttctgggttccgaatctggaaaagtccagtccagtccccccctctaagtgggcaaggtcctccttttatatcttaaggggataccaca

SEQ ID NO: 46505 - DNA, 1379 bp, Oryza sativa
atttgatggtacgaaacggtatccaccctaatcattatgttttcagcattctaatatgtgcatacgctaaacaagggaaagtagatcaggcaatgcttgtgttcagcaaaatgaggcagcaaggattgaatccggatacagtgacctatggaacagttataggcatactttgcaagtcaggcagagtagaagatgctatgcgttattttgagcagatgatcgatgaaagactaagccctggcaacattgtttataactccctaattcatagtctctgtatctttgacaaatgggacaaggctaaagagttaattcttgaaatgttggatcgaggcatctgtctggacactattttctttaattcaataattgacagtcattgcaaagaagggagggttatagaatctgaaaaactctttgacctgatggtacgtattggtgtgaagcccgatatcattacgtacagtactctcatcgatggatattgcttggcaggtaagatggatgaagcaacgaagttacttgccagcatggtctcagttggaatgaaacctgattgtgttacatataatactttgattaatggctactgtaaaattagcaggatggaagatgcgttagttctttttagggagatggagagcagtggtgttagtcctgatattattacgtataatataattctgcaaggtttatttcaaaccagaagaactgctgctgcaaaagaactctatgtcgggattaccgaaagtggaacgcagcttgaacttagcacatacaacataatccttcatgggctttgcaaaaacaatctcactgacgaggcacttcgaatgtttcagaacctatgtttgacggatttacagctggagactaggacttttaacattatgattggtgcattgcttaaagttggcagaaatgatgaagccaaggatttgtttgcagctctctcggctaacggtttagtgccagatgttaggacctacagtttaatggcagaaaatcttatagagcaggggttgctagaagaattggatgatctatttctttcaatggaggagaatggctgtactgccaactcccgcatgctaaattccattgttaggaaactgttacagaggggtgatataaccagggctggcacttacctgttcatgattgatgagaagcacttctccctcgaagcatccactgcttccttgtttttagatcttttgtctgggggaaaatatcaagaatatcataggtttctccctgaaaaatataagtcctttatagaatctttgagctgctgaagccttttgcagctttgaaattctgtgttggagttcttttctcctacagttgtattagaggagggatcttctctttatgtg

SEQ ID NO: 46506 - DNA, 5374 bp, Oryza sativa
cccagaagcaacaagataccagtccctgtccaagaaaatcgtgttctgtagtagtgattcatgaattccttctctacttgatcgatccattttctttgtttcttttttggcatagatcgaacacttggtggtgcgctcgtcggcgttcccagtgtccagagcgccaccatcgccccactttgtcattcccgtcgactcgaatcatctccggctgtaccattgcgccactgacgtcgcctaggtcccaggagaacgacgcccacatatgatcaagccaatacgccgccacgaacgcggtcggtcgccgttgctctcctactgcctctgcttctcttgccgccgagtcaccgacatgtgggcctggctgtttagccacttcattaggtgctaaggactttaattagtagaaatttaaatcttgtaaggttctttttgtaaaattgctttgtttgccatgtggacttatggacctaaatgcaattcacctaatgcccagggacttttttgtatagggtttagggcttaccctaaaacatgaaattactatttcatgcattcattacttgatataatagcttaatgagtatattgtactcacccttgctttaacccctctttcagaatcaatttggagtttttgccgaagccaggagtttaatcagataaattggtttcattccaacttagttcccaagtatagattagatagatggtttaattctatagcaaaacattagacttggctcatcctatagcttctacagtaatagttagccactaccctattatttcatgtaaagaaatctcctttggagccttaatcaaatgtatgcgatgaagattcagattgttgaacctgtatcaatctactaatacaggggttgatacagtttaaatatgtcggttaccgaatctttaattttgggacccgacatggtgtgtgggtgggggcccctgcgatttgggagcctagagcggccgtaccgcttgcgccccctcccccctgaggcggccctaactacatgggccttaaaaggccaaatggcatcttatgacgaattctgggcttgatggcgacgaaaatggatgccatagactctatgacgacagaaagatcgtcactagattaatgacaaaaagataagctttctttatagaacgccattagagacgcatgacaggtgacgaatcatattcgtcacacgaatgtcacagatttcatagcatgacttgaaattaaatttttatgacgtaaatgagcgtcacctatcataagattcttgtagtgatggcttgtttggctattagagaggcagtttgagacatacagcacacagtttcataccgtgtgcgtgcctagttggcaactggatcctagtagatgcaaattttgaatcattcaacccaacccaatccttcttctcttaatcttctcttcctacacttgtgtatttgtgtttgtgtgtgtgtgtgtctaagaggctagtagagttagctatcctaaaattttttgcacgttgcagctactaactgtgctgctggcttgtcgtcctctgcttcaacattaaagagagaactaatagatcggtgatccactttggtttcttggatgctatccagccacgtcaccatgcatgcgaattttgtggatggagtcagtggctctgcatgcacggagctgatttaattaattaacttgttgccagctagtacctaattaagcatgtgtgttaatttattattaattactttgctagtgttaatttatccttagttttttttattccaaactacgagtagcatgcatgcctttgtcagagagagaaaccgatggaatatgcctcgtttcaaaagtccatgcataatgtgcatgctttgtggattcgtgctgtattttcctgggtagataagaccaaagaatcccacttaccaactaggttttttaaaagtctggtacatcgtgaaccatgctgcttcacgtggtcggacctatatacgttaggatcaaatgtgctcaacgtggtctggcacatcatggaccatgctgcttcatgtggtcggatctagatgtattaggaataatccttttcgtagtagtgaaactaaagaacttcacatgccaattagtttttttagagtccgaacaaagatgaaactttttggaaaggtgctccagatgaccaagttcaattcaccaactgaaatcgcacattggattttacatgaaaaatgcaagatggacaaaaatgatttctttcggttctaaattaatactcccggccatttgggaggagcaatatgtacatatgcatgcatcacacttcagcatttttgtctttttttttccttggagttttaagaatgctcataattagggcatgcaagttgatccattgatatattcgcaatatttgacgatttgtttttcattttaaaaattgttgacgatattagcttaattttggtaaggaaaatatcggttaatttatccccaatttttatcaagagagaaaatgaaccatgagaattggggtgctaattaaccacaagcaaatattcatcttaatttgttgtatatatatatatatatatacacgagcatgcatgtaaagatggaaatatgtgaaaaatataatggtgctagtagatttgtctaaaacacttccataatactatgatcaggacactcgataaggacaaagttcaattttagggattgtgtcattatcaaaattatcaatgaataattggccatagggccgggattagcaagggtctactactgtcctgccatttcattaattaattagattaagtccccgattccttgcatcccaaattggcctacgagaaccgacaaaaatcgcaagatgggaggattgtggtaggttatcttcagcaactgtgcctctcaagtggccataacatattagccagaaggataaataatcatcaatctgccttcacagttttgatcatctcatgagacatatatataaaccacccattagcaagagtctcctaggtgaattaattaactatgttgatacacatatacttaattggtataagaaaaattagtggtcgttaattagtataaaagcatcaatcaaatggagactattagctagctaggagaccgggcaagcaaagcaaagcattgatcttgatgaatcctccagagagattaattgcatattgccagttcctcctgacctattatatgcatgcaagtgctctctgtacttgtgcggtgcaacgacgagcaagagtgcgtacgtttatagtagaactgagggggtgcgccttatatacaccggacgagcaacagtgcgtacgtttgtagtgacgtctccaattttagtttctatggtagtaaaatattcgacgtttgacacctcaaactgcagaaaaactggagctgtgaaatgttttcttttttcatatgcgtggagctctaaaatattgacagttttgtttttttctataaaaaaagccaagaagagttaacgacttgatgggtaggcgctcctggatggagggagatgagcttaaaaagttgtagtaaatggacccatgcagtggaaatgcggaatggagtggagcagtaataaaatttaaaatgccacgcgcagggcatctcgaccacgacaggactctccttgagatcttcaaacagtgtgtgcttgctagctgaactgcagcagtggaacagtaataaaatttaaaacggatgtacagtgtgttcacagtggacgagtgtgctctgtgttctctgcatgtgaatagatatggcgatctctgcttgtgaatagatttggcgactactattactgggtatacgtggttaggacagatgttagtttgttctgcttgtttggagatggatttgggagcaaatgtacatggttagggcgcaaatgttagtttattttgctgtggaggggagtgggttttgctagaagtagacccatgaattttgctattccaaaattcctcaactagctatcagcctcatcgtttggcatattttctgaatatgccaaacggcatatttgcaaacgaaaatcaatttgtgaataaaacttttatatatgtgttcttagcgatctaaaagcaaagggtgaaaaataaacttcgatgaaaaaaacctcaaaatcagctccaaatttaatgttaaaaaaaatcaaattttggctgataagcatatgaatatgccaaacgatgaggccctatatatctagctccaacaaatctgtgatgcctatatctcactagtcttgctatgtgctatgtcatgtacacgtgggtaaatacctaatttatgaattttgctgtctcatcatgattatggcaaatatacatatacctaactcatgaatttttctatgcctacttctcaccatttatgctatgtctaagctagaagattttgctatggccatacctactcttaaatttttctatgtcggccttgactcagccgccccaatagaagtgacgaaactactgttgttgcaagagttggattccttcaagaaagtgatagatgaatctgaggcatcaagggagcagcaatcgaagaaaattgaaagtttgattggcctaaatgctccatattttgctctgaaaagttgacagttatgttaccaatcatgtatcattgtcattttcatagccttcatcatggcgttgcgaatattgtgaatattccaatggatcaacttgcatgccctaagtgtgagcattcttaaaactccaaggtaaaaagtcaaaaatgctgaagtgtgatgcatgcatatgtacatattgctcctcccaaatggacatcatgcaggatcgggactggacaacacattaaaggctctcatgctacacgcttcttgcagctgtagttaaacaagggcatcaagcggtagttcgataacaataagattcattggccccaacatacccccatccattccaataaatatggcacgcatgtattttaagatttatctttaaccaagaattagtttaaatttacaaagataattgatagaaaattagcatcatttcaacgtgtttttcaatacgaataccacaattctatttatgcattactagtcatcaacctgtgcacttgcatgggctaaaaaaattatgtgacatcaattaactaacgtggaagctttattggtgcatccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctaa

SEQ ID NO: 46507 - DNA, 14362 bp, Oryza sativa
tgtatctgaaaatcatctgcttctgtccatcggcgaaaacgtgcaaatttaaaattccttggtacgcaggactagatatgaagagtttgttcagaaattgtgcaacaaacatgtacatccatcaactatatacatgcataggatacatacatacaatgcaggtagccatttgcaccatatccataatatactagtaggcagccatccacaccttatgcataccaggacgatccatttgcacattatccacatcatcacataacgcttctgcctatatataagagcagcagcttacattcaagaatcacctctcaacacacaactaagaaacatagctaggtaaccagggaaggtagcatcagcagcgggaggcaatggagggaaagaggactaccacttcgatggtgatcatgtgcatggtcatcttgagcctcactgtcgactacgccaccgcagcacagtgcggctgctgcatatcctctcgagcaaaagcatgttgttttggttgtattgctgctggtggctccgactcagtctgcaagaacacttgttgtttcccatgtattctggccgattctggtaaattcactgaagtcactctattcaatgcattcttatatgtagagacagactttgtagcatatcgtggactaatacatatgtgtgtctttccatgcattttcctcaatgtactttgttgacttcacttccaatctcacgacttcaggcatatatcttgcaacatgaagacatcttatgctctacttccactacaaaattaactaatgcgctaatgggatttccatattttaatttcacagttgttgctaagatggacgaaatgggagttcttgctaagatggacgaaatgggagttcttgctaagatggaaggacaagcctaaaacaacatatttgcattgctaccagtcttaatgcctttcataagaatatgttgttttgcttcaagttatggcctagttatgttaatgtttatctccaataaattgttgaccatatggagcgatctatagtcgatccatctgttggtcccaactatttgtatgtcgtgcatgtgttcgctcacaagcatatttaatttctcttgctgcttttaataaggccatagcactatccaatgtatcatctgttggtctctgaccttagcaatttattgcaacatgattattattatttgtgtgtgcatgttctttacttaatttattcttagcggatttctgatgtttttgtgagttttagactatgggagataattaagattgtcatgccaaagagtattccgaatcctactaggaaggcatagggtggggggggaggaaacatggtcaatttctcggctgctatcacattccttgttttcttagtcttgggagacttatagccatactaaaggcaatacagtcgaggaatgacaaccttactcacaaggacaaatagtcattaaaaaattatgacagcactaaccatatctgatttcagttcacgaaacatacatttaaatttaggcagtattacggagaactaaatcgacaaacaacaaaccatatttgcaatttttcctaaactaattaaccaagagcaaatatgcaatggagaattccacatataatttcacagcataactacataatacaatatggtataatacacatatgcatactagggcctacggcaaaagaggaaaagatcaatgcgcatgctaacttgtgtataatacagatatgcgcagtactttgaaatatgcataccaggacatatgctttagttcactccattcattcttgcactcttgcacattcaacatcaatcagatctaccaagcattcttgcacattcaagcacaagcagatctaccaatgaatcactaacttatgtagcaatggggggaatcggaggagaattaaaacctttcctcgtcagacgactgaaggacaggaggcggcggaagattcactggctgcacaccatgccgcgcgaatccctgaggtgtgggcatcgcatctatcagcaccaacgacatcggcagtggcaggggtggactagggctctttcgtagaccgatgtaaactagacttattggcttcgatttagggaggggagggaaaagagatagactttacccggctggcctttgggcctgcgtggagagggataggagttggcttggtttcagccaaaagataggaagaggattttaaataggttgcatatgcatgctttgtctaaagaaaattcctaaaaataaatgaatcagcaataaatcctaccaaaattcccataaatactaaacaacaccctaagctcccagcaattttagtttgaatttatcacatcaattgataacccaaataaatccttcaacacagctaaaaatctggaaacagcataccaattagcctactttgcaccttcaccgaaattaaaccataaatcctcttgcaaaatctcaaggtcagaatgttaaacatactttactctaccatctggtgcaatggcttagtctaattcgaaatgtaaccacatgaaatgagagccataaattacgtaaactttggaacttggcaccttgaaccatcaaatccttgtctaccttgccgtctccctgtcccccacaccccccccccccttaattctaaattaaatgtatgagagaaagagagtaatatagtttggtgtgatagtgccaacacatggaaaatttagagcttctagttctctccttctacatctctcttaaatgtgggaccaaatccttgtggggcccacatatcatacaaccatagccaacacatcatctgctcttctctcatttaaattttcttttatttctcaaaaggttagagaagggtttaaattcaatttccactcaaaatgccactctaccactccaagccttttaggaaagatctatatatgggcccatttgtcgtccaaacacagcaaccaaccttggtgaatcatctctttgatcctaaattattttttcaaagagagaaagaaagagagagagggagttaaagtccaatttacacccaaacttcaccatacctctcatcttctcattggaaacatctacatgggaccactacacagccactcatgctaggttgagtgaagtacaagtgggatcatagcctcaaatcactgccaactcctttaaatcgtttctaccgctcatgttgacacctagctctcactttccacctttcctttcaccattcattactacaaccaagatttttctgtgagggctaaaatgatttttgcgtgtgggtaaacggcccgcatacacctaggggtctaggaaaataacgatttttgcgtgcaggtggcgcacctccacgggaaaaaaaaacctgaaaaaacataaattttctttaaaaatgaaaccctagaatctagtggtggcgccgccactcctgcttgccgctgccgcctcctcgtcgtcgtcatcgtcgtcagcggcggcctccgcgccgctcgcctcggatccgtgctcccctctggccgcactgccgccgacgcccctcccctctgccagatctagggagggatggaatgggaggggaggggagctggatgccacgcggggggagggcgcccggctgccggatctgtgcggggacgaccgccaccactggatttttgcgttgatggccgccgccgcaggatccgtgcagggacggccgccacccgccggatcccacgcccaccaccgccaccacgtggaggaggccggcgcgcgcctacgcccaccgcagctgtcgccgcgcgccaccgccgctgccgccatcaggaggagaggagaggagagtggagagaggagaggagaggtgtgagagagagaggactgagaggagaagctctgcgtgcaaattttaaagttgaaaaggggattgaggggaggggagaggagagaaagaggggaaattttaaagtgggtcagagggaaaagagggagttagtattttgcatgcggctctcttaataggtctgcacgggaaaattggctcattttcacgtacggtccatttaagagaactgcacggaaaaatcgatttttccgtgccgtcctcttaaaaggaccgcacgtgaaaatgagctgatttttccaaaagcgacgagttgctgcctgcacggaatctaaaagggtccctgtagtagtgattaatcaagccaactcgccactgtgaacctcatctatttctcatagtgttccactatgcaaaccaccaaaaactacctcggaatctccaagaacttccacttactcttttcacccgaaggagtttcatccatgtcacgtattctctggtgagcttcaccgcactccaaccacgggaacatgaagttccttctctacctaatcaatccattttctttgtttctattttggcatagatcgaacacttggtggtatgctcgtcagcgttcccggtgtccagagcgccgccatcgccccacttcgtcgttcccatcgactcgaaccatccctggctgagccattgcgccaccgacgtcgcctaggtcccaggagaaagacgccaaaatatgatcaagccaatacgccgccgcgaacgccatcggtcgccgttgccctcctattgcctctgctccccagcaaccaagtcaccgacatgtgggccccggctatttagccacttcattaggcgtaaggtctttcattactagaaatttaaatcttgtaaggttctttttgtaaaattgctttgtatgccaagtgggcctatggacctaaatgcaattcacctaatgccaatggacctttttgtatagggtttagggtaggtcctaaaccctacatagaaattactatttcatgcattcattacttgatataatagcttgataagtatgttgtactcagccttgctttaaccctctctttgagaatcaatttggagtttttgctgaaaccgtgagtttaaacatataaattagtttcattccaacttagttcccaagtatagattagatagatggtttaattctatagagtttaaacattagagttggctcatcctatagcttctacagtaatagatagccacaatcttgtaaataccctattattttatgtaaagaaatctcctttggagccttgatcaaatgtatgctatgaagattcagattgttaaacctgtatcaatctactgatccagggcttgatacagtttaaacatgtcgattaccgaatctttaattttgggacctgacaaggtgtgtgggtgggcgcctagagcggccatcccgctcccccccccccgagccggccctgactacatgggccttaacaggccacatggcatcttatcatgatttctgggcttgatggtgacgaaaatggacgtcatagactgtatgacgacagaaggatcatcactagattaatgacgaaaagataagcattctttatataacgccattagagacgcatgataggtgataatatatatatatatatatatatatatatatatatatatataggacggctctttcatacacccaggtgtatgtacacccttttattaatggatgatccattagcattcaatttagctgtgaaaaaaattaataatattaatttccaaatgactgcatgcatgtggcatagctgcacaccggattgggtgcaaatttgaacaagatcgttggcatgcatttgctttcaaatttgataacgtaccttagatatccccaccttttctagtatgcaacagtatatactgttttttaagccgcagtatatatactctttgaagcgatgagcagtactatatactagttttttgtgtattagcggtgcataataaggagtaccttacatttttgttgtagcagtgaatatttctttttttaattagcagccgtatatactgatgcggacatcactacttcggatacacacaacaatcctccaacggtcattcaaggaccgataacaagagctcgtgcgcgacaattaaatttagaggtgagttcgttcctatgttcttctttgtatgaattcgagaatagaggggaacaatggaggggacaaggagacacttggagaaggacttagagccatggaggaccattggggacgtccaagtcaaggtggaggcccaaaccaagtcgacgtctggtgcaattcggagtctaggaccagtctgcactaaaacgggcgcccaggtcgtatacgtgttcgaattggggcgttctttatatggatggaaagctaagaagataacctttccaatggttttggtcccacgtccaaattctttctgagtcaacgggaattgaccgaacaacttaacgtccagaatctgtcccggtgctgcgtcaccgtatttgggcctttggcccgtgtatcgtattggaacccattagggttgcgtcgagaggggtttgcacgaccctaaactatatatatcagtacccgccgtcatctttaggtttttgggttttgcttagattaatctgtcaagaacagtttcgccgctagattggtttgtaagaccccaactcgtgagcttaatcattcatctgcaattttggttgtttttctatcttgttcttgtttgtgttcttcgattggcaaacagggattagccttctcggcgaggtcatccgtattttgacacgggtgataacctgaggagacgtggtgctgcgattgcggggctcaagaacgtgcgcgttcaagaagccggatcgatttgtgtcgcgactccgcccaaatcgttgtttatcagaacctttcggaagatcgggaaccctagtgcacatcaagtggtatcagagctctaggttcaccgtcaggttcgctcagtttctttgcccttgattagttttttttttcgcaattatcctagagtctacagaaaagccaaaaaaaaattagttgttagttaccttaacctagaccgtgtttagcctttgcatgattctctctcagagtccgtagtgttgagtttgagtcctagtttaagttcatgttgctggtctagtgtgtgttttagtctagtcatgtgtttgtcctttgtaaccctagccgctacctttcaccgtgtgttaggcttcatcctttgagagccgtttccgccatcataaacacccatccagataaccaagcatctccagaacaccctacaactccgctgccaccatatcccaattccaccgcaaaatagactaggttatatcccctctggaaaacctagccggaagccgaaacttcaaacagccataacttttgcatacggactcggaatcaggaaaaatttaacttttcggataagagaaaaaattttatatccgtttatccccgcctttggctggtttggcgaatccaaaattccaaaaattggcttgcaaaattgtctgttcgagctcacaagttcctgcaccttgtttatagtggtttcagaaaaatccataggccacatacctactccaattgagctttaacttggaggtgtgcctatttttgtgttctaaaaaaagaaaaaaaatatcaaaaaaataaaagaaaaaaaagaaaagttgatttccactagtgctttgagctcacgacgcgctccgttgagcttatctgccagttcggttttgtagtttttgctgaaactcgctgaagcttgcctgtcagtccttctttgctgtttactagtgtcatattctttgagccatctttgttatcactactgtctaggacacgagtagaccagcaactaagggcaagtgacttgggatttttattcagcattactatctgtcattggattgtgtaccactcataaacatatttttggccttcctagctccacatattacttctgaacagcacaggttcttgatcactgcaattgctgactacgccttccaggtatcctttgctttgctggtaagaaccttataagaccatggttaggaactccatattgctgagaatcgttgagaggcaccactacacctgcgtagtagattattagggataaccttcaccgttttgtttctgttttggtgtttcaatgtcaggtaacgaaggcgagaagagtccccaggattttgctgactgtgtcagccaagagcaactacgaactctccaacaaaatactcaaaaggacatcacggaggctgttgcaaagtctgtccaagatgccttcactaaaatcggcttcctaaaccacatggagaggttggacaagcggatatccactctaactgatcgggtcgccgtgttggagacaccttccaatgaggaagtggtgagtggtgacgacgatgctcatcctgaagacacggtgtatgattccagtggctatattgacgcaccggctacaaggcaagcatggctacgacgtcgtctacgcacaaaccgcacaggtatgggtggcactcgccaccaacaaggtaataataatgatcgtgtgcccgatgatccttatgctaaggttaagtttaaaataccatcttttttgggatatgatgatgctaaaaaataccttgattgggagatgacagtagaacaaaagtttaatgtccaccttgtacccgagcaacatagagttagacgagccagtagtgagttcaaggattttgctattatgtggtgggctgggttatctgatgagggggtactacctactacttgggaagaacttaaggtagctatgcgcgataggtttgttcctccatcttatcatagagatttacgtaagaaactgatgcgtttggaacaaggggataaatctgtacaggattactatggtgagctacagaagggtgtgagacgctgtggtatagtggagggggtcgaggatgctatttgtcgtttctacactagtttgagggaggaaattcagaacattgttgattataaggaatttaactctgtcaaccagttgtttcgatttgctatgcttgcagagaaggaattacaggggcgcgaccatcagggcaagagcaaggcaagcacatacactctgcgcacgacgtgtcgcgaccgagaaaattgtcttttctcgaacgctagtgtattaatccccgtcccaggaaaagccggggtacaccaaacaaacatgatacaaaaggcacatctttattatatcgataatatttgcattattacaaaggcacttcaggcctgacaatcaaaaataaacagcagcggactagcgggcctacggctccatcttcacaggcgcataactgggggtataagccaggactccacctaagacttcttctgcaaagcttctcttactgaaggggggaaagattgagcaagaatgagtacaaccacagtactcagcaagccacactggagatgcataattaatgcaagggagtacaaggggataataatctaggggttaagttttgcagtaaacagcatttaaaagtcacttagttgcccaaagctattttgtaaacacgatcctagagctatataatattattaatcaaggccgtggacccacatgaacctgccttaacccaaggcctacgatgattcagaccgaactggcaacccgaccctgggtcccagctcgtcccaagccaacccaggccaaccattccacattttagttattaagcaggttttaagaatttaaaacactaacttgggtacattgctaggcttgcccataaccgagggcacggctattcgaatagattatactctgatcagaggtgtacatctttacccacaagacacgtcttcctcacgtgtaaccacgtgccacataccaccacggcatacggacggaagacgcgacatagtttccaacccatcctagccatagacaagagtaccgacccaacccacctacggccggaacccccggacaggcaggcaaaattgagcccctagcagcaggacaccagccctgtgccatgacatctcgactaccgggccgcaactcgtgtagccttcatttgtcctagagatgtccatcgacccccgacttcgtccatctccatccgtgtacttttgtttataaccagactgagccacaaactaagccttacccactagacatgtggaagtacggtagtgctttgcaacaggggcccgaagaccggtccttatgtggccgaggtgctactaacaaaaccatgcaccccgagcccagcctaaaaccattttgagggttttgaatagagggggaggtgtgcatccaattccacaataatccaaccattccatagtgtccaagtgatatgaatattcccaaagtctagagttataaaaccacctaatgttgcctagttaatcagcgaagcatctacctaaattcatactagtggaaccatgaatagagtacccactagttggggttttatttattctagggtgaacaaggtaataataacaatagcaataataatgtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgagaacctccggaacgacagaagctacgcgaagcacacaagcaaagctaaaccctataaagaagcaataacaatacataaaaagaaagcacacggttctttaggttataacaaacattaggagacttgaacgggtcgattcagagttcgtatgaccaagatatgatcatccgaagtttaatgatgttatatggagatttgcggattattatcattaagctttgcaactataaaacatgtgtaagcgctagcctggaaaagacaggaaggctgcgctgttgacatgcgaaccccacatgtcaacctaagggaccacggcagaccgggtacacagagacggtccacgggtcgacggaagtggatcccgtgtgtcaaccgaggcgagtggccgacaaacggactccactaaacaccacacgggttgcacacgtggaaatcacgcggctaccgagcgggcacactaacacggtcaccacacgcacaagcgaacgactaccgacaccggtacacgggtaccggggtcgacaaccgcacaacgggtacggggcgacaccgaaaggacgaggacggggcagcgagaagacggatccttaccaccacgcgacgaggcgtgggaacgacaacgatgaacgggcgcggcgaagacagctcggggacgacggaggcgaacggcgagggaacgacttcagcggcgatccttggacgaaggcgagacgcggctggcacaaggcttgatgacgcggagccgaggacgaagacgaggacggggctgccgcggcttgcttgacggatgcggacgacggacgagaacggctcgacggagggacgaacgccacgacgaccgggaacgacgagaggacgacgacgacgacgaccggggaacgatgccacggtgtcgaaggaggagacggcggcgtcgatcggcgcaccggcgacgccactggacgccggcgggaacgtaactccgggggtctccgcgggaaacggagggcaagccggggaaggggaggtgactgcgatgccgggagaggcgacggcacggccggacggtgcgcgggtgaggtggcacaggcggctggaggcggccggcggcgtgggagagagaggagggcggcggggagaggtggtgaggccacgggagaacgcgggagggggctaaaactggagaacggatcgagggggttccattttatagcggaaggaatcgagccgagcacgggagagggcggaacggcgacgggaatggcggccggcggccatggaaagccgccggagaagacgcgggcgttcccggcgattgggggcacaatccaagggggaaattggggggaattgaagaggaatcaatgggtattaaaaccccccaattaattttggaatccatggtttgaatgaggcggatttggaggagggagcgagctagggtttcacgggagagagaggagccgggcgggaggaaggagacgaccggcgcgtgggccccacgcgggcgcgcggcgtcagcgcgcgtgcggcgcgcgtgcgcatgcggctggctcgggcagggggtggcttgggccgggcggccggcccaggaggggagacctgggagagagaggggaggggagggagctgggccgggagggggaggagaggcccgggagagagaggggaaagagagggaggagagggagactttgggctgggccgagagagagagggaggactttgggccagacttggcccaaaggaggaaggaggattattttttttagtttttctttttagtaaactttgttaattgtttttggttgcttaataattatttccggtgctctgaaaattcaagtaaaatttgagggctccttttaaaccaaggacaatttaacaaaaattctccagaccacattcgaatttttctggtacgtattttagtgtttgccaatttcttttcgaattttaattaattctattattccttttagagaatgatttttaatttcaggatgaatttatcaggacgtgacacgacgccatctgcgggactgcccaaggccgtctcttttcgggcgtcccagccagcgggcaagcgaccagcagcatccggagcttctgcggcaccaaaaccatctccaccaccacgaccagcagagtcaagtaaaggttcctcgcaggtacccgccaagagtgcctcatctgtcacctcgacgggacgcattcagtgccaccgttgccaaggatttgggcatgtgcaaaaagattgccctagtcaacgggcctatgttgctacagaagatggctacatcaccacctccgacatggaagaggaagaggaggaagaagaagttgaggacgaggatggcgaagtttttggtcgtgatgacacaacggactacagaaccatcattgtgcagcgggtgctcagcacgcaggtacagcagcatgacaggttgcaacgccataatttgttttagatttttttcgtcatcaacaactgtcgtgcacgtgtgatcattgatggatgtagctgcaacaacttggtgagttctgatttggtcaataagcttggcttgactacatgtacacatccacatccttaccatattcagtggttaaacgattccggaagagcaaaggtaacacaggtttgtagggtttcgttttccattggctcatatgcagattctgttgattgcgatgtggttcctatgcaagcttgttcacttttgctggggcgtccttgggaacatgataatgatgctacacatcatggtaggagtaataaatacacttttatgcataatgggaagaaaattactttgctacctttgacccctgctgaaattgtagaagctgataaagaacgagctgctagtttgaaagttgatgaatctgaaaatcagcaagtggctaaatctgtttttccacctaaaaaggataagctttcacctagttctaaggttgagggaattaagttgaagggtggtgttatgcttgcaacgaaatgtgacattggtgatatttcaaatgatgatatgtgctatttcttgatatgcaaacaagccttggtttctttagatgatattgctagttcgatacctcctgttgttactaaccttttgcaggagtatgaggatgtctttccagctgagatacccccaggattgccacccatgagagggatagagcatcaaattgatttgattccaggagcatcattgccaaaccgtgctgcttatcgaaccaacccagatgagactaaggaaattcagtggcaagttcaagacctttaggaccgcgggtatgtacgtcaaagccttagtccctgtccagttcctgtaattttggttcctaagaaagatggttcttggcgaatgtgtgttgattgtagagccattaataatattactatccgatattgtcatcctattcctaggttagacgacatgcttgatgagttgtgtggctatattattttcacaaagattgacttgcgtagtggctatcaccaaattagaatgaaacttggagatgaatggaaaacagcttttaaaactaaatttggtttgtatgagtggttagtaatgccttttggtttgactaatgcacctagtactttcatgagcttaatgaatgaggttttaaggccttttattggacgatttgtggtagtgtactttgatgacatattgatttacagcaagtctttggatgaacacatggatcatttacgtgctgtttttaatgctctacgcgatgcacgttt

SEQ ID NO: 46508 - DNA, 8905 bp, Oryza sativa
tcttccattggggaaagacacaggagaagtcctttgacattttgaaggagaagcttacgcatgcacctttgctacaacttccaaactttggtaagacttttgagttagaatgtgatgctactggagttggcattggaggtgtgttgatgcaagatggtaagcctgttgcatactttagcgagaagttgcatggtcctattttgaattattccacatatgataaggaattgtatgctcttgtacgttccttagaaacgtggcgtcattatttttggcctaaagaatttgttattcactccgatcacgaatcgcttcaatatcttcgctctcaaaataatttgaatcgtagacatgcaaaatgggttgaatttattgaatcttttccttatgttatcaaacacaagaaagggaaagataatgtgattgcagatgctttgtctaggcgctatactttcttatcccaacttgaatgtcggatttttggacttgaatcaattaaagaacaatatgcacttgatcctgattttaatgaagtgatgataaattgtaaagagggacgtacttggaacaaatttgtgatcaatggtgggtttgtttatagagctaaccgtctatgcattccagttggttccgttcgtcttttgttgatacaggaagcgcatggaggagagttgatgggacattttggagctaagaagacggaagatgttttggccatgtatttgtcacatcctgatttttgtttcaggatttataaattatttaatgaattattattagaatttatattaaatgttcattaatttacaagtgaagttaaatgtgggaaataaaattttctaaatataaagcatggatggatttaattttttattaaattctccatggttaattatactctctggaatattctcggatttttcggagctcaattcctaatttttaatcttacaaagagcatttcagtaattacccacatattaaattgatcattaaatggtctaattataattttgttaagtactttgagtgtccaagtattttcaggatttttcttgaaattatttgagcattggaagtatttttaacgattcaaagatcatttcattgattaatttaattggaaaagtaataataatcctcctcctcagcttgggccattttcggcccattccttcctttccttcctctctctttcgccggcccaacctgagccgcctcctctcctctcagccaagccggaaaagtctacttttcctccctgagctactgttcatcttccagctcaggcagatcccgagctagccgtgccgtgcacagtgccgccgtctcttccttctaaatctcgcctccccgttgctcctttttccaatttagttgaggggaaatattcctcttatcctcctctatctttaccctcaaaaatcggagctaaccgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtgcctcgtagcgccgccgccacgtgctccaccccgccgtcgtcgccggccgagctccatccgcgtcgtgccgtcgcctccgtcgtcgccgccagtcgccgtcaccgccgtaaggtgcgccgaggtgtggagaagcccggccgccggagccccgaagccgccgatcgccggagccccgaagccgtcgaccgaagccgcgccgccgctagacctcgtcgccggccgtcatcgttcgtcgtttggttcgagggtgagtaccgttgggttcgtctcgtcgtcctctacgtgtaaatgtcctccaaagtcgcagccgaccatccaatctccggcgaggtcgtcatcttggttcggccgccattgatgaggtcatcatgacgtcatcatcgtttttctttttcctgtttttctaatagattaaatcttcagaaattcataactaaatcatcgtaactcggttttgagtggttcaagttgctaaattcatctaaaattatgatctacatgtttgtttactttttatgtattgtttatttggtttttattagtctttttcttcgttttgcgtgaaagttagtcgtttccgtcgttgcgaaggttcgcgagtacgccggaagtattcaagaagattaattgaagaccgattattgcaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttattttcctatgggttataattcgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggttaaggtgggttgtgagcatatggttttgatggttgtgctcatgacaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccattgcctctggttttgagggggagattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaactactccactgttttacttctcttaaaagttttgctaaatgctgcttttgcaaatgagcctatattatgccatcctttggtatccttgtgcacttgcatatttgctatgtggcttgttgagtatgtcatatgctcaccttgcaataatcaatcaacctcagttgaagaaaaaggatccagaaggagaagacgtttggcttatacccgagttgagctgcctgtgggagtggagccggagattcgctagattttattttccgctgcagttttcttcatggtgaggactaagtgcctcttaagtaagtatttagcgttttagttaatttgatgaatctgtatattaaattgtcagtttgtgtacctcggctgatttctggacgaggattttatgcacaaataagttcggaaattactagtgaatttctgggcgtgacatatttcttttggccaaggatgagaaaggatgttgacaggttcatggcacgttgcaccacttgtcagaaagctaagtctcatttgaatccacatggtttgtatatgcctcttcctgtaccttctattccttgggcagatatttctatggactttgttttgggattgtctagaactaagagggggagggatagtatttttgtagtggtggatcatttttctaagatggcacatttcataccatgtcataaaagtgatgatgctgttcatattgctgatctatttttccatgagattgttcgcttgcatggtatgccttctattgtttcagatcgtgatgcaaaattcttaagtcatttctggcgcacgctatggaacaagttgggtacaaagctattgttttctacaacatgtcacccacaaacagatggacaaacggaggtagtcaaccgcactttaggtaccatgttgagggctattttgaagaaaaatttgaagatgtgggaagaatgtttgcctcatatggagtttgcatacaatcgggcaacacattctactaccaaggtaagttcttttcaggtagtgtatggtttcaaccctcgtgctccaattgatatgttgcctttacctactagtgagagggttcataatgatgctaaggcacgcgctgaatttattttgaaaatgcatgagtcaaccaagttcaacattgaaaagatgactgaaaagtatagaattgctggtagtaaaagtaggcaagaggttaagcttgaaccgggtgatttagtttggttgcacttgagaaatgatagatttccggaattgagaaagtctaagttgatgcctcgtgctgatggcccttttaaaattgttgagaagattaatgataatgcatataaacttgagttgcctcccgagtttggggttagtcccacgtttaacatttcagatttgaagccatacttgggagaagagtatgagcttgagtcgaggacgacatcaattcaagagggggaggatgatgcggacatcactacctcggatacacacaacaatcctccaatggtcattcaaggaccgataacaagagctcgtgcgcgacaattaaatttagaggtgagttcgttcctatgttcttctttgtatgaattcgagaatagattgcaacctaatgattatattgtgcttaggaacaatggaggggacaaagagacacttggagaaggacttagagtcatggaggaccatcggggacgtccaagtcaaggtggaggcccaaaccaagtcgacgtcgggtgcaattcggagtccaggaccagtctgcactaaaacgggcgcccaggtcgcatacgtgctcagattggggcgttctttatatggatggaaagctaagaaggtaacctttcaaatggttttgctcccacatccaaattctttccgagtcaacaggaattgaccgaacaatttgacgtccaaaatctgtcccagtgctgcgtcaccgtatttgggcctttggcccgtgtatcgtgttggaacccattagggttgcatcgagaggggtttgcacgaccctaaactctatatatcagtacccgccatcatgtttaggtttttgggttttgcttagattaatctgtcgagaacagtttcgccgctagttcggtttgtaagaccccaactcgtgagcttaatcattcatctgcaattttggttgtttttctatctcgttcttctttgtgttcttcgattggcaaacagggattagccttctcggtgtggtcattcgcgtttcgacacgggtgataaccagaggagacgtggtgctgcaattgcggggctcaagagcgtgcgcgttcaagaagccggatcgatttgtgtggcgactccgcccaaatcgttgtttatcagaaccttttggaagatcgggaaccctagtgcacatcatatacttactccagaactaacgagtatatatatatactgattatgtctttttattggtacgcgcagtatatactactgcaacgagcgaatgagtatatactgttctttcacggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttcttttttttatcagtatatgcatttgttattatttgagtatatattgtatgcactacttgttctgtcagtatactgcatgtactaattgtcatgtttggtcggtatactgcatcgtcctcgctaaaggaggttatactgccttcttgtttgatcggtatatactatgtatactactttttttcactcagtatataaataagtatgtaccagtatttcttagataagtcgtatatttgctatccatggaagctggatgcatatgcttttcagttgaatagaataattaatatgcttttcacgtgcaaattcagatgtatgcctgaatcactggcaaagtatcggctgttgcattatgaataaacctaaattaatgaaataccctagaagggcactgaattctgaatggacattaccagaccaaagaaaaagatcaacgcagactttcggaaactaagaacaaaacataacgggatcacccctcgatgtggctcatcgaagaatctctgcatccccacagacagatctcggttaacatcgatgggatcacgctgaccgcacgccggagagaggtggacaagaatgtgtcttcctggattaacaccattagctaggaatcacggttcaatgccgacgacaatgctgtcgccgcacggccacacatgctgggctgttctgtcatcagcaccatctacgtccacgatacatgcatctcgcatttgcatgcaccaaacaaattcgatctgcatgcatgcattatcgatttgcaacgtagaaaaagcaaatcaagaaaatcggaagaaggaaggacttgcctgcagtatagtcgatgttccagttccggacgacgctcaacgtcgtcttgatcgtagcatgggcctgcatcgatgccgtcgccgcacggccacactgacttgcccgaagatcaacggcgtcgttgtctggtcatagctcttcggccagccagtcgcctgcggatagtcataccgaaggcattggtaatggaagacgccggcgtagacatcagcagatgccacgaccttcgaatagccgatgggtcgcgccgccgtcgccttcgaatcgctgatcgagataacctgcggatcgatctatcgattctgtttacaaccacccatgagattttaatacgagctattcaaaagggttccggttattacggaataattcagattatgaggatttttttcgtaactaaaaatcaaaacgggctcggtatctggatccgcttgctgacttggtcggtggtgttcgctgatggacggtggatggaaccgggagtacctactcctgggagtatagaatcattatatatatatatatatggtgagactattctataccccccctccccctcaagagcccaacccactaccccctccttttattgggctcaaaacccacctcctaccccagtcaaagcatggtcaaaggacggtcaaatcgctgccatgtcggtcaaacccgtgtgctaacttcctcccacatccacctatttgttgtccttgtctcgtacgaacggtgcagtaacatgacgaccactatgcagtaacactgtaccttacttgcagtaatactaataaaatatagttaaaatatagtcatgacggatctagttttgtagagctttttttttaaagcattacggtgcaaacggttcaaaaatataatatgtggtgtgagagatattattgtttaaagatgtgaattcaaaagatatcacttgcatttacattttactagttcaaagtgggtgataggtcctgtacctgtgtttggttgttaccacctcttattgcagtaatgctattaagaaattgcagtaacatgcagtgttactttaaaagttatagttgttactgcacacatacagtaacgccatgatggaatggtagtaacacacaataaaaagtagtaacaataatgatttagtattactacttatggagagataaatttcaaaataccaatcttcgagaagaaatagtagtaacacactcgattactgtaaaagcacataaactgttacaactctacaggacacaaagttccatagttgtaagaagctaattagaagacaaatatatatgttattacaaaactcataacaagttactatgttttagtagtaacattatcgtataagtatagtaacacgtcacgttactgcaaaacatataggatgttactgcacttttgatagtaacatcgtagtgaaattgtagtaaactagaaatcgaaaaaaaaatatatgagttaaaagtctacatgctaaccatatatttgttactgcacaaaagtgtaagtgttactgcatggcagatacacgttaccacaagtgtatgcagtaacactattcaagaattgcagtaagatgctttgttactgcaaaacttataaaatttaccacactttcataacaatgttatgatgggattgtagtaatgtacaatagatagtaacaacacttgtggagagttaaattttaaaagaccaatctttgaaggttctctctacccttgctgtcgcgaccgagaaaattgccttttcccgaacgctagtgtattaatccccgtcccaggaaaagccggggtacaccacacaaacatgatataaaagacacatctttattatatcgataatatttacattattacaaaggcacttcaggcctgacaataaaaaataaacagcagcggactagcgggcctacggctccatcttcacaggcgctcaactggggtataagccaggactccacctaagacttcttctccaaagcttctcttactgaaggggggaaagactgagcaagaatgagtacaaccacagtactcagcaagccacaccggagatgcataattaatgcaagggagtacaaggggataataatataggggttaagttttgcagtaaacagcatttaaaagtcacttagttgcccaaagccattttataaagacgatcctaaagctacacagtattactaat

SEQ ID NO: 46509 - DNA, 3532 bp, Oryza sativa
ggtacacgggtaccggggtcgacaaccgcacaacgggtacggcgcgacaccaaaaggacgaggacggggaagcgagaggacggatccttaccaccacgcgacgaggcgtgggaacgacaacgacgaacgggcgcggcggagacagctcggggatgacggaggcgaacggcgagggaacgacttcggcggcgatccttggacaaggcttgacgacgcggagtcgaggacgaagacgaggacggggctgccgcggcttgcttggcggacgcggacgacggacgagaacggctcgacggagggacgaacgccacgacgaccgggaacgacgagaggacgacgatgatgaccaccggggccggtgaggaggcgacgagggcagccagcagcggctgcacggagaagaggacggcgctgaacacgccgctgcgatgacgatgacggtggcggcgcagcgagccgacgagccggggaggaggaaggggcggccgaatggacgttggcgacgacgaggatggagaggccggcacgggcgacggcgttccggcgaaacagaggagcagctggaggagaggacaacgctgcgacgtcgacggaggagacggcgacgtcgatcggcgtaccggcgacgtacaggagccgaccggagaccgggaggtactggacgccgacgaggaggccactccggcgagcttcgggcgaggaggaggtgatgccggggatgatggcggcatcgcggagccgagggaggtggtggcgacgtcggccggcgctcaggcaaggagacagaggcggctggaggtggtacagtggcagcaacgccactgttgccggcgggggcgcacctccagtggtctccgcgcaaaacggagggcaggccgggggagaggaggctgctgcgatgccagagaagacggcggcacggccggacggcgctcgggcgatgcggcaggggcggccggagatggccgtcggtacaggagagaggggcaggtgatggggaggtggctaggggctcgggagagagcaaaatggaccaaaggaaggaggagggcttcgttttatagggcaaggatggagtgccggtcacgggagaggccgaaaaccgcgccggaggaggtggccggcggcatcaatggcggtcaaagaagagggattaaatcccggtgattgggggcgggattaaagggggaaagttgggggaaataatcaggaagggatggggattccgttcccgcaactaatttggaaaaaggagcaacggggaggcgagatttggaaggaggaggcggcggcactgtgcacggcacggctggagagctcgggctctgcctgagctggaagaaggagcactgtagcgcgggggaggtaaaacagactttcggccgggctgagaggaagggagggaggctttggggcccaaagggaggagggggatttattttctttagtttttcttttagtaaactttgttaattgtttttgttgcttaataattatttccggagctctgaaaattcaagtaaaatttgagggctccttttaaaccaaggagaatttaacaaaaattctccggaccacattcgaatttttctgatacgtattttagtgtttgccaatttcttttcgaattttaattaattctattattccttttagaaaataatttttaattttgggatgaatttatcaggatgtgacacttgccccataagtaaaccgagccaattcatctctctctctccatgttactgcacctttttttcttactatacatattcttgcagtaacgttatcaagtaatcgcggtaacacactatgttactatgaaacttataatcgttactacatcttgtagtaacggcgttacatgattgcagtaacgcatagcagatcagcagtaatacttatgatatagtatcgtggagagccaaatttttaaaaaaccaatctttgaagggtaatatctctcacatcatgtactacttttaaaaaccatttgcaccatgatgttagaaaaaaagtgcttatcaaaagtagatccgtcatgattatattatgactacatttcaatattgttactgcaagtaagacatgatgttactgcacgatgaacatcgcgttactacgttgttctgagacgagagctgataagagtggaggtggtggggaaagtgaagggcgggtttgaccgagatggggagctttgaccgaggtgtggggtgggttttgccccctggaggtaggggggtatagaatagttattctatacccgggtgtagaatagtttttctctctctctctctctctctctctctctatatatatatatatatatatatatatatatattagaaaaactattctataccctccctcccaccaacccacctcctctccccccaagggcccaaaacccacctcccacctcggtcaaaggccagccagaggtcccccacgtcggtcaattctaggtcaaacccgtcggtgactttccccacgaccctctctcttcttagctctcgtctcggaatgacgtagtaacgtgttgttcatcgtgtactaacacaatgctttacttgcggtaacaaaattaaaatttactcataatatacttatgatggatctacttttggtaagcacttttttttaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgcaattacttgataacggtactgcaagactataagttttgcagtaagaaagcgtctaactacattttttgagtagtgttactgcataaacacgtggtaacgtgtaattgtcgtgcagtaacacttttacttttgtgcagtaacaagtgtatgattagtatctgagacttttaaccgatatatttttgtttcaattcctgaattactgcaattcaccacaatattacggtcaaaagtgcaataacgtcatatacatgcagtaacgctatattggagggaggaaaccaattttcttaagaagagggaggaaaaatggttcttgaggaggggagtacgtagatgcattttgaagtttaatcctccacatgcagtaacacgataacatcatggtggaaacggttttaaaaaataatacatatcttgtgagatattgcttttcaaagattgacattttgaactttagccctccacatgcagtaacagaatgtgtaatttacagtaacaggggtatatacatgcagtaacatggttttaccaaatgtataaaattattcaaaacactcctacataattcagaccttgctcaaagccacctacaaactttacctatggcccacctattcgaacttcatctcgtaaaaatgacatagtaacactgcatttatcatgcagta

SEQ ID NO: 46510 - DNA, 10786 bp, Oryza sativa
tcgctctatatatatcgctcatatatatatatggaatacatatatatatatatatatatatatatatatatatatatatatatatatatatatatatatatatatatatatatatatatatatgcatatgcatatgtataaatacatatattacacatgtataatttaaagcacttaacattttatgtgcatatatattaccaaaatatatatttacactaaagtaaatgtgtacatctataaacatatacatgcatgtatagtacaattcatttgctcactagctagctacgactttgacgccggcattatgtcaaaagaagaaggaccgacgttatgaattgtcgatccgttgtagtagaattcaccctcgggattaaggacttcttcgttgatgaatctcatcagttgttcttgaacagccgtgatataatccttgtgtgggagattgtccctcatgtgaatacactatcattcgaaaaataatgacatatgaatatatgaaattaataaacagcaaatcgatacgcaatgaaattttgaatggtttatatatacgtataccgagctctcgtgtggtgtagatttgggttgataggaagtgggcatactcgcatacgtagtagccgcacaggttagttcccaggtcatgctttgcacactatatgagaaaggacaagagatttaatatacacttatattaactgtaactagtaatcatatataattagcatatgcatgatttaaaattgttaaaaattctaattatcatatgtaaataccacatgcatgatttaaaattgttaaaaattctaataatcatatataactagcatatgcaaaatttaaaattgttaaaaattctaataatcatatgtaaataccacatgcatgatttaaaattgttaaaaattctaataatcatatgtaaataccacatgcatgatttaaaattgttaaaaattctaataatcatatgtaaataccacatgaatgatttaaaattgttaaaaattctaataatcatatataataagcatatgcatgatttaaaacttttaaaaattctaattatcatatataactagcatatacatgatttaaaattttaaaaattctaataatcatacataattaacatatgccgtacaacaattgatttatatggatattcaatacatccaaaatattttacattgtgtacacaacaattacggcaatacatcggcggtgacggttgaccgcacgtacttcctcctcactattgttccttccttgtgttcgctacgtgagtaaagggtgtcttcgtttgataggaggatgctagggtcaaccgtcaccgtgaaagggggttgcccatcaaactgatcataatcctcgtcagtcttgtcctcaactccgatgatttttcttttgctagggagaaccacgtggcacttcggctcatcaggccctttgcccttctttcctttgctagacatgtccttcacataaaaaacttgcattacatcattggcaaggacaaaaggttcgtccgagtatcgaaccttgttaaggtcaaccgttgtcatcccactgtcatcaatcgttacgcctccaccaatcaacctaactcattggcaccggaacagaggaaccttgagaggtccatagacaagttcccatatgtcctcgatagcaccgtaatacgtgcaagttgtaccatcgtgtcccatggcatcgatacgagcagcactgttctggttcgtgctctttatgttttggtctctcgtgtagaatgtgtacccattgatctcatatccttggaatgtcgctatcgagccagatggtcccctcgccaggtaggcaagttgttggctaatcgtctcgttacccatgagatgttgtcgcagccacacgggcaatttatcaatgtgatgccgtgtaatccatgcatcggacttaccgatgtttctggcgggaactagagccaagtgctcctcgatgtaaggagccaccaatgaagattattgcagaaccgtgaaatgggctttacggaataaattgttgtataccgtcattactgcgttccttctgagagtcccctttccccgtagtttcccttcatggcgtgattcaggcaccccgattgggcgaaggtcttcgataaattctacgcagagttcaatgacctcctctgttccataccccttggcgatgcttgcctctagacgagcacggttacgaacatacttcttcaaaacgctcatgtacctctcgaaaggaaacatgttgtgtagttacacaggcccgagaataccgatctttttgacaaggtgacaaagcagatgcgtcattatattgaaaaatgaaggtggaaatatcaactcaaagctgacaagacattgcaccacatcattttgaagggcttccaatctatccggatcgatgaccttctgcgaaattgcgttcatgaaagcacattgctttgttattgttgcccggacattgtctggaaggataccctgaattataactggtagcagttgtgtcatccacacgtgtgacagtcatgagactttaggtttgtgaacttcttctccttcgtgtttattattcgctttatattcgtggaggacgtacaagaattctgaatagggtaactcccaaaatatagagttctttttccacatcaccacgtgaccatgttcgctatcaataggctggctgctaggcccctttccaaacactactttaagagctttcaccatagcaaacactattttctcactgcgatgtttaggcttcgtacggtggtccgccttatgttcaaagtgcttgcctttcttccgtacagggtggtttgcagcaaggaatcgacgatgacccatgtacacaaccttcctacagtgcttaagatatgtactttctgtttcatccatacagtgagtgcaagtcttgtaccccttgttagactgcccggataggttgctaattgtaggccagtcgttgatggttacgaatagcagcgctagtaggttaaactcctcctgtttgtcctcgtcccacacggggacaccttatttcttccacaacagtttcagatcttcgaccagtggtcttaggtacacatcgatgtcattatcaagtggcttggggccttgaataataatcggcatcattctgtacttcctcttcatgcattgccaaaattttggcaggatttcttatgtattaaccagatttggcaacaactaaacgtagatattttttggtaactttggcaaaaaatgatatggttgaaaatggcatcaaagtgaacaggccctaattaacttgttgacagctactccctccattccaaaatataaagtataaccacccttaactcaaagaccaagaaaaaattattatcatcttgtagtttgaatcatcctaataaatataatgcatgcatccaataggattagataacatgagagtaaaggatttaaaaaagtaataacttaatgaagaagatgtcatagttaattgcatgcttgcatgcatgccttatattatggaatagagggagtagtacctaattaagcatgtgtgttaatttattattaactagtaatctgcccgtgctaacgctacggcgacattcagaaatacaaattaagatcgatgaatatagttattatgttgttaattaaattgccacatgcataaaataacatagttattatcctggttcaaatggagtcattagtgacaacaaaccatggtaaaagcaaaagtaattaaactttggaacttggcaccttgaagcatcaaatccttgtctaccttgttgtctccctgtcacccccctcttaattctaaattaaatgaatgagagaaagagattaatatagtttagtgtgatagtgccaacagatggaaaatttagagcttctagttctctccttctacatctctcttaaatgtgggaccaagtccttatggggcccactcatcatacaaccatagccaacacatcatctgctcttctctcatttaaatcttcttttatttttcaaaaggtgagagaaaggtttaaattgaatttccacccaaaatgccactctaccactccaagccttctaggaaacatctatatatgggcctatttgtcgtccaaatacctgcaaacaaccttggtgaatcatctcattatcctaaattatattttcaaagagagaaagaaagagagagagggagtgaaagtccaatttacacccaaacttcaccatacctctcatcttctcctaggaaacatctacatggggccactagacagccagtcatacatggttgagtgaagtacaagtgggatcacagcctcaaaccactgccaactcctttaaatcgtttctacccctcatgttgacaactagctctcacttttcaccttcacttttaccattcactactacaaccaagatttttgtgtgagggctaaaacgatttttgcgcgcgggtaggtggcccgcacgcacctaggggtctgggaaaatgatgatttttgcgtgcgggtggcgcactcgcacgggaaaacaaaaatccgaaataacatatatttttttaaaaaaaacgaaaccctagaatccggcggtgggcttccacccgatggccacagtgcctcctgcctcccgctggcctccgcgccacccgccatcagatccgcgctcccctccagccgcaacgccgccgacacccctcccctccgccggatctagggagggaaggaaggggagaggagcggagctggatcccgcgcggggagaaggcggccggctgccggatccgtgcggggatggccaccaccgctggattcttgcgttgacggccactgccgctggatccgtgtaggggctaccgccgcccgccagatcccacgccctccaccgccgccacatggaggaggccggcgcgctcctcccaccaccactacgccgctgctatcgccaagagtggagagaggagaggagaggcgtgagagagagagaggactgagaggagatgctctgcatggaaattttaaagtggaaaaagggatagaggggaggggagaggagagaaagaggggaaattttaaagtgggtgagagaggaaagagggagttagtatttttgcatgcagctctcttaataggtccgtacgggaaaatcgactcattttcgcgtgctgtccatttaagaggaccgcacggaaaaatcgatttttcccagaagaaatgagttaccgcacgaaaaaattgatttttccgtgccgtcctctttaatggaccgcacgcgaaaatgagctggttttcccagaagcaacgagataccgcccgcacggaatctaaaaggtccctgtccaggaaaatcgtttctgtagtagtgattcatgaagttccttctctgcttgatcgatccattttctttgtttcttttttggcatagatcgaacacttgctggtgcgctcgtcggtgttcccggtgtccagagtgccaccatcgccccactttgccattccagtcgactcgaatcatctccagctgtaccattgcgccactgacgtcgccttggtcccaggagaacgacgcccacatatgatcaagccaatacgccgccacgaacgctgtcggtcgccgttgctctcctgctgcctctgcttctcttgccgccgagtcaccgacatgtgggcccggctgtttagccacttcattaggtgctaaggactttaattagttgaaattgaaatcttgtaaggttctttttgtaaaattgctttgtttgccatgtgggcttatggacctaaaagcaattcccctaatgcccggggacctttttgtatagggtttagggcttaccctaaaacatgaaattactatttcatgcattcattatgtcgcgaccgagaaaattaccttttcccgaacgctagtgtattaatccccgtcccaggaaaagccggggtacaccaaacaaacatgatacaaaaggcacatctttattatgtcgataatatttacattattacaaaggcacttgaggcctgacaaacaaaaataaacagcagcggactagcgggcctacggctccatcttcacaggcgctcaactggggtataagccaggactccacctaagacttcttctccaaagcttctcctactgaaggggggaaagatagagcaagaatgagtataaccaccgtactcagcaagtcacaccgggagatgcatgattaatgcaagggagtacaaggagataataataggggtttagttttgtagtaaatagcatttaaaagtcatttagttgcccaaagctattttataaagatgatcctagagctacacagtattattaatcaaggccgtggacccacacgaacctgccttaacccaaggcctacgatgattcagaccgaactggcaacccgaccctgggtcccagctcatcccaagccaacccaggccaaccattccacattttagttgttaagcaggttttaagaattaaaaacactaactttggtacattgctaggcttgcccataatcgagggcgcggctattcgaataggttttactctgatcagaggtgtacatctttacccacaagacacgtcttcctcacgtgcaaccacgtgccacatgccaccacggcatatggacggaagacatgacatagtttccaacccatcctagccatagacaagagtaccgacccaaccccacctacggccggaacctccgggacaggtcggtaggactgagcccctagcagcagggcaccaaccctgtgccatgacatctcgactaccgggccacagctcgtgtagccttcatttgtcctagagatgtccatcgagccccgacttcatccatctccatccgtgtacttttgtttataaccagactgagccacaaactaagccttacccactagacatgtggaagtacggtagtgctttgcaacagaggcccgagcttaatccttatattggccggggtgctacttcccacaactggcatgcacccaaaccccaccagaaaacaggttttaggggttttgaaagaggaagagaggggtatgtccaattccaccataagccaaccattccatagtatccaagagatatgaatattcacaaagtctaaagttataaaaaccacctaatgttgtcctattaatcagcgaagcatctacctaaattcatactagtggaaccatgaatagagtacccactagttggggttttgtttattctagggtgaaataggtaataataacaatagcaataataatgtcttaacaaaggtaaatataaatggctaaataaaacagtgataaagcggtaatgcattaatttaaatcaaaataattttataaactgggattcaatatgctcaaggatgatgtgacttgccttgctcagagagaacggccttccgaaccttcggcgacacccgcgaaccacgcttctggaacctccggaacgatagaagctacgcgaagcacacaagcaaagctacaagcctataaagaagaaataacaatacataaaaagaaagcacacggttctttaggttataacaaacattaggagacttgaacgggtcgatttagagttcgtatgaccaagacatggtcatccgaagtttaatgctgttacatggagatttacggattattataattaggctttgcaactataaaacatgtggaagcgctagcctggaaaagacaggaaggctgcgctgttgacatgcggaccccacatgtcaacctaagggaccacagtagaccgagtacacagagacggtccacgggtcgacggaagcggaccccgtgtgccaaccgaggcgagtggccgacaaacggactccactagacaccacgcgggttgcacacgtggaaatcacgcggctaccgagcgggcacacaaacacggtcaccacacgcacccacgaacgactaccgacaccggtacacgggtaccggggtcgacaaccgcacaacgggtacggcgcgacaccaaaaggacgaggacggggaagcgagaggacggatccttaccaccacgcgacgaggcgtgggaacgacaacgacgaacgggcgcggcggagacagctcggggatgacggaggcgaacggcgagggaacgacttcggcggcgatccttggacaaggcttgacgacgcggagtcgaggacgaagacgaggacggggctgccgcggcttgcttggcggacgcggacgacggacgagaacggctcgacggagggacgaacgccacgacgaccgggaacgacgagaggacgacgatgatgaccaccggggccggtgaggaggcgacgagggcagccagagcggctgcacggagaagaggcggcgctgaacacgccgctgcgatgacgatgacggtggcggcgcagcgagccgacgagccggggaggaggaaggggcggccaaatggacgttggcgacgacgaggatggagaggccggcacgggcgacggcggtctccagacgaatcaaagagcaggccggggtggaggtcgacgcggcgacgccgaaggaggagacggcgcggccggcccgcacctgagcggcgcggcaggggcggctggaggtggtacagtggcggcaacggcactggacgacggcgggaacgcgcctccggtggtcaccgcgcgaaacggagggcaggccggtggagaggaggcggctgcgacgctggaggaggcgacggcacggccggacggcgctcgggcgaggagggagaggcggctggaggcggccggcgcgggggaaagagaagggcgacggcggggaggggtgatacgaccacggggaggctcgggatgaggctaaaacgatagaacggaggatggggattccattttataggagaggagagggagccggccacgggggaggtcggaacggaggcgggaatggcgaccggcggccatggaaagcggccggggtagacgcgtccgttcccgacgattgagggcgccattcaagggggaaattggggggaattgaagaggaatcaatggggattaaaaccccccacttaattttggaatccccggtttgaatgaggcggatttggaggagggagcgagctagggtttcacgggagagagaggagccgggcgggaggaaggagacgaccggcgcgtgggccccacgctgtcgggcgcgtggtcagcgcacgcgcggcgcgcgtgtgcacggctggctcggctcggcctggcttgggcgcggcttgggccgagcggccggcccaggaggagtggagggaggggaggcccgggagagagaggggaggggagggagctgggctgggagggggagagaagaggtgggccgggaggaggaggagaggcctgggagaggagggaaagagagggaggagagggagactttgggctgggcttggcccaaaggaggaaggaggatttatttttagtttttctttttagtaaactttgataattgtttttgttgcttaataattatttccggtgctctgaaaattgaagtaaaatttgagggctctttttagaccacggagaatttaacaaaaattctccggaccacattcgaatttttcttgtacgtattttagtgattgccaatttcttttcgaattttaattaattctattattccttttagaaaatgatttttaatttcgggatgaatttatcaggacgtgacacattacttgatataatagcttgatgattatattgttctcacccttgtttttgccgaagccaggagtttaatcatataaattagtttcattccaacttagttcccaagtgtagattagatagatggtttaattctatagcaaaatattagagttggctcatcctattgcttctacagtaatagttagccaaaatcttgtaaatacccaattattttatgtaaacaaatcttcattggagccttaatcaaatgtatgcgatgaagattcagattgatgaacctgtatcaatctactgattcaggggatgattatcacgcccggaatttctatccaaaattccaaacgcttacatgtgcgttaaaccctcgtccaggaatcagccgaggcacacaataacaaattgataatagagtactatcaaataactaattaatatgcgcagaataaattattacagaggtggatagttcctctcaaagaacaaagttctacgcagcggaaaaaaaaacaaaagactaaaccaggaatataccattccaaaccaggagtcaatttagtcatcacagtattttcattaataatgagtaatgtgagactaatcacgaaaaacattgttagacccacccataaccgcgggcacggctattcgaatagttttactctgattagagatgtaccactgtacccacaagacacaactctacaacatgtcaccatgcacctcagtaccaccacggtaccttggaaaagaactgtgacaatacctctcatacaacacaactcaccacagtgcaccgttcgtggatcataatctccccctcataaccagaggcaacgaactccccagcgacccccacggacttctcgctgcttcacagtctggcaccccgtaatgaatcatgctatacaaaaggtaaagccgttgctcacgctggcttgtggttggcacggtaaatgtttcacaacagtagctcgtcaaccagtccttaattgttatgagcacgaccatcaaaaccatgtactcacaacccacctttcatcaggtttatgtatca

SEQ ID NO: 46511 - DNA, 1652 bp, Oryza sativa
cgcggctcgactcgacgacggcggcggcgttccagcggcttgcgacgacggcgaaggggcagccgaggtactcctccaccgtgcaaacccggcggcggcgacggacagcgacggcggcgacgctagcggtggcgcggcgcgactggagagtcgccggcgacggcggcgccgctacgaacaacggcgggactcgggacttggggcaaacggaagaggacgactaggggatgctttatataggcttggattagagagatcggactccaaccgagaggaatcgagccgggaaaaactagggttagttaggagagataaactcaaaacgaattcgatttggtttatctgggcaaaattgatctccgaaactctaggggaaagggagaggataaggaggagatgatttcccctcaagcaaccggactcgggggcgaccggttgaggttgaatcggaggagagacggcggtgctcgggctcggctcggcccggccggaggtaggggatgaccctgacatgtgggccccatatgtcggcggctagaggagaggagggacggctaggcttggattgggccggcgtggctgcacggccgcgcgcgagggacagggatgttgggccggaaacagcctaggggaggattttaaagactttttcaattaaaataattcgtgaaatgatgtttcatttattaaaaatacttcccttgctcaaataattcccagaaaaatctagaaaatagataagcaagcaaagtatttaataaaattttatctagctcaattttgtgttgaaatttttcctagattattagagtttaacttgtaggtttttaaaataatttctaaaaatgcattaaaaattgaattattaaattaggcgattttcagggcgtgacaaacctaccccccttaaacggaatctcgtcctcgagattcagaagaactggcaaaaagatgaggatgagctgacttcaattcatcctcccgctcccaagtggcttcttcttctgaatgattgctccactaaaacttacagaaccgtatgacgcgattctgggtgtttctctcactcacctccaaaattctgactggcttctcaacataagttaaatcttcttgaatctctaaacgctcaggatctgcttcctcggtaggtacactcaaacatttcttcaactgcgacacatgggaaacgatcatgtattccctccattgacagaggcaactctacttgataagctacttcacctctccgactcacaatcttaaaaggtcccacaaaacgcggtgccaatttctctttggtctgaaaacgatgaactccccgcagcggcgtaacccgtaggtatacataatccccttcttcgaaagtcaaatccctacgacgattgtctgcatagctcttttgacgcgactgagcaactcgcaacctttcttggataatcttcactttttcttctgcctctcgcaatacatctgtcccaaaaacttgacgctcaccagtttgatcccaaaggagcggtgtacggcacttacgaccatacaatgctttgtatggagccatttgaagactagcttgataactgttgttatacgagaattcagcatacgacagattcttatcccaacttccaccgacatctagaacacaggct

SEQ ID NO: 46512 - DNA, 917 bp, Oryza sativa
atccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtggacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaagtcgtagacgcccaacagcggcggcataataggccagccgtgt

SEQ ID NO: 46513 - DNA, 26578 bp, Oryza sativa
  unsure (1)..(26578): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactgtttgacaccttttaagatgcatcgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggtcaaccgtcaaggtgaaataataagtcggcgaaaacataatcatccattagcaacagcggagatgtcagggtcgatgaagcagaggtgctggagatgatgtcagtgacaataatccatcaaattaatgttatagctgttgtagatgcttcacttggaggagagttgatgatgttgtccaactcgtccaaaccgaaatatttgaagttgttggagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcatggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataatccagacgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagtcagccgtgaagaagatagcatcagttggcgttataacaggccagccgtgcaggcggtgacaccagtcagcggcggatgcggtggccggtcggtgaagacgtagacgcccaccaacggcagcataataggccagccgtgcaggcggaaacaccagtcggaggcggcgaaggcaagccggtcggtgaagacgtagacgcccaacaacggcggcataataggccagccgtgcaggcggaaacaccagtcggcggcggacgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggattaaaaataaatacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaagggggtagcgcacgagatctaaaagtggatggatgcagagacaaaggatttagacaggttcaggccctctcaatgagaggtaataccctactcctgtttggggatttgaatccgccgggtgtagtatagatctgacgatcaggttgtctcatatgccccctagagggcctcctgcccaccttatataggatggggggcaggattacaagatagaaaccttaaccaatacggtatcggtttcctaaatctactttacaatattaccaaaccaggactttaggctgttccgtaatatataaggaaacgtaatacccgagccatgatctgttacatattccatagatataagttatcccctatgactagtcggataaccatgccgtatgggtatggggtacccataatatccacaccggtggagctggtttaagtattgttgctgccgatttcttcctcacagcagtcttctttttctgcaaaagtgagatttataagtgatcggctatgaatgaaataactgcaaaaggaaattagtatgagtggtttacccttgagaaatgagctagggtagcaggagttgggggagtttgcttgggtgaagccgatggtgttttttctgtatcacttactttggctgcagcttgatcgacatcttcttcgatctcttcttcatccagggcttgctcgatggatggatctaaagcaggcaagtcatcggctggcttaggtttgttcttcttggtcttcttcttgggagccagagctgattggtcaatagccaatgccttggcctttctcttcctgccaacatcggccggttctctcatctgtcgttgaagcagacttgaggtcttaggggcatggtagccgatgacaggaggagctaatccacctccgtttggtagaaggcatggagcatattctatgtccctgccgctattgctcttgcgaggaggagaagattctgttgtctgcaaggtaaagagagaagttagtcaagattcaagtcagctaataattattcaaacaaaattggcaaaataaagatgtacctgagggacaacatcaggaaataggtctgtcatgtacatagaagccgactgatggaatatatgttgcttccattcgccccaccatttgtcaaaattcctactcctgagtcttgccaactctatgttctcgatgctgcccagagggggtgatgtgcactagggttcccgatcttcctaaaggtcctgataaacaacggtttggacggagtcgcgacacagatcgacccggcttcttgaacgcgcacgctcttgagccccgcaatcgcagcaccacgtctcctctggttatcacccgtgtcgaaacgtggatgacctcgccgagaaggctaatccctgtttgccaatcgaagaacacaaacaagaacgggatagaaaaacaaccaaaattgcatatgaatgattaagctcacgagttggggtcttacaaaccgatctagcggcgaaactgttctcgacagattaatctaagcaaaacccaaaaacctaaagatgttggtgggtactgatatatagagtttaggtcgtgtaaacccctctcgacgcaaccctaatgggttccaacacgatacacgggccaaaggcccaaatacggtgacgcagcaccaggacagattctggacgtcaaattgttcggacaattcccgttgactcggaaagaatttggatgtggaaccaaaaccattggaaaggttttcttcttagctttccatccatataaagaacgccctaatccgagcacgtatgtgacctgggcgcccattttagtgtagactggtcctggactccgaattgcacccgacgtcgagttggtttgggcctccaccttgacttggacgtccccgatggtcctccatggctctaagtatttctccaagtgtctccttgtcccctccattgttcctaagcacaatataatcattaggtagcaagctattcttgaattcatacaaagaagaacataggaatgaactcacctctaaatttaattgtcgcgcacgagctcttgttatcgggccttgaatgaccattggaggattgttgtgtgtatctgaggtagtgatgtccgcatcagggggtcctgggatattgagtagccgatccatcatcagtgtggatgagatctcctcgcttcattggattttatcggcaaagaataagccgattggcgtctatcccattccaaactgtctagcatgggcaccaaacttgtatgtttcttccttgatggatgccgacaggaaggatgcatggactaatagcagccgagaagacttatctggacttgtcaaatttttcggaattgatatcctcaaatctgaagtctgctgggatacccaaatttacttaatcttcgtatgggaaccaaactcgagcatctctctggaagccttcataaaagctacagaaccaatccttgagcaattcagccgataactttgctccagcatcggctggtgtggatgcatattccccataggacatacacctgcggtgggtgcgctcttctccatcatcattggtaatcggctttaatcttggaaactcagcttctgtcatagctggccgattgacagctttcatggctaccaggtttagccaggtttgcagcaaccaccatggcccgcctacactaacagctgagcagacaacaattttagccgatgcattgttcagcatttgatacaagtagccgaggaggatcttgcctaaaggaaattgcctctttgattctaaggcttcagctaaaaactgccagttggttgtggggccgcaacttgatccacaaaaaaggaatttctcaagccacatcagcagaaaggccacttgttctcgggaggtggcagttcctttgcccatatatgctgctacataatcagaccagccacatatgctcttagttctgaagtcaaactggttcttggtgttcaagctcatgaggttagccgacgaggtcatatccaaaccgatgatcatggtgatgccaagcaaaatggggttcatcggcccttggttgaacaggaaagcattaatggtgttggaccaaaaataggtggcagcggccatcaggggttcatctttagctgaatttgctatggtaaggccaagtgcctggccgatgccgatttcgtcccaattgccctgcttgctacccgataccagtttatgccacacagaccaacttttctccgtagtggttttctcaagagaaggccaagacataaaggtgtttttccagtgacctagatttgggttggccaatctaaaagggatcctattggtttcagcgatgatgaactcggtgggatcaagattgccgatcggaccaaggaaataatggtgctcatgtgacagactcgggatcgtgtccagattggacaagtgctacagatgtaaacaagaatagagaagaagaaaataagatgaggcaaggaagaaccaatctattgcgaaagaagaggatctagccgatgggtacttaactctgcgtatttttccgatggcgcgacggatggactggcggaggacgacatctttgcgagcggatgcttggccggagaggaaatcatcttagggtcgtctggtgcacccaggggatcgccggagagagagaggacgaagttggcttaagcggtgaaaaaggagctaatggtgtgaaatttctcggggacgacggttagtatttaaagcagcgcgataacggtcggaaaaacggaagtgcgatattctctcggagatgagatatggcaaatccgaaacattaccaaatattccggacttggggtcatgtgttaacgaccaaatttggtaatccaagtatcagagatgaagataggatcgaagcggaattcaagatagaaattaatctagaaacagagtgaggatcggctaaagttcgaatcggctatgacaaggatcggcagaattcgagtcggactaggttggctgattcagccgataccgacaatgtgacgtggtacatgttgtcgggttgagttaatatgcttcatgaggattgccgtgcatggattgaatcctgagaaggcaattgtatctattaattaggatatttcatgtaatttccttagagatatgttcgggcaaaagtctgccgaaaaggattatggtatctttgtcgacgggtggcacccgtagaccggatatagagggtattggggtatgttggtacaaggatctacgtaatacgacatcaagcaaataaaagacaaggattatactggttcaggccccttgacaggtaatagccctaatccagttgatatgggattatatggtggaaaacacaggttacaaagggaacaatggaacatgacggatccagcaagatcgtggtcgagttggttcgactagatcccggcgatttggctccttgcgggctccgacttcgtaggctgtgacggttgtgttagctctgagattcgatgccttaggtactccctggggggtcccttttatatcgcaggtcaggcggtctccaagtagaaatcggagatatcagaccctatacgatacattgacgacccagtcttgtccgagtaggacttttcccatccgtagattctgtgaatgatttccttagtgtacgcaggaagtatccgtatgcgcgtgggtataccataccgatatgtgacgtatatcgaagggtaaagggtatgcctaacccgtaaccctgacagtagcccccgacttctgcttaaaatgagctcgtgtaaccattcacaacttctagcgtcgagactgttgtcgttcccagtgcgaggaccgtaaagacaagacatagtcgagaacaccatttgaagcccaacggtcacgagcgaatttgaactgaagtccaaaaaaccgccgcgcgtaacagacccagaaatttccggcgggcatctcagtcacgcccggaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcatctcaatcaataaagttctaagcagcggaaaattaaaagaaacagcgcaggcgactcctctccacaggcagcttgaccagggctacgcctaatcatccactccatcagcatcattgtagaactccttctctgatgaatgattgcaaggtgagtatacgacatactcaccaagccacgcagcaaatatgaaattgcacaggataacaaaggatggcatagtataatatcatttgcataaatagcatttaacaaatatttcagaatttaataaaacagttaaataacaattaaacaatattaatccaacgctatacaacataccctgttgcataggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcatggttattcgaatagattaaactctggccagaggtgtaccactgtacccacaagacacaacctcaacatcatgtcaaccatgcgtcgcgacacttgacaagtacccgaatagagattgtgacaataccctctatacaaaacaattcaaagcaatgcaccgttcccggatcataatcacccccttataaacaaggtatggactccacagcgacccccgtgggcttatctccgccacttcacagtctggtgctctactatgaaccatactatacggaaagtaaagctgttgcccacgctagcttgtggttggcacggttaatgtttcacagccgaaaatcgtgaaccggtccttaattgtcatgagcacaaccatcaaaaccatatgctcacaacccaccattatcaggttttagttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtaatcaagaacaaaagagctataacaaacaataggttaattccacctaatgacattcaaaaataaatgcaatagttgaatagaaacaatagctttaaatgggatcaacatactcaaagggttgtttgggatctgtgtgacttgccttgctggccttggaattcctcaaaatcttctcctgcaaattcggactctccgagaacgtcggaatctaaagagaaaagaacaaaatcaccaaaacagcacacaaacaagcatgaacagtatatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagatgattattacgtcagcggctagggttcacggtggaccgggtgcacggcgggggctcacgaaaacgaacggccgagatctaaccctatccaaacagacggccgagatctaatgggtctaccgcgactcacgggaagcgacgatgatgacgtcggcgatgacgtcatcaccggcgacggctcggatggtgcaagctcgccggcgaactacggcacgacggcactaacgaaaggcatctaccggttgcggacaacacggcgaactcacctgtgaccaaagcagcggcaacatggttgacacgagcctttgttgctggtgtggaggagttgttctgagcagggatgacctttgcgcggcggggcttcggacacttatcagcgtaatgtcctgggccaccacagttgaagcacaccccgggcttactgccttgctccctcttggcatgctattgctgtgacggagctgcaatagagcgtggagcttgattgcggatgttgttgcccgcgctgttgttgaagaactggcgctgcggatgaacaacaaacgaagaacctccctgtggcatagattggggtcccaaagcaagacgcggcctctgactatttccctgctgtgccttgaagtgagcaatccggcgtttcttctgctccatgcgattgtacttgtcctcctggcgaatagccttatccactaacttctggaaatcatgataatccccagtcatgagtgggtaagaaagctcatcatttagtccttccaagaacttctcttggcgctcttcatcagtgcgcacatcttccggagcataatgagccagacgattgaactcgtgaagatactcagtgaccgtgcgagaaccctgagtgagcgacctgaactccttcttcttgagggacaccactcccgatggtatgtgcgtcttccaaaaagcagcggtgaactcaagccaagagataggttcagcagtagtcctgttaaggcggaagtgatcccaccactcagaggcagggccatgcagctggtgtgaagcaaaagagactttctcctgatctgtgcactgaagcaggtccaacttcttctctatggtgtgcagccaatcatcagcttcaacaggattggtggtgctagagaaagtaggcggcctcacacgaagaaagtctaccagcttattctggggaggcgcatggttgtttccctggttctgctggttctggagttgctgcatcatcatattcataagctgtgcctgttgagccaggacttgagcaagcgtgggattctctgcattgttgttgttgttgttgttggggttggggccattcccgttgctgcgagtaagcaccatctggcatagagaggagcacaagaagagaaacaagggaaaaactacttagaatagggaattaattttactaacttaacttttattgatattaactgagtttcactattagaaaactgaaaactctcacacctctaaactcaccaacctcctaaaactagaaagcaaacaaagacatgcatttacatcccaccaatgatgtaaacacatgcaagacccactcacacaaccaaacttaaacaagcaaactaacacaacgatctaaggcaatgacttaacaaggcatctaggtcttccgggcatcggagttgattgaaggctcgttcggtgcgtccccatcgtcttgagttggtccccactcgatcttggaatgggtgcgcttggattcttcttcatcatcatcactcacattgacgaccggaggatccgctggggctggggtagcttctttttccactacacgaacctttggcgccaactggtagcgagggacgaatagagctctcttccttgcggtaagacgaaccttggccttctgcggtggtgcttctcccttcaatgctgctagctccttctccaaatgatccaccttgtcatctagcttgcaaatctttccccggttccggtcttcacgatcttgagcggctatcacaatctcaatgcgggtttcatccatagcccatagcatctcaaccaaatgccttgtggtagcatcattctcaatccctgccggttctaggtagctgccacggtcacttccctggggttgacgaggatggtaacggtactcggtgtcggccaaccgatcattgtaactttcgcggagctctcctatggcgatccttgccacctcctgacaagcatgaatgtagcttccccctccagcctcgaacatcaccgatgggatatcttcacgattactgttcaaggtgactttgacccagcacttctcttcatcacgatcatgagggatctgggcatacaaaggggcaatcccaaatcctatgaggaaagacatcgtacgcaactcctggacaaatccttcagtaccaaacaagtactcaagcttgtagcacagcatctaaagacaagtgaaatgagggagttaagtcatttatctagttaatagcacaagtttttgggttagcttgaataaagttagaaattcaaagtaaaaagtaaataaataaagcaaaccaagcttgcaagataagttgaaacagttagaaataggttcacaaactttgcacttttgaataacaggtatcaaagaaaataaataaaagagagttataaaatcgatatgctaagcttagttcattgcagcaaaattaaataaaacaatgttataaaacttttgatggtaaatgggccattagtacggtaatagatgtacagtactaacaacacaggaataataaataaattttgaatgagaacaataaaagaggtcatgaattgcatgtgccattagtttggtttaattaaaagagagagaggagaacagttctacttttccaatatctttagagggcttctatgggtaaccatttggcaaaacctagggtcaaggaggctccgataccaacttgtcacgcccagaatttctatccaaaattccaaacgcttacatgtgtgtaaaccctcgtccaggaatcagccgaggcacacaataacaaattgataatacagtacaattattactctaattaataagcgaataaaatgtcattacagaggtagatagttcctctcaatcaaaagaaacagcgtaggcgattcctctccacaggtagcttgaccagggctacgcctaatcatccactccatcagcatcactgtagaactcctcctctgatgaatgattgcaaggtgagtatatgacatactcagcaagccacgcagcaaatatgcaagtgcacaggataacaaagaatggcatagtataatctcatttgcataaatagcatttaacaaatatttcagaatttaataaaacagttaaataataattaaacaatattaatccaacgctatacaacataccctgttgcatgggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcacgactattcgaatagtttaaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccgcatcataatcacccccttataaacaaggtatggactccacagcgacccccgtgggcttatctccgccacttcatagtctggtgctctactatgaaccatactatacggaaagtaaagccgttgcccacgctggcttgtggttggcacggttaatgtttcacagccgaaaatcgtgaaccggtccttaattgtcatgagcacaaccatcaaaaccatatgctcacaacccaccattatcaggttttggttggcaagttaattaattaatcaatcatgattaaccatcatgagctatcattaagccatcattaaataatagtgaagcataagttatcccaatagtgtgctaatgtttctaagcatggctaagcacttatatctaatatccagctgaacccatatataaagctcaactagtcaagttacaataacccaaggtatcaaggaataaagtactgaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaatgacgtcggcgatgacgtcatcaccggcgacggctcggacggcgcaagctcgccagcgaactacggcacgacggcgctaacgaaaggcatctacgggttgcggacaacacggcgaactcaccagtgaccaaagtagcggtggaagatcaacggacggtgacggcgacgaggttgatacggcggcgaccttcggcttgacgacgacggcgatgctccggagacctacggcagcgacggaggggcggacgaggtcagccatggcttgtgatcacgatggcgaccttcccgagtggcgacgacgactggagcgacggcgacgcacggctagaccagcggcgatgacggcggcgcacggctgcacggtgctagggctctaccggcaacgagaggcgaaggcgagggtggcggcgggtagcggagggcttgggggtccttttataggggctagggggcggcggcgaagtcccacggcggccggcgacgagaaggaaagttttagggttcgggaggaaaggggaatccgaatcgagctcaaatccgatgatttccaaagcgatatagacgatgcttccaaaaggaaaaaggtagaggagatctcggggatcctttcccctcaatcaatttcatcggatcgggaaaggggcgacggaattggatgggcggcggcggcgcggctcggctagggttcgggcgcgaggaagacgacgaccccgacaggtgggccccacctgtcagcggcggacgcgcgcgcgtgagcggcggcttggctgcgggccggcctgggccgaggagagagagagaggggggttttgggccgactttcggcccaaagccagaagagaactttttaaaacctttttcaatttaaattattcatgaaatgcaattccatttattaaaaatacttccttagctcaaataaatcccagaaaaatctaggcactatagaattaagcaaagtatttaataaaattttatctggcccaattttatattggattttattatttaaaattagatcttctcttctaggcttttaaaataaaatctaataattccaattaaacaacaatttatatatttgggatttttagggtgcgacaatctctctttgttccttggaattcgcaccgtcagtagtgcgtctatttaaaggaattttggggatccattttgaagtccgcccaccgtgcagaaaacatcccgcctgcaattgctcttcgtcttcttcgctgccacaagaaaccctagttcatcgacctaagccctttctccagcgatcttcgatcagtgatggatctcggcaaatcattctccaccagttgcgatcgaagactatattctctgcggttttctccctccgccttccgaatttcttctcttggttttaaacttctatggtctttctcttctccatttgaaccccaattctatcacctttcttagcatcttttctcatctttgcgaggcctacattggggtagagccttttcttgatctctttcgcttctactacgagctgcgttggatggagtccaacagggtatctggttgcgtcgtgttccgacttcgcgatggcttgaagtcgcgttatatccccttccagtgcccttcttctcgcagcaaatgtcggaataggtggttctatcttcagatcaaagattcagaccctgtcttcgttgttcccaaagaacaaccggacaagatttcgtcttggaccgcaaagccccctttgaccccctctctctagtcgtttatcgacattattgacgatctccgagtacgaggcttgtcggggtatgaagtcgctgcagacttcgttggtaggcggatccagccgctccaggctcgggcccatctagcctttgactattccgaaccggaggacgcgacccgggtttctcctcggggtatctttctcgcatttatcctgacatgctcttgttcgcgttcctcttgatttatcgagatttggttcttgattcgcaggtctgaacagcgaagccgtggaacgtcgtgtcggccaggtgatgatcagtggtccgacaacggcgagtaacatccccgtgcccctttgtgaaaagggggcggccgaacatgatgacgccatcaacgtaagtgttctcgataggcatcctgcattttcctttcgagatcacattgtgacttgattaagcgtaggctcttcctctgactgacatcatcgggccgctcgcggaccatcaggtggcggcgtctctgaaagagaaggtcgccaaggaggcgtctgatgctgctgctactaccactagtggtggcaatgttccgacaaaggggaggaagttctcctctgtaagcggacatcatcgcaaggcgtcaacccccttggtaagttatcctgtcgtcagatcgtacagccagaagaattacgccttacttcgcatcgaccgtttttcaggcctcggacgcgtctcccccgcctccacgacgacaacgtcttgtgacgattggcgagaagtaagtagacgaatcttaagcttccgtgattttattcgagtgttgtctgaaccgtggtcgtctcacagggcagcgcgggtgaaggctgtgcaagacaagtccggagggacctccggcgcatcgcccgctgcggcctcgacggatgtcgtgctcgcacccgggagccgcgaggtgacaccaagcggcccagtcagcgatcccgcggctggtcgtggtccaccagctgccgtcctcacctgggaggagctccaggtcgagatggggcgcctcctcgaggctggtgctcgcggcatcggccgcgagattgcagaggcgaggtcggaagcagcgttggcgaacgagcgtgctgactggctggtacacgagttagcggaagctcgtgaagacctcaagaagatgagggagttggtggccggcaacgagcgacaatggcaggggctcgaggaccgcctgtcggagctcgggaacaacctgtcggaaatccgtggctcgttgcgggtcacatacactggcctacaccagctcgccggggagtgcggcattaagtctaccatcctggcgaatcccgacgagttctcgctgacatcttctcttgcggaactggcgacggcgatgggggagatcccctccaagcatgcggccaggatcggggaggaaacgtcgaacgggatctacaccggggcgtgccacgtccccgcgtgtgtaaagctatcgcatcctgaagtcgatctgcgcgagatcttggatcaggcggcggctagcaacacgcgtaaggaggtgacaaaagaaatcggtgatctaggggaatctgttctccccctatttgaagagtaggacctcttgtacccccaagacatgctgtgtaaaactgaattttaaccgcctttgtgcgtgcaattatcattgtagtttactcttgtatgttgatcttgggagcttttgtcctttgtagagatgttgatgacgaggatgtccaggagcgcgggcacatgtgtcgcccgacaatgtggaccagacccttgctacggggacggagatgacgacgacttcctcaggttagtagtccgttcatcccttgatgccctcccgactagataaactatgttctcgaaagaggcgtatagcttgacttagttgttatcacattgagcagatctcgagaatgcccttgctggccaagatcgtcgtatccaatattggaagacgaaatttgaagtagcggaactcgagagaaccatgctggcagtgaagaaaaagcaggctgtggaaacgctccgaggtcgtgaggtgtggttcaactcatacttgaagagttgctgcacatccatggccagggtctgtagagaacttcgagtgccccgtggagatccggaggagtcggcggccagatacatctcacggctgaacggagcctgtgctcaactcgatggcatcggcaagcgtattgacgaggccttgaagcaggagtgtcgtcgatcgagctgatatgccggagggcacgtgttggcttgcctacgagatcatcgcccgcgcctggacctcgattgtctccatgagggttttgctcgttctcggaagactccggcggagatagaccatctggcgaggtcgatgtcgccgttggcggagaagatcttccagtctatggactggcgttggccttcttggtaatcttcgtatcctgtgatagatatctcaggaaaaaggtgtaatatagctctgaatttgcgtaaaaactgtaagaagtattttgtgaaatagaaaataaatctatctttaataaatctttcttactcctgatgtcgtgtgtaagagtgcgttctcagttcacgactttagtcagccgtttgagttgtacactctccctagcccccagccttgtcgtcggaggaattttctcggaggataaggctcttgtacctttgacctgccttggttgaataagctctgatcctagcccccagccgtgaagttggaaagttaatttccgatttcgcggcttggttaatacgcacggcgagaacccttacacgaccagatcttacatggtctttcgtctctacaggatctgacaaggccttatcggctctgggcgtccccagccgaagatcccttaggttcctcggaggccttgtcaagacggcgtaaagggacatgaggacaggtttcaacgctaggtgtcattagggtaagggatcatcgggcggaaacactttgactgtaatatgggcctaagaataggctttattgatactgtaaggtgtcttacaggtatggatggtattgactcatacatagaatttacgtagttggtcaatgttccaagaatttgctaactcgcgaccatcaccgtctgcgattttgaatgcgcctggccgcaagacttgtgtgattgtgtagggcccttcccattttggtgagagtttgtttcgccctgcttggctttgaactcgtcggaggacgtagtcgccgatcgaaagtatgcgtgctcggatgcgcttctcgtggtaacggcggagggcctgttgatagccgactgctcgaacggcaactcgttcgcgatgttcctcgagtagatttacatcgacgtttcgctgttcctcctagtcctcgtaggagtgcttctgtactcatgtactcggatgtcgtagctcgctggggagcatggcttcggagtcgtacacgaggaagaagggtgtttccttgttgtcagtgtggtgcgtacggtccatagtactgacgggagttcttcgacccattttttgtcatgtgacatgagcctgtcgtagacgcgggttttgatcccttgtagtactatgctgtttgccctctcgacttgtccgttgctttgagggtgagagaccgaggcgaagcatatcttgactcccagcccgatgtagtaatcctgaaaatcagcgctgatgaactgggagccgttgtcggttatgatggggtgcggtagtccgtatctgcaaaatatctccttgatgaatttgatggcgttgtcggccttgatttcccccgtgggtactgcttcgatccacttagtgaatttgtcgatcgcatttaataggaacctgtagccgccctgtcctcgtgggaatggcccaagtatatctagcccccagcacgagaacggccaagtaagaggtttagtctggagcgcttgagctggtagctttgtgtgtttacagtggaattgacaggcttcacatcgctggaccatgtggcatgcatctttaagggcggttggccaaaaaaaacacttgtcaaaaagctttcccgaccgatgttcgaccggcggcgtgtgacccacagatgccttcatctatatcaaggaggaggtgtctaccatcgtcggacgagacgcatttgagaagtaccctgtttggcactttcttgtatagatcgttgccgaccatacagtagattttttctttacgggttattttctcagcctctgtatcgtcctcgggcaactcctcgctgttgatgaatttgattagtggggtgcgccagtcgtctgtggtctcgatgtcggcaacggcgcgttctgcttttgtggcctccgagctaatgtcgggggtggccgagctgacttcgccgctaacctcttttactgatggcttcgtcaggatgtccagaaaagtgccgggctcgagcggttctcgtctggacgcacgtcgtgctaggtcgtctggctcgatgttgtcctggcggtagatgtgtcggacctcgatcccatcgaaccttttctctagcttcctgacttctgcgagatacttggataactcagggttagagcatttataatctttgtgcacctggttcacgactagctcggagtcccctttgacgattagtcgcttgaccccaagtgcggctgcagctcttatcccggcgagtagtccctcgtattcggctgtgttattggtcgccctgaagttgaggtggattgcgtgcttgaattgatctccggagggagatgtcaagataaatcctgcccctactccttggctgttgagtgcaccatcgaacgccattgtccacgtttcgttgtcgacttggttgtctgatttgttatcaggcatagtccagtcggctacgaagtcggcgagtacctgggacttgatggctgttcatggcgtaaagtggacattaaactggctcagctcgactacccatttcgcaatgcggctgacaacgtctttgtttctcacgacttcaccgagggggaaggaggagataactgtgactctgtgggcttgaaagtagtggcgtagcttccttgatgtcatgatgaccgcgtaaagtagcttttggatctgtggatatcttgtctttgcgtcgtggagagcttcgctgacgtagtagactggtcattgtaccttctctctctcgacaacaatgacggtgctaacggaatatggcgtggcggcaatatagaggaataattcttcattaggttggggagcaacaagtacaggggggtttgataggtagcgcttgagtgcaacaaatgcctcttcggcttcctgtgtccatacaaatgtcttgtttcttcagcagagcaaagaaaggttgccctcgttctcccatcctagcgacgaacctactcagtgccgccatgcatccggttagcttttgtacttccttgagtcttgtgggtgacttcatgttctcgattgccttgatcttctcgggatttgcttctattcctctgccagaaacaaggaatccaagcagcttgcccgacggtactccgaacgtgcacttctatggattgaacatgaggcgatatcgccggaggttgtcgaacgtttcccgcagatcgtcaatcagtgagtcgcttgtcttggtcttgacgacgatatcgtcgacgtaggcctcgacattgttgccgagctggtcgctaagtgcgccctagaccgtgcgctggaaggtattccctgcggttattagtccgaacggcattttcacatagcagaatactccgaatggcgtgatgaatgctgtcttctcttcgtcctcttttgccatactgatttggtggtagccagagtaagcatcaaggaagctcaacagctcacagccggctgttgagtccaccagttgtctattcgaggaagagggaagtgatcctttgggcacgccttattgaggtcggtgaagtcgacgcacattctccattttccgttggccttccgcaccatgactagattggctagccactctggatgaagtacttctctaatgaagccagctttgagaagtttgtcgagctcttctcgtatggcttgttttctgtctggtgcaaatctccgcagtctttgctttactggcttggcatcgggtcgcaccatgagtttgtgctcaatcacctccctggggacccccggtatgtcggacggctgccaagcgaacacgtcagcattatcgcggaggaaggtgatgagcgcgagttcctatttctcgcttagtgttgccccgatcttgacggtcttgtcggggttggcactggagagtggaacgatcttgattgcgccgtacggttttggcgccttgtttgtcttgcacactttctttggtggttcagtcgtggcgggtgggctaggtgtttgctcgaccatgtcgaggctccgtttgtcgcactgtactgccagctttgcgttcccttgaatagtgattgttcccttcggtcccggcatcttgagcacttgatacgcgtagtgagatgcggccatgaacttcgcaagtgcagttctcccgatgatggcgttgtaagctgtatcgaattcagcgacatcaaaggtgatctgctctgttcagaagttgttggcttggccgaaagtcacgggcaacataatcttgcccaatggtctgtatagtccgactaggtatggaatgtgatgtatagatagaatatctttaaagagactcgggttaagttccaaacttgtatgttaaggaaatatccgggatcctagttggttacgattaggtcatatctgcaactacctattccgttagggatatgagctgtattttgtaatacggactccttctcctatataaggaggggtccgggtgcctcttggggtacaacattctactcttagatcatacgatcaataatagactcggcggaataatccccagacaggagtagggtataacttcttattaagaaggcctgaaccagtataaacttcctggtcttcaaacccatcaacttttctagcttgatagccacccccttttagtattgccgaaatcttgtttcgtcatgtatcattgtcattttcatagccttcatcatggcgttgcgaatattgtgaatatatcaatggatcaacttgcatgccctaactgtgagcattcttaaaactccaaggtaaaaagagataaatgctgaagtgtgattcatgcatatgtacatattgctcctcccaaatggacatcatgcaggatcgggactaagacaacacattaaaggctctcatgctatacgcttcttgcagctgtagttaaacaagggcatcgagcagtagttcgataacaataagattcattggcaccaacaaaaccccatccattctaataaatatggcacgcatgtattttaagatttatctttgaccaagaattagtttaaatttacaaagatatttgatagaaaattagcatcatttcaatgtgtttttcaatacgaatacaacaattctatgtatatattactagtcatcaacctgtgcacttgcatgggctagaaaaattacgtgacatcaattaactagcatggaagctttattggtgcctccaattactaaatataagatttttcctttctttctcaattctttcggtcaaaaacgagcatgtgtgttattcatagaaacggaggtagtatttgtaagaagtacggtatcgaatttccaaaaagttccgaccttgtgcgataatatacacacacattaacctacataggcaagctagctagaccatgaaatataccatttctaaacctatcggtcacttactcacgttggggagcctaactaaactaacatggtctcacatggcatgcaagctagccatggtactaactcgtctactacgccatagtatgctacaaacacaactaagttatcttatgaaggactactcaatagtacacataaaacaatgttactcgttgctttttaccttcatttgacgggtacgagctaagtgtatctgaaaatcttctcttctgtccatcggcgaaagcgtacaattgtaaaattgcctggtacgcaggactagatatgaggagtttgtccagagattgtgcaacaaacatgtacatccatcaactgtatacatgcataggatatatacatacaatggaggtagccatttgagattgctagttagcgcatacgcgcgagttgctttcctagcgcatacgtacacgtgtctctcgtggagcgaacgagagaacggccgtacgacgctttcatcggaaacagaaaacgcgattagcgtctaattaggcgcagattaaccgagaaaactacgtctaatgcagttttagataatgatagtatgattttgtatatttctatttttttcaaagattttattaaagtaacagattgaaaagaaatctataggtgaaatcaaaattttaaaacttttaacccagatttggaacattgaactcgaaatttgaattttattgaagtcaaattttgaaaaatttcaacttttcatctcaaatttgaaaaactttcaatccagatttgaaaacattcaacctagatttgaaaactttcaacacagatttgaaaactttcaacccagatttggaaactttcaaaacagatttaaaatctttcaacacagatttggaaactttcaaactagatttgaaaacttttaactcagatttaaaaactttcaattctggtagaaagttttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataatgcttctgcctataaatagtagcagcaccttacattcaagaatcacctctcaacacaaaactaagaaacatagctagataaccagggaaggtagcatcagcaacaggaggcaatggagggaaagaggactaccacttcgatggtaatcatttgcctggtcatcttgagcctcactgtcgactccgccaccgcagcacagtgcggctgctgcatatcc

SEQ ID NO: 46514 - DNA, 1934 bp, Oryza sativa
atttgcctccctcatttcattaatttcaaaatattaaaccttcgaatcaaattttatcataataaatgaacctatatgaaaaggttgtcgaaaacaaagttgtataacttattgagatctacctaacttatttttcttatttatacatctgagtttgattaacctatataaaatttgaatttcaaattatgacaaccttaaataatatttttaaatactaaatgatttcaactgaaaaaatcatcaacaacaaagttgtataactcatcaatatctacaacttttgttttggttattttgctacatgactttctttcaataatttgaatatgaatttcaaattatgacaacttcaaacaatattttcaaatactaaatgatttgaactgaaaaagtcatcaataacaaagttgtataactcatcagtatctataacttttattttggtcatttcttcattcggtaaagtaatagtatcattgttcataaaatgaacttatctctcttatagtttataaactatataagagatatgtacattttgtgaacaatgttacaaatcgctttgttggatgaagaaatgacccaaataaaagttatagatcttgatgagttatagagatttgatgttgatgaacttttcagttgaaatcatctagtacttgtaaatgttggtttaagttgtcataatttgaaattcaaattcaaattattgaaacggagtcatattgcaaaatgaccaaaacaaaagttgtagatattgatgatttatataactttgttgttgatgactttttcagttaaaatcatttagtatttgaaaatgttttttttaacttgtcataatttgaaattcaaacaacatgcttgcattgcttccagtcttaatgcctatcataagaatatgttgttttgcttcaagttatggccaagttatgttaatattatcttcaataaattgttgaccatatggggcaatctatagtggattcatctgttggtctcaactatatgtatgtcgtgcatgtgtgcgctcacaagcatatttaatttgtcttgctgcttttaataaggccatagcactgtccaatgtgtcattcgatggtctctgaccttagcaatttattatgaccttagcaatttattacgacatgattaatattatttgtgtatgcatgttctttacttaatttattcttagcggatttctgatgtttttgtgaggtttagactatgggacataattaagattgtcatgccaaaaagtattgcaaaacctagaaggaaagcaaaaaaggcggggggggggggggggtgggaggaaacatagtcaatttcccggctgctatcccattcctcgttttctcaggtttgggagacatatagccacactaaaggcagtaaagctgaggaatgacaaccttactcacaaggacaaatagtcgttaaaaaactatgacatcactaaccatatcttatttccgtttaccaaacatacatttaaatttaggcagttttacggataactatatcaacaaacaacaatccatacttcattgtcaaaacaaattgccttctatgtacttcacaaattctcacaagatcatatttgcaatttttcctaaactaattaaccaatatcaaattttcagtggagcattccacatataatttcacattataagtatataatacactatggtataatacacatatgcatactatggcctaccgcaaaagatgcaaagatcaatgtgcatgctaacttgtgtataatacacatattcacagtactttgaaataagcataccaggacatatgcattagttcacaccattcattcttgcattcttgcactttcaacaacaatcagatctaccaagcattcttgcacattaaaccacaagtagatctaccaataaatcacaacctta

SEQ ID NO: 46515 - DNA, 703 bp, Oryza sativa
tacgacttcaccgccggcttgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccaccgctgttgggcgtctacgacttcaccgccggcctgcctccgtcgccgccgactggtgtcctcgcctatacggttggttggtcacaccaccgttcatgggtgtctacgtcttcaccgaccggccgcctcgtccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgcctccgactggtgtttccgcctgcacggctggcctattatgctgccgttggtgggcgtctacgtcttcaccgaccggccaccgcatccgccgctgactggtgtcaccgcctgcacggctggcctgttataacgccaactgatgctatcttcttcacggctgactacatcgctgtcactactaataggcatcagtatcttcaacacaagctgcctacgtttgccatgg

SEQ ID NO: 46516 - DNA, 1070 bp, Oryza sativa
ccgtataggcgaggacaccagtcggcggcgacggaggcaggccggcggtgaagtcgtagaggcccgtgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaagccggcggtgaagtcgtagacgcccaacaacggcggcataaaggccagccgtgccggcggaaacaccagtcggcggcggcgaaggtaagccggtcggtgaagacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacatagacgcccaacaacggcggcataaaggccagccgtgcaggcggaaacaccagtcggcggcggcgaaggcaagctggtcggtgaagacgtagacgcccaataacggcggcataaaggccagccgtgcaggcggaaacaccagtcggcagcggcgaaggcaagccggtcagtgaagacgtagacgcccaacaacggcggcataataggccagccgtgcaggcggaagcaccagtctgcggcggacgaggcggccggtcggtgaagacgtagacgcccaacaacggcggcataaaggccagccgtgcaggcggaaacaccagtcggcagcggcgaaggcaagccggtcggtgaagacgtagacgtccaacaacggcggcataataggccagctgtgcaggcggaagcaccagtcggtggcggacgaggtggccggtcggtgaagacgtagacgcccaacaacggcggcataaaggccagccgtgcaggcggaaacaccagtcagcagcggcgaaggcaagccggtcggtgaagacgtagacgcccaacaacggcggcataaaggccagccg

SEQ ID NO: 46517 - DNA, 871 bp, Oryza sativa
tccccgcacggatccggcagccagcctccttctccccacgtgggatccagctcccctcctctccccttccttccctccctagatccggcggaggggaggggcgacggcggcgttgtggccggaggggagcttggatccgatggcgggtggcggggaggccggcgggaggcaggtggcactatggccgtcgggcggaagcccaccgccggattctagggtttcgtttttttaaaaaaatatgttatttcgaatttttgttttcccgtgggggtgcgccacccgcacgcaaaaatcattattttcccagacccctaggtgcgtgcaggccgcctacccgctcgcaaaaatcgttacaaaaatcttgcttgtagtagtgaatggtaaaagtaggtggaaagtgagagctagttgtcaacatgaggggtagagacgaattaaaggagttggcagtggtttgaggctgtgatcccacttgtacttcactcaaccaagtatgagtggctatctattggccccatgtagatgtttcctatgagaagatgagaggtatggtgaagtttgggtgtaaattggactttagctccctctctctctttctttctctctttgaaaatataatttaggataatgagatgattcaccaaggttgtttgcaggtatttggacgacaaataggcccatatatagatgtttcctagaaggcttggagtggtagagtggcattttgggtggaaattcaatttaaacctttctctcaccttttgaaaaataaaagaagatttaaatgagagaagagcagatgatgtgttggctatggttgtatgatgagtgggccccataaggacttggtcccacatttaagagagatgta

SEQ ID NO: 46518 - DNA, 15020 bp, Oryza sativa
  unsure (1)..(15020): unsure at all n locations
actattcccaagttcaacttttcaaattcctcacataactcccaaggtaggtgtcgaccttctaacatcttacagtagcttttcttgctgagagcatctgctacaacatttgctttacctggatgataatccttgatcaactctaaccaccgtcgttgacgcatgttcaaatcaggttgagtgaaaatgtacttcaaacttttgtgatccgtatacatctccgtacggttaccaaaaaggtaatgacgccaaatcttcaatgcatgaactacagatgccaactctaggtcatgtgttggatagttattctcgtgggggcgtaactgtctagatgcataggcaatcaccttcccatcttgcatcaaaacacaaccccaaaccatgtctagaagcatcacaatacacctgaaaacctttccttggatcaggcaagactaacactggcgcagccgctagccttttcttcaattcttggaaactctgttcacactcttccgtccacttatacttcacatccttctgaagcagtcgagtcattggtctagcaatctttgagaagttctcaataaacctgcggtagtaccccgcaagaccaaggaaactacgaatctctgaaaccgtcttgggttgcttccaatttagcactgactccacattgcttggatccacggcaactcctccagttgagatgacatgaccaaggaacttcacttcgggcaaccaaaattcgcatttactaaacttggcatagagctgatgctcatgtagtttctctaaagcaagacgaagatgctcttcatgctcttctttattcttggagtagataaggatatcatcaataaacaccacgacaaacttatccagatattccataaacacttggttcatcaagttcatgaaaaaggccggggcattagtgagtccaaacgacataacggtacactcgagcaaaccaaaccgtgttgtaaaagcggtcttaggtatacctcctcacggattcgaagttggtgatatccggaacgaagatctatcttggagaaaactgtagcaccttccagttgatcaaacaagtcatcaatcctaggtagaggatacttattcttgatagtgacctcattcaacgctcgataatccacacacattctttgggtatgatctttcttctccacgaagataactggtgctccccacggtgaagtactgggtctgatatatccttcctgaagcaaatcatccacctgtctctttacctctgctaactcattagctgccattctgtatggtctcttatggatagggttggttccaggtactaagtctatccagaactctatgtctctcttaggtggcatacctggcaaatcctcagggaacacatctggatagtctcgtactattgggatctcttgcaaagcaacttgatttaatgtcaaaccgtgagatttaggggatgacacaaagaaagacactgtttgcccattgctacttgttaaagtcacattacggttagcacaatctataactcctatgtgatgggttagccagtccatccctaagataacatcaagatcattggattctagaaagataagtgaggatgggaaaggtgtttcttctatttctatggtaacggaaggacaacactgcgtcgaggatacttgatcgcctagggcataaactaggacagggctgccaagactaataactcccatgccatgattgcccgcaaaacttttagacaaaaaggaatgtgtagcaccggaatcaaaaaacacagttgcgggtatagagttaataggaaacgtacccaaaaccacatcaggtgcattctgggcttctgcggctgcaacatgattaacacgagccttcggtgctggagcattggagttgttctgaacaggtgcattcttcacacgccgaggcattggacacttatcagcataatgtcctggatcaccacaattgaagcacacccctggcttgcttccctgttccttcctgacaggatgattctgagttggagctgctacatgacgagtgaccatattacgattatcgttgctgtgattactagtgttgttgttgtagaactggcgttgagggcgagcaactgaagaggatcctccctgtgggtatggtgcagcttgaggtcccaaagcaatgcgcggcctctggctactacgctttttctgttccatcctattatacttgtcttcttggcgaatcgccttgtccaccaactactggaaatcccggtaatccatagccatcaatgcaaaagacaactcatcattcagtccctctaaaaacatctcctgacgttcttcatcagtgcgaacatcttctggggcataacgagctaagcgattaaagtcatggaggtactctctgacagaacgggatccctagttgagtgctctgaactctctcttcttaagggccacaacacttgatggtatgtgtgtcttcttgaaagcagcagtaaactcccgccaagtgataggctgtccctcggctctgtttagaagaaagtggtcacaccgctcagcagcaggaccatgcaactgatgtgaagcaaaggaaaccttctcctgctcggtgtactgaaacaaatctaacttctttcccacagcatgcagccaatcacctgcctctactgggttagtggtgcttgagaaggtaggtggtctcacacgtagaaaatctgccaacttgttctgcggaggtggtggttgattgttgttatttgcctgctggttctgcgcttgctgcactaatagattaatcaactgggtttgctgggccaaaacttgggcaagtgtgggatctccttcattgtgaccatttccacttccactttcacttccagtgcgggtgttcaccatctgaagaaaagcatgggcaaaatgaaagaatgacagagagatacccttagaacggagaactttagttaatttaaattctatattgctcttaattgtgtatgattacatttaaattgaattaacactatctcaccagctaacttactctctgacaagcaaaagaactaaacttatgtagttacatcccaccaatgatgtaagcaacatgctaaacccacacacgcacaagcaatcttaagcaagcaaactaacacagcgaactacggcaacggtctaactagacaactactctcgccttgcgtcggaacgaagagatggatcttcctcctctggagtagctggctctctttcttttgggtcttcctcttcttcctcatcacttaagacatggatgacaggttcagcatgatcaggcacagcgtctcccaccacacgagtcttcgaagctaactggagacgaggtggtagactggttctcttccttgcggtgaggcgaagcttgggtgctggcggtggtgcttctcccttaagctcagctagttccttctgcagacggtacaccttgctctccaacttacaaatcctgccacggttccagttttccctatcatgagctgctttctctcgctccacgcctactgcatccatggcgctaagcatatacacggcgtgcatcacagtggcgctaccttcaccttcgggacagttgtaagttctatagtcttgaccatgtggcttgtgtgggtgatactggaaagctgatgactctaactcctcatcaaagcgatgacgtagctctccaatggccaccaaggctgtttcctgacaaacatggctgtacttttttccctcagcttcaaactttatcgacggaaggtcttcacgatcactagtcaacgtcacgcgaacacgacacttctcctcgttggggtcatggggaatctggcgatactcgggggcaacctcgtaacctacttcaaatgccatcattctcagctccctgacgaatcctagcacctcgatcaagtttttcggcggatgggcatctaaagcaacatggaaaggaaggaattaatgcatatttttaagttagctgcacaaactagacttaattaaattggacccaaagaaaaagaaaataaaagaaaaggaacaaacatgactcaattttttttctttttggaacataaatcaaccttgaacagagacaaatagtttacacaaatgaataaattaaaactaaaatatttaggatctaccaggagcacggtacagtgtcaccattaacagggatgagtagtactgatgccatcttgattgaatcgataccataatagatgtacagtgccgactaaccaatgaaattcagaaaattaaactatttaataccctgaacagtaaagttttttttctttcaaaataaaagaacaaatttctgttttggtaaagtagaatttaataaattttgtacataaccttgcatgtgctgccaacttaattaatttataagagaatagagaagggcagttctattttccaaaataattagaaggcaacttaaggtttaccatttggcttgtcctaaggtcaaggtggctctgataccaacttgtcacgtccggaatttctatccaaaattccaaacgcttacatgtgcgttaaaccctcgtctaggaatcagccgaggcacataataacaaattgataatagagtactatcaaataactaattaatatgcgcaaagtaaattattacagaggtggatagttcctctcaaagaataaagttctacgccgcggaaaaaaagcaaaagactaaacatctatggcgactccacttcacaagcaactcgacctgaacaaagcctaatcctcctgatcatcaccttcactgaagcactcctcctctaaagaatgaatattgcaagaatgagcatatgacatactcaacaagccacacagcaaatatgcaaatgcacaggataacaaaggatggcataattaagctcattcgcataaacaacatttaataaacatttgagagaatagcaaaacagttaagtaattaagcaatattaaataaacactatacaacacacccatgttgcataggcccaaccttatctgaacaaccaacccctggttgtacaaatcaaacctccaaaccaggaatataccattccaaaccaggagtcaatttagttatcatagtattttcatttatggtggtacgaaaaacattgttagacccacccataaccgcgggcacggctattcgaatagttttactctgatcagagatgtaccactgtacccacaagacacaactccacatgtcaccatgcgcctcagtaccaccacggtaccttggaaacgaactgtgacaatacctctcacacaacacaactcaccacagtgcaccgttcctggatcataatctccccctcataaccagaggcaatggactccccagcgacccccacggacttctcgccgcttcacagtctggcaccccataatgaatcatgctatacaaaaggtaaagccgttgcccacgctggcttgtggttggcacggtaaatgtttcacaacagtagctcgtgaaccggtccttaattgttgtaagcacgaccatcaaaaccatatactcacaacccacctttaatcaggtttatgtatcaattaattatcataacacaattaactatcgtgagctaccactaaatataaccataactaatatcgtaatatgattaaccccattaatgagctaatgtttctaagcatggctaagcaattatacctatatagcacttagctggagcaaaccaatatataaggtcaaagctattcaatttattacccataggaaaataaagtcattgtcggccattaattaactgggaaaggctcaccacccgacgacattcgaaaataatgcataagttgaaataaaatattagctttaaacgggttcaacatgctcaaagggttgtttcggatctgtgtgacttgccttgagcttcttcaaacacttctgaaccttcctcaacgtaaacgctctcctccggaacatcggaaactaaagcaaataaacaaaatcaacaaaacagtacaaaaacaagaataaacagtacatgtggatatttttaacatgtagatcttgattttagatgaatttagcaacttgaaccactcgaatacgagttacgatgatttagttatgaatttccgaagtttaatcgattttcaactaataaaaaggatttatgacgtcatcgatgacatcatcgccggccatggcacggctccacgcgaccaccggcgatagagagctcggttgggctatccgaggacacctacgtgaagaggacgacgacgcgaactcaccggtgcaagaaactatgacggacgacgacgtacggcgaccggcgacgaggaccaacggcggcgcggctcagctcgacgacggcggcggcgttccagcggcttgcgacgacggcgaaggggcggccaaggtactcctccaccgtgcgaacccggcggcggcgacggacagcgacggcgacgacgctagcagccgcgcgacgtcactggagagtcgccggcgacggcggcggcttgagctacgcagcggcggcgctacgagcaacggtgagacgcgggacttggggcaaacggaagaggacgactaggggatgctttatataggcttggattagagagatcggactccaaccgagaggaatcgagctgggaaaaactagggttagtttggagagataaactcaaaacgaattcgatttggtttattcgggcaaaattgacctccgaaactctaggggaaagggagaggataaggaggagatgatttccccttaagcaatcagactcggggacgaccggttgaggaggaatcggaggagaggcggcggcgctcgggctcggctcggcccggcccgaggtacgggatgaccccgacatgtgggccccacatgtcgacgactagaggagacgaggggcggctcggcttggattggcacggcgtgggctgcacggccacgtgcgagggagaaggatgttgggctggaaacggccaaacggcctaggggaggattttaaagactttttcaattaaaataattcgtgaaatgatgtttcatttattaaaaatacttcccttgctcaaataattcccagaaaaatctagaaaatagataaacaagcaaagtatttaataaaattttatctagttcaattttatgttgaaatttttcctagattataggagtttagcttgtaggtttttaaaataatttctaaaaatgcattaaaaactgaattattaaattaggcgattttcagggtgtgacattgatatagtttaaacatgtaggttacccaatctttaattttgggacccgacaaggtgtgtgggtgggggcccctgcgatttgggagcctagagcggctgtaccgctccccccccaagcttgccctgaatacatgggccttgaaaggccacatggcatcttatgacgatttctgggcttgatggcgacgaaaatggacgtcatagattagtaacaaaaagataagctttctttatagaatgccattagagatgcatgataggtaacgaatgatattcgtcacacgaatgtcacagagttcacaacatagtgaatcatctatatatgggcctatttgtcgtccaaatacctgcaaacaaccttggtgaatcatctctttgatcctaaattatattttcaaagagacaaagaaacagagagagggagttaaagtccaatttacacccaaacttcaccatacctctcatcttctcctaggaaacatcaacatggggccactagacagccactcatacttggttgagtgaagtacaagtgggatcacaggctcaaaccactgccaactcctttaaatcgtttctacccctcatgttgacaactagctctcactttccacctttactttcaccattcactactacaaccaagatttttgtgtgagggctaaaacgatttttgcgtgcgggtaggcggcctgcacgcacctaggggtctgggaacatgacgatttttgtgtgcgggtggcgcaacccacgggaacacaaaaatccgaaaaaacataattttttttaaaaaaacgaaaccctagaatccggcggtaggctttcgcccgccgcccgcctgccatagtgcagcctgcctcccgccggcctccgcgccacccgccgtcagatccgcactcccctccggccgcacagccgccgacgcccctcccctccgccagatctaggcacgaaaggaaggggaggggaggggagctggatctcgcgcggggacggccgccaccggatccgtgcgtggacggccgccaccgctggattcttgcgttgacggccgccactgctggatctgcgtagggacggccgccgcccgctaggtcccacgccctccaccgccgccacgtggaggaggccggcgcgcgcttactcccaccgccgccgcaccgctgctgtcaccgcgcgctgacggcgctgccgccgttggaaggagaggagaggaggggagagtggagagagaggagaggagatgcgtgagagagagaggactgaggagaagctctacgtggaaattttaaagtggaaaaagggatagaggggaggggagaggagagaaagaggaaaattttaaagttggtgagaggggaaagaggaattagtatttttgcatgcggctctctcaataggtccgcatgggaagatcggctcattttcgcatacagtccatttaagaggaccgcatggaaaaatagatttttccatgccgtcctcttaattgaaccgcacgcgaaaatgagccgattttcctagaagcaacgagttaccgcccgcacgaaatataaaagggtccctgtccaggaaaatcgtttctatattagtgattcgagaagttccttctctacctgatcgatccattttctttgtttccgttttggcatagattgaatacttggtggtgcactcgtcggcgttcccggtgtccagagcaccgccatcgccccacatcgtcgttccaatcgactcaaaccatctccggccgaatcattgagccaccgacgtcgccaaggtcctagcagaaagacacccaaatatgatcatgccaatacgccgccgcaaacgccgtcggtcgccattgcccttttgttgcctctgcttctccagccgttgagtcaccgtaagtgagcccgggtgtttagccacttcattaggcgctaaggactttaattagtagaaatttaaattttgtaaggttctttttttaaaattgctttgtatgccatgtgggcatatggttctaaacgcaattcacctaatacccagtgacctttttgtatatggtttagggtaagccctaaaccctactcagaaattactatttcatggatttattacttgatataatagcttgatgagtatatcgtactcacccttgctttaaccccctctttcagaatcaatttggagtttttgccgaagccaggagtttaatcatataaattggtttcattccaacttagttcccaagtatagattatatagatggtttaattctatagcaaaacattagagttggctcatcctatggcttctacggtaatagttagccacaatcttgtaaataccctattattttatgtaaagaaatctccattggagccttaatcaaatgtatgcgatgaagattcagattgttgaacatgtatcaatctactgatccaggggttcatatagtttaaacatttaggttaccgaatctttaattttgggacccgacaagctgtgtgggtgggggcccctgcgatttgggagcctagtgcggctgtaccgctcccccccccctaagctggccctgactacacgggccgtaaaaggccacatggcatcttatgatgatttctgggcttaatggcgacgaaaatggacgtcatagactctatgacgacagaaggatcgtcactagattagtaacaaaaagataagctttctttatagaatgccattagtgacgcataataggtaacgaatgatattcgtcacacgaatatcacagatttcacaacatgacttgaaattcaatttttatgacgtaaatgagcgtcacctataataagatctattgtagtgatggcttgtttggctattagagagacagtttgagacatacaacacacagagctaattgatcggcgatccacttgggtttctggtgatcatatgcaacatggactaagctacttggatttgttcaaatgatctgcttcttggatgctgtccggccacgtcgacatgcatgcgaattttgtggatgagtcagaggctgcattcacggagctgatttaattaattaacttgttgccagctagtacctaattaattaagcatgtgtgaatttactattaactactttggtagtgttaatttatccttagttttttttattccaaactactagcatgcatgcctttgtcagagagagaaaccgatggaatatgccttgttacaaaagtattgtgcatgctgtgtggattcgtactgtctgcatgagtttttatattttccggggtagagaagataaaagaattcaacttgccaactaggttttttttagagtctggcacatcgtcgaccatgctgcttccctttatcggacctatatacgttaggatcaaatgtgctcaacgtggtctggaccatgctgcttgatgtggtcggatgtaggtgcagtaggaataatccttttcataatagtgaaactaaagaatttcacttgccaactagtttttttagagtctgtacagaaatgaaactttttgaaaagtgctccagatgaccaagttcaattcaccaaccgtaatcgcgtgtcggatttacatgaaaaatacgagactgacaaaaatgatatctttcggttctaaattaatactcccggccatttgagaggagcaatatgtacatatgcatgcatcacacctcagcgttttcgtcttttttttccttgcagttttaagaatgctcataattagggcatgcaagttgatccattagtatattcgcaatatttgatgatttttttcattttaaaaattgttgacgatattagcttaattttggtatggaaaatatcggttaatttattcccaatttttatctcaagcgagaaaatgaaccatgagagttgaggtgctaattaaccacaggcaaatattcattttaatttgttgtgtatatatatatatatatacacgagcatacatgtgaagatggaaatatgtgaaaaatataatagtgctagtagatttgtctaaaacacttccacaatacaatgatcatgacactcgatcaggtctcaaagttaaattttagggattgtgtcaatataaaattatcaatgaataattggccagagggccgggattagcaagggtctactactgtcctgccatttcattaattaattagattaagtccccgattccttgcatccctaattggcctacgagaacggacaaaaatcgcaagatgagaggattgtggtaggtaatcttctccaactgtgcctctcaatcggccataacatattagccagaaggataaataaacatcaatctgccttcacagttttgatcatctcatgagacacatatatataaaccacccataagcaagagtctccaaggtgaattaattaactatgttgatacacatatacttaattggtataagagcattagtagcggtagttaattagtataaaagcatcaatcaaatggagactgttagctagctaggagaccgggcaagcaaagcaaagcattgatcttgatgaatcctccagagagattatttgcatattgtccagttccccctgacctattatacacatgcaagtgctctatgtacttgtgcggtgcaacgacgagcaagagtgcgtacatttatagtagaactgagggggtgcgccttatatacaccggacgagcatgagtgtgtacgtttgtagtgatgtctccaattttagtttctgtcgtagtgaaatattcgacgtttgacacctcgaaccatagaaaaactggagctgtgaaatgttttcttcttttttatgcgtggagcactgaaatattgacagttttgttttttctataaaaaaaagaagaagagttgacgacttgatgggcaggctctcctcgatggagggagatgagcttaaaaagtcgcaataaatggacccatgtagtggaaatgcggagtggagtggagcagtaataaaatttaaaacgccacgcgcagggcatctcgaccacgactggactctccttgagatcttcgaacagtgtgtgcttgctagctgaactgcagcagtggaacggtaataaaatttaaaacggatgtgcagtgttcacagaggatgagtgtgctatatatgtgttctctgcttgtgaatagatatggcgatctctgcatgtgaatagatatggcgagtactattactgggtatacatagttaggatagatgttagtttgttctgtttgtttggagatggatttgggagcaaatgtacatggttagggcgcaaatgttagtttgttttgctgtggaggggagtgggttttgatagaagtagacccatgaattttgctattccaaaattcctcaactagctatatgtctagctccaacaaatctgtgatgcctatatctcactagtcttgctatgtgctatgtcatgtacccgtgggtaaatagctaatttatgatttttgctgtctcatcatgattatgccaaatatacatatacctaactcatgaatttttctatgcctatctttcaccatttatgctatatctaagctagacgattttgttatggccatacctactcttaaatttttctatgccggccttgactcagccgccccaatagaagcgacaaaactgctgttgttgcaagagttggattccttcaagaaagtgatagatgaatctgaggcatcaagggagcagcaatcgaagaaaattgaaagtttgattggcctaaatgctccatattttgctctgaaatgttgatagttatgttaccaatcatgtatcattgtcattttcatagccttcatcatggcgttgcgaatattgtgaatataccaatggatcaacttgcatgccctaagtgtgagcattcttaaaactccaaggtaaaaagacaaaaatgctgaagtgtgatgcatgcatatgtacatattgctcctcccaaatagacatcatgcaggatcgggacttgacaacacattaaaggctctcatgctacacgcttcttgcactgtacagtatgtacaagggcatcgagcggtagttcgataacaataagattcattagcaccaacataaccccatccattccaataaatatggcacgcatgtattttaagatttatctttgaccaagaattagttttaatttacaaagatatttgatagaaaattagcatcatttcaacgtgtttttcaatatgaatacaataattctatgtatatattattagtcatcaacctgtgcacttgcatgggctagaaaaattacgtgacatcaattaactagcgtggaagctttattggtgcctccaattactaaatataagattttttctttgtttctcaattctttcggtcaaaaacgagcatgtgtgttattcatagaaacggaggtagtatttgtaagaagtacagtatcgaatttcaaaaaagttccgaccttgtgcgataatatacacacatattaacctacataggcaagctagctagacctagaaatataccatttctaaacctattcggtcacttactcacgttggggagcctaactaaactaacatggactcacatggaatgcaagccagccatggtactaactcgtctactacgccatagtacgctacaaacacaactaagttatcttatgaaggactactcaatagtacacttaaaacaatgttactcgttgccttttaccttcatttgacgggtacgacctaagtgtatctgaaaatcttctattctgtccatcggcgaaagcgtgcaaatgtaaaattgcctggtacgcaggactagatatgaagagtttgttcagagattgtgcaacaaacatgtacatccatcaactgtattgtcacgccctgaagtttccccctttttccttgctttaaaaaaatggttaaatgaattgcgcgaagaaattgtttgattaacttagagctaattccttaattaataaatgcaaataataatcggaattggcatgtggaatttttcttgagttctacatgtcgaaattcgctaacaaaatttttagtggaattttcagagctctcgaaataattttaaccaattaaaaacattaaaccgcaataaataatcccaggaaaatctttttcttttcctcttttcttttcctcctttaggccgtcggcccactcttcccgcgctgccctcctccttgttgggcccgacccacgtctccctccctcctctctccgggtcaccgacaggtggggcccacctgtcggccccgtcttcctcctccagccggttggagccgagctgcaaccgccggcgcccccacctccccacgccgcccgtttcctccacatccgcacccccgctccgcgtccccacgtcgccgccctccccgccattctcgcccgcgcgcgcgcctgcaaatgggcgggattcgattagaattccccccactctctctctctctcccccccacgtcgccggccaaatcggggggtttcccggccatgtccgcccctctcgagcccctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46519 - DNA, 1294 bp, Oryza sativa
ccccaaccttttttcctgtatgcttctcgaacatcttcacacgagttacaacactgctcatcagactaaattaaatgaaagaagatattcagtgaaacccctggaagaatgactgatgtaccaaatatacggagcactatataacaatctaattcatgtaaataagaaacagataatagaaaagaaccctggaattattgagatcagcatataaggcactagtgagctaaaatataagaacaatatcccataaaaaacacaaaggagtaatggccaaggttgcaaaacagagggcaatccattgtacagtaagcaaataaagaagaaaacagaaagctaaaaaaattaaatggtctaacccaagcaaattatatctgataacccctactatcactatcaggtgtgtctttttcgctaaggccacagggcagtaaaacttttgtatagtgctagttgcatgcccttgagttgaataggatttagaggaaaacggatgaatggttttttctttttctatctggtttttctgcgtcaattttcacgtggaaacacattttattatgattattattattgttgttgttaattttattttattttttttgggggggggggatgtgggtgaagtcagatgctaagggggacaacttcgcttttaaagtagtagagatacgagtcaggacgaaatatcatctaaaagcaagaggagcatacttcttccgcaccataacaagagccacaataggtctcattgtgttcaagcctgccgccatgccgctgtaggggctgttccacctgtaaaaaataagaaacaaggaaacatgcatctttagggttaacgaaatgcatcaagatctggacattacaagccagaatttacttaattgcatagttatggaaaatgatatatgttatgttatcttgttaatagctcagatttcagatatggtacaattttaaataaccagtcctcgttagcttcacgttaagaatctaggactgttaaggcatttccatgacaaaatgcattcatactagttatgattttgattaattcataaatgggactttgaagtaacgccttactatattctaaaaatcatgagcgtattgttcttaaggacagtgaaaagcactaaccttcatcccaccaactgcatcttgcttagttgcaataacattaccatggacatcaattctctgcttgaatatatcatgtttctacataagagcattacacaaagctgtgttagctactactcactaaaagtctgcaacaaccagtgatcaacca

SEQ ID NO: 46520 - DNA, 5128 bp, Oryza sativa
  unsure (1)..(5128): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctccttactggtccaaaacattatcattagttcattaacaatatacatgttagcaagtattgagtacatttcaaggagggaaaaacaaggctaaagcactcaagtcaatccacttgttggtggcataggaaatatggtgtgaacgaaacaggagggtgttccaaaatcaagagaaaaccatgtcgcaactactcatcaaaatacaagacgaaatcaaaatatggagcatgtgtggagcaaaaaacatcgcgagaatatccgcttaggtttcatttagtgtgtgtttcttttatgttttcttccctagtttcccttgtttctttctccttcaccttctttggtgatattgtaaatacttttctattctccttaatataactccagcttagcctagcttcggtttcaaaaaaaaaagtattgagtttataattacatattgtaaaaaacaagcatacctttgaggggtcaagacagaagttggttagagggaagttgcgctgtgggttctccataagcagttcaatttccctgttcaaaaaaagcaagtgtgcataaaaaaaactgagaaaggaacagaacctgtggaaacataatagtataagctaaactattcttaccgcttgaggtttctgcttgttgcttgcctaagcttcataatagatggttttgaactctttggcacttggggagctggtttcctaaaataatcagaggaaggcatatagaaattatatgtttgtatagttattctttgaaaagaactaatcaaaattgttaacttaaaggcacagtagtatacccagcacattcatcatctacgaacacctcaatggggttgacaagattttgcagaattgcagccctcgatcctaccttctgacaaatctgttcagtgaaatagtatcatcagttcattaaccgttactgaaccgataaaccttgagacatgtcaccaaagggaccttttgagttacaggttgtgaaacaaacatacattccaccgctcgtggggatgcagacggacatcagagagaatggataagatcttcaaaccagaatgaataaaacactctgcaacagagcaaagaaaaaagatccacttgcttttgagcatcttctatgcaaagctgagatactttaggaataacaatgcttaaaaatcagtaataaaggtccaaccatccacttcgcctgatccattatcatgcgatgagcacaacggaatcttcaatgaaagcctcaagtagggttgattacctttgtatatgacatcttttagagccttccagttcacgtttctcatcatcagagccattactgctggggccaatactcttgctgtcaatgtctctggcctgtgaggattaccaaacaaaagagtgggtgttattccaacacgtatcttttgtatactagtttcaaaagctattacggtaagtatatgaaagataaatggaattctgtaaacgagatgttgagttgcaaacaaggaaaacaatggagcacgcaacagcataacactatgaacagtttcgatgaaacaatgggtgaatcaaatgtcacatctcaaatcagaggatgatcgctaaataattcagcaggataaagtttcatttatgtatctaacaactcataatattgaccggtgactagtttcacatcgtcacatgctgcaaatatatagatgtcacactgagaatcaggaaattatgcaaaatcattttgttgaacaaaggaatatttatgcaactttaacaactgacaatttttgcttttaatacactggaactaaggagatgaaaagctgatcagcgtcaagttattgtcaacttcaggtgcactaggatcaaacagacacatcatatatatattaataatacatcaaaatgcaatatgcacgtcaccagtaagaatatttctgaggtaaaacataaaatatgcaatgagcccatgaggactaaaagactaacatgcttgtaacttgctcccttcagtctttctcgaactcctcctccctttggtacttcttccccaatcgatccacctccacctccccctcctgatccccctcctcccttctttcctttctttttccgcttgtcctgctttcttttgtgcttaacctcctgacgatccaatgtgttttcaaagatgggcttgggaggtttctcatgctcaaataatcctgagttaaatgcatccctgaataagatcctgacaatactaagagccgattccatagaatctatgacaagtttctcatgcttgaatggttttggctctaggccctgtttcatgaggtcaacattttccattatgtgagcagaaattttcttgtacttcttcacatacatggggttggagggatgtttccccaatttgcttaaacccggattctcagaaaggaaagaatctttgatgtagtcatgcaccgggcgtaatcttgctgcctcagatataatcacagcaaatattgcaacatcttctgatatatttatgttttcaccaccagcatgcctccagaagttgtcaaatgcttttctaacaggccatagaccagtgggagtattctcaacacccccgaaaacaagcttgttatagttcaaaccagttttgagtctgatgcactttgggtccagagtgaagttctcatgttggtcatggttaagctcaaaaacacaatcccttgctttccatcctctaaggtacagatttcttccctgtatcaagaatcttatagaccgacccatgtacacgaattccacttccattgagcctccagctcttgtagtgaatacctcatggcactgtccacaaatatctgagatatccaccttaattccatcttcatatgaccaattaattacctcttcaatgccactaagatagcttgctaacgcttccttgtcagttccatcaaggcaaattgtggtcacatgctttgaggtgagccccctattcctgatctgctaaacaaaattacaggtgtgtacattcatatatggaagttaaatgagtaaactagcaacttttcaacaggcagtgctgcttaatggtcagttgtagttcattagggtatatccaaactcccaatcctgtgaaagattccaggcatattaaacttccaagttcagagtaacaatgtggctgatatatagccttgcaagttaactgtaacaatctggctgataaccttgcaagattataagcaacagcagcaaaactatggactgctgaaccatattctgttctcacatttttggatccaatatacagtctaatactctgtcaatagtgttttctatcattctctgacaatactgccgtaccaaatatccatattgaccagggcacagttattggaaatcatatccaagtaaaccaatcaccataattttgtatggcatttccctctcttaatataaaaccagcaagatctaggtttcaaaaaaaaaaaacaatcaccataatacaattaataggaacgactgaaacgaattcaataggttgtcctacctaggaaatttatgcactaattagcaagacaaaatcagttcggcaggtggatcataagttgcacatgctcagggaatcttactagcgctgcacataaatcggaaacaaaaatctctaataatgcacaatcaacatattatcgctaactctgtatcatgaatccgctgtggataaagtaaaattctgccgcggaatgacgtaagttctgtttccaaaatcgcatctaagccaattggtattcgataccgcgtcatctccgctccacggctgaacacaaacaacaacgaacggttaaagggggagacgattacctcgctcgcgtgaggaggcggaggcgagggccgtgagcgccccatcgtcaacgaatctgccgggcgatagcggcgtcggcggcgagaggttgctcccgtcagcgccgagggaaccctagggtttgagatcccgcacgcaatcgttgctggggcggggcagggcggcgaaatggtgcgcgacggcgatcacggagcaggcgaaatggcgaagagggggctcggaagaatgccgctgcgcttgtcgatgcaatatgcttgagaatgggggagttgggtctctgggcttcgttttcgggcatcgcgagattagtgggccgtccgtactcaaatgtgacataataactttagggaaaaagtacaccggaggtccctcaacttgttgaatcgtccttgaaccacaaaaccagatacaatgcgtccctcaacttataaaaccagaataaactagatccctgaacggttttgactccggttttgtctgatatggcagatgactcagcgtgggacccacgtgggtcccacatgtcagccacttcttcccctcccctcaccatctctcttcctctctcctcccctctccacggcggctgcagagaacagatgggcgttgcgggcgcgggcagcggccggcgagggaggagctgccaccggcggcggcggctctacgccggccgacctccagctgttgcatctgctcatcaccagtccgcggcgagacgacgacgccgcccgacgcactatggtcccggagcaaacacccgcacgcggagcccgacgccgccgacatgccaccgcccacgaccgcaaaccgcctgcagcagcgcggccctccgcccctcgtctgcctctttcgccggcgccggcggctctctgcgtcttgcagagcctctcggcgatggtgtgccccatgtgcattgacaggtgacgagcagcctcgtcgcggcgacatcaagcgcctccgtccgggagctccacgatggagtggccctggtggttctccctgacgaccgagaccacggcggcgagcgaattggcgtgcgcggtgagcgcgacaggacacggatgatgctgaggttgagcttgtgaggaatgaagcacttgagcatgtggatgaagtcgtagatgg

SEQ ID NO: 46521 - DNA, 1937 bp, Oryza sativa
ggcgtcgtctttattctcgtccccgcgtcgtcgcccgctccgcccaccgctcacctactctgccggccggccggccgctccccgcgccgtcgcccgctcctccagctggccactccgcgcccgcatcgtgccctctccggcgatctgcttggaggggaggggagagaggctgagaggggatagagagaagtggggaagaaaactaggtttcgctgacatgggggcccacatgggtcccacaccgactcagcagccacgtaggataaaaccgggatcaaaaccgccgaaggacctattgtaactggttttatatagttgagggaccccgcatatctggttttatggttggaggacgattttgtatcccgataataagttgagggaccttcggtgtactttttcctaactttagtggggaacgaatctatatacacaagtttccaagtttcctatgcacaccaactaacaatgttatagaaatgttttaaacaaattaaacacatattttttatttattatattttagtattacacctatgtgtaaaatcctatctttaaattcattatattttagcggtaacaaaaagataaaattatctagattttactcttaaaaccggtcagattttcacttttttttgttacagctaaaatataatgcatttgaatatgaaacttcgcatatatgtgtaatactattaggagcacgtgtctaattttttctagaattttctgtgacatttgtttgttggtgtgtacgaaaaacttatgtgcatatgatatgttcctaagttagtgagcctcgcctatcgaattggtattaatgtcacgaggtgagcttagttcaactagttagtttattacttgtggtagaaccaagctactcgagtttaagtcttagacttgacatggatgctcacatttgtaggtaattattattttagtagtaagcagtgtatatatcgatattgatatgcccatggcgacttcattaatcctaaaatatgccaatccaagctttttggaggtgcttatagcggtaaggtgcgcacgcgttgtaacgccccgattttcacgtggcgttaaaaaactaatttaataaaaatcctatatgcgaaaaatttcgttctttaaatccctccttagtctcaattccctaatgtcaaaatcgtctgcccaaaatctctgtccgagaataatctcacatttcgaaccttcgtattcaaatctcctttctaaacctctatcgagaaatttccccttcgaataattccagttcagttcctctccgaagatttgagtccacactcaaatcatctccggttactccttgcgaagggctcatgattgcaaatctcaagtttggcaaattcgaatccctaacctaacttctcaagtcttcgtttcgaaaatagctttgaaatttgaatccttatattcgaattgaatccgcaaatttcatctaatgctcaaataaaaactaagtccaatgattcacctccatatcctaaacttttcccttagtccttgaaatcaattctcgattgtttcatcctctctctctctctctatctatctctatatctatctttatctctatttccatctatctacctatctccctttgaatcctttctcaaaatattcctcccaactccaggatgcaaaatccagtcaaactccctccttgaattccaactttttcatcccctcccccttaaatccctcacaaatactcctccatgtccataataccgaattccttattcggttcccttcgttgactccctatacttctttgagttcaaatataaaatttgaattcaaatcccacatcaaatgcctctcaaattcgttgaaacaactccctggataatatcaagctatttccatcagtttgggacgcctctcctcattttctctcggcccaacccaac

SEQ ID NO: 46522 - DNA, 25893 bp, Oryza sativa
ggcatgcaaaacggcactctgcaccacaggcatgcagcggtgcagttgaaccattcgatcctcaacaaccaccccacccgtgaaacccatcgcaatctgagtagcagcgtgcctgccagtctgccagtgaggactgaggatcttctggaatctggagtacgtttagtttgtacgtagggcctcttcaagaatacgactgaataattccgccccaacaaaacgaaaaagaaaacaaaacgagttgataaagcaagagcagccgaacgagttaatttccaatatatggtttggcacgcgattgctccgtgcgcttaataattaactaacacaagtcctcccgcacgtggccgtggatttggatatatacaaaaaccagacaccccgatcgatcggcctttgctatcgtatagctagctaccagcccaaccaactagtgcgcgagtgagcgcgcggctattgcgtgccaaacaaggccggccgttgcgcgatatggctggaggtgggttccccatgggcggcggcataaccttctccgtcgtggtcacctgcctcatggccgcctccggccggcggcctcatcttcggctacgacatcggcatctccggtacgtatacgtcgtgggactacctatacatttgtcgacaaattttttctcaaaaatgtgacagatgtaattatagtacaatcatagtgtaattacactgtaacttatatgtaattacactgtaacttgcatgtaacttatatataagtttcacataattttaaatcgttagatctattacaagatttgttttggtgaggaagaaaacaaatcatagcacacacatatgtgaaagaatttgttcccgcgacctccattttaccgaaataacatgttacggagagatttttgaaagttacatacaagttacactgtaattacatgcaagtttcagtgtaattatactacgattatactgtaattatatctgtcaaatttttgggaaaaaatttgtcgacaaataaatagcaaaatcgatacgtcgttacacttacacgtggctgcaaacgacattcatcacttgtattatatataccgtcgtctgtgagggagatgatgtggtcagggggagtgacggcgatggagtggggccttcatcccgggggtgctccggcggatggcggcggcacggcgggacgagtactgcgtctacgacagccacgtgctgacggcgttcacgtcgtcgctgtacctggccgggctggccgcgtcaccagggcggtcgggaggcaggccgtcatgctcgcgggtgcggcgcttttcttcgccggcgccgccgtcaacgccgctgcggtcaacatcgccatgctcatcgtcgacagcatgctgctcggcttcggcattggcttcaccaacctgcaggtccgtagcaaaaccactaaaaatcctcccgaaatagctcttttccgggcagcagatcgatcaaaccgatcccaaattcacgcaatacatcgcatgaaccggcccaccactaccgggcgtgaccatccgactttgcagcacacgtgcaccgaaacaacgcgtcgctgagatgggcgccgtcaacctcggctccaccctcgtctccatcgccacggtggaccggtacggccgccgggtactgttcttgaccagcggcctcgtacgtgatgatcgcctgccaggtcgcggtggcgtggatcatggggtcgcagatcgggcgggacggcgagtcggcgatggcgaggcgctactccgtggcggtgctggcgctgacgtgtgtcttctcggcggcgttcgggtggtcgtggggcccgctgacgtggtgttagcaccctttgctccaattcaattagcaaccagattgttaccacttgcaagtatttggtgaaacaaaggaagaaaataggggatacaagttgctagtaactcaaggaagaagaggagaaagagaagagatcgacaagggtgccaccggccgcctaggtcgccgtcgtgagcctcagctcgccaattgatcccaccatgcctccaatgtgaagtatctgtttctttttataccttctacctgcttgcttgtgctttggcgggggtggatggttggctaggcccatatgcatttgacctgacaggcccatggaaggaggcaggatcctaacattccctcccccataaaattcagcttgtccccaagctgatggaaacctcctggatcccaaggcatcaacaatactccctccgtccttaaaaaaaaaaaaggcaaaccgtgggttcccgtgtcaacgtttgactgtccgtcttatataaattttttttataattagtatttttattgttgttagatgataaaatatgattaatactttatgcatgacttatctttttaaatttttttcataatttttctaaataagacgaatggttaaacgttggacacggaaaccagggtttgtcttttttgagacggagggagtacttttgttatctttggagtgcatacgatgcacatgcttttccaccaatgcttcccaagctctcaatttactgaccaaagcatgtatcaggagaaaataacttgagtagctcctaatagatgacttgttcagacagagagacttgataacttgagatgctgaaattatgtccacactaatgtcctgttctatcttcccttgtcctgtccacgcagccctagtcaaaggtgggagccccagaatttctagccatctctgatatctgagtaaacaccaaggattcagctcattagttatgagttctaataaccagtatgtattggacccctttcttaccagctcaagtaatttaacagacaaataatccttgtttgcaacttatgcatatagcgtctctgaatctgtccaagtaccaatcacatcaatggaaacctttactgcaatactggcatcaataggattgtttccatcaaaaccaacaatggaatcataaccacatctcttgaccttcctgttctgcttctcattagcagctctagcaataatccatggtctcaggattttgttcgaatgaacacagtgaaaagcagttaagtaaacctgaaaatatattattgggtgctcaagcaactcagcaaaaaacaatgtagtagaaatctttctgtcgtcaaaatgtatcccaactgaaaggttaagcaactggccattgcataatttcttggctgtgttttgtagccagctctcaacaaaattaagtgcaatgcacattgacttggaaattctacagtgtaaagatattgcatgagactcaataattgattgtacggcttcagttgtgtttccagcagaacggctcctcgagttatgcaattttcctattgtcagtggccttggtggtgtcaccggcattaagtcaccttggctgcatttggatgatgaccctagcactcgtcgcagcgcaacttgacaaccaatgtctcctgcttgagtaggcggtggccatggttgctgctcagtgtgagaacattcacaattaagctgataaggagatggccacagttggaaatgatcagccaccaccatacctctgttgcctttggcccctttatccctattggatgccttgtccagctctttatcaacatactgaaccactggttcgatggtgatgttgttagcagccttgacactggccattttagatattggtattgacaagacatcaggattgctagtatggacaccatggctccatggctcaactctaaacagttggcatgcatttccgagatgacggtagcttgtgcttttgtatccatagccaagtctagacccataatggtcgggaacactaccacagccaagtctagacgcagctcgtacagtgcgcctctcacccgccgtgcgtcctccccttgcgcggctcaaccagcgagcgcacaccctgctccctccttcacgccggctgcgtcgagatcctctgtagcagctgtcgccgtctccgctgtcaacgccaccactccgttgctccaagctgcagcaccacaaaccggcgcgccgctagctagggtttagcctcgacgcggtcgccctctgataccatgttgctaggtgattgtttttctccagaagcttcacactatttcctctctcttctactatacatatgcattggtgtaatgggccctgttgggctgaaacacacacatgcctacactcaacactagcaacactagcttcacactatctatctatctagatgaatatgaacatgctagaaagtcttacaatatagaactgagggagtaacaaataaaaaaaaaatgtccaaacgctaagtacccttctagaactccatagccgaccaagtgaccttcaccgagattgaggcgaactcaatctttatttgttcactggcacatccatgattagttgctttgaaggatcgacaatgttcagcgaaacacccagaccctaaacctaccttgaacttcaaatccatacactcatgttccatgacagcaatcacatacctcctcaagtcacgtgactcactgatcgcaccatcaaagagccgaatttcctcatgtaacccactggtaaaacagctgagacacaaatcaaaactagtctgcacttctgatatgacgacttctacagtcgcctcaaatgcatacaaaagattcgcttgagttatgtcaactgcgccgcaatctccataaatgcgatttctcactggtacatgtgatgtcaatatatggtcaagatctgttgcaccatcaatcagttgtagatcatcttcctctcgttctcctgtcttgattctcatgtcatattcaactagaacagcacaagaaaagtcgatccctcgcttagggccagtcatttcgatgagggaaccctaaaaaaatattaatatttagtagctcttcatagcaaagtaagtaactaagaaaatattaacgttttagtcacaataatgcctagctaaacggatcattttacagttgatgcccaagatattcgtcatgtgtcaaacagaacggttacaatgtgtgcaagaatgttagagaaggtttgtcccacgctatttatttgagttaattttgaattccaaaatattaatcatataagcttgtgtgaaatgtaaacaaaaaaggactttgttgtgaagggtcattcatatgtctgtagacaaccaaaaaaagaacaattttatgtggtactaggcaggaaccaaagggttcgaaactattctatttgattctgtttgcaacacgtacactcacttgcacctagttcatgattaatacaggtctgatcataattatcattccacaatatagtacttgataaaggtcttatcaatccataatattattttgttacttttggacacactaatcgcatcccaactcaccttcctcactgtccagacatgtgtttatggaagcaaattttttgcagctataacactataatattttagctgccttttcgggcacgtatgttatgtatctattatactataaagaaagcttgaaaaagaggcactatgttcactttgaagacctacaaattaccacattatcaaagaaaaaaaaactaagctgttagatcatggtgggacaatgaaaatcatagtagcggcatgtttctgttcagaaaaaaaaacattcacatgagaaatatggcggaaaccatagactactactatttcatttctttttaagaaaaaaagattgcaaactgagcctacactatcaaactgagcctaatacaccatttccactctatcctaaattcagtaatgtaaaagatattttgtggctgtaaaatactccctccggttctataaaataattgacgtgttggacaaggttgagatcgaacttttataactttgaccatcaataacttttaaaatatctagtttaaagaaaactaggacaacatatatagatttatctttcaaagcactataataaaagtaaacatgcatttatttattgcatatattataatagaaaaataaggtcaaagatatattttgtagaccgtgtcattgtccaaaacgtcaattaaaatgaaatcggagggagtaacaacaaaaggtaacctcattgttcacctgaatggtcatttagcctgtttaaacgccacatggtggttagccgtttctgtttaaatgaccatttagcacaaaattggctaaccatgggtgaaggacggtttagtgttaaggttaatgttgggtaagctctaatcacatttgttccatgcatgctgtaagtttgatcttataatgtgaaacaaataaagtaatttgaaataattgtagagagcatggaagcatacctgctccacaatgatgggatcatccctgccaattttgactatataattaagtaatggatcctgaaggtcccgcacagcaatgtatccatacaattcaattgagccatcaactacaggagttttagccaactttactgagaaaatttgcaacatgccatttgcaggatgccatatgcaagttccatccctcatgtagcaatctttcgtgggatgtgataacatcattgcctccaaccgagctacaacaaagatgacatgccaaattgtaacggaaacttaaagagtagataaaatacatgcatggtacaataaaaataaaggtagaaagtccattctaatgactaaagctttttggttgtctagataattcccgtctcatttcactcccccacctaattactaaaaccagatcacttcatgtgggacaatataaggcaaaaaaaaaaaacaccttctgtccaatgtaatttctagtaaccaattcagactgacagaagaaaataaaaaaaaaggggaaaaagaaaagaacatcaggtcccaaacaagggaacaaaccaccatggtttggagttgagggggctctgttccactggtccacaattgtccccctcaagcacaaagtctgcaatttattctgtgacacttcatcgattgtggtcatggtagaatgctgcctctgttcaatagtgccatcgaggaggcatcaccagttagatcatggccatcatgggaatgatcacctaggaggtggatgaggcatcctaattttacacctttcccatgtcttgactggtcaacaattgcaaataagggtgaaatttgtgaggtggatgccatagaccgtataagatattttccaatggcgtatcccagaataggacactctgtagtggcaaataaaaagttcttccgatacttagagctgtggtttgatataaatatcatctattatgccacccttaacttaaatgggagatatatttctatttaattgataacttcctagtctactagactccagactcttaataatagacagaatttctcgtcttgtttgttgttcagggcatgtaggtcagatggccacatggtgggccccagcagccataggactggttggcaccctagggttgcataagtggcagcattgctgccaccttcctcctggacacaaacccttgggatgtgataatgtatgcagataatcatgagaaattgcgaaagtattcatgacatagagtggagtgtcatattatggtacaaaatctcaatttaaagcaggggtgaagtgacccggttttagtagtttaatttatcattttaagtacaaaatataatgcacactaacctttcaacatagaatatattagctgaacctatagcttgacaaatgtcctaattataaaatagataacaacaggaaaatagatatatatcacttactctcgttacgatctgcaatacgataatcccatttccacccagatccaaaggtgcccctggtatcgtatatagaaccgtcacggtggctgcttgcaataagtggcgtccaaacatgacagtcacagtggtagttaacagcacgatcattgaactcttcatatccatcgttgtcactaacctcactggccctttggttccttgcaatttcttcaccatctattagctcctgaactgccacttcaccatctattaggttctgaactgccccccttggatcttgtttaccaccggtgacctccacagctgtcctagaagcatcttcatcgccatacgtggtaggacggcaatggccataacaagagatgaactccttagttgcagcactgtccttgccttgggtgatgggaaggtgcttgtccatagaaatgatattatctttggttgtgtggataggatcgttggcaaatgggatgaagcggcgcctgtatggtatacccaatccctcgccttccactccactgccgctggccatgttccgagatccaggaaatctatgaacaaagagcataaaagggtaaatctttgcgtccgattcaagtgccatcagtcgggattgaaataatttccctagttatactcaaaacaccaacatgatataagaacaaatagttctaacaaaaaaaaaaactaaattcaacagaatctatatcgagaactttagcaagagacgaaaggcccaaactttacgatcagagcaggagaacacaccgagaaacacgactggcaggagggttaagcgtccacgtgactgaagcgattcttcgcgcaagcgccggtagccacccgcgagccggaccagaggtagccatggaggagaggagagatcgcgggaggggatcgagatgcggtgccgcagggcagaataaggcgcgacgatggggcgtcggaggaggcgaagaatcgagcgcgaggggatttgcatgcgctccacgtacggagaggagggcgcggcggggggcgagggggggttgtgtaggcggcggcggcggcggcgggcggcggcggaggtttggtccggttcgtgatgtgcgtgttgtgtgtgatcttgctagcccaaaagtcgaaaaaagcccactgcgcgattgttcacgctatagacgctgagaccgaacaccaacagatcttttttaagatacaatgatttttttttagaaatagaggtagtggaattaaattatattctttacagtaatatataatacaagataattacctttttacaagataattaaattctgcatctaactttatataagaaaaactagatgggtggctcgcgcaattgcgctgctagcacccatacaaaattactccctctgtttcataatgtaagtcattctagcatttcccacgtccatattgatgttaatgaatctagatagatataatgaatctaaatagatatatctatctagattcattaacatcaatatgaatatgggaaatgctagaatgacttatattgtgaaacggaggaaatatctatttattaatatgattttacttaaatattgttaaatagctatctcgtaatctaaagattttgaaaaacaaagccttatcatccccatgtttctaattttataatttttaaaagtcacatcggttgttacctcttactttcttttttgtcacccctcatttaattttatagaaaatcccttgtatacccttgaaattttaactaatcccttctatgcccctgaattttgcttacttccttatatacccctaaaatttgattttgatcccttccatacccctcccgtcagttgattgttagttgaccgtctaatttctataaaaatgaccattttaccctttggatgaattacattgttaaaaatgtaaaagcttctcacacgaaactattatagctatgagtttgttgtgcgatgcattatttatcccaaaaaatatttttagataatgaaataaaaaattgtgtatttatttttaaaataagtaaaaaaaaaaaagaggatcattcatacaaagataggacaaccaattttcataataatttttttatgaatgctcccgatcaaaaaaaaatcattgtcctattaaaatttcaaataaaaattttaatttattaccttttttatttccaaaatttatgtcaaaattttctgcactaattatttagtctcattagtttcataaaatgcctgtgatctgagattccaaggacaaccagctgacatttacgaacttcatttgtacttaccctacaatggatttgtacgatgacaatattctttatgtaatggccaagatgaagggtactgatccaagtggttgggtgctctctgtcaacaccgagaacaagaagctagagaaagtctcaccgttttcccagaaaattctgtttttccatcgcatctacctgcaatgtgaccttttcaagcacctcggcaaggctccaggtgatcttattgatacgccttccactaccatgcaaaactatattaattctttgctagcttaataatgggaagcattttaattgatgtaaagaagaggttcggcactagtagtacgcaattagtcttatgaatttagtcttaaggtgtgggtggaccttgccatgtcacctagccttaacaaccatgcatctgctacttgagtgttgcattttttttcttttgttgtggggaaccagtttggtggggccctaattttttaaaattttcattggcccaaggaatggataaacacaccaacaggtaatttgtagctgttattggtacagtggttacacatttgctgtctaatgctaatatgctgcatcttgacatgtgtgccacttattgctattgttgaattatatcagggaaatgattgaattgttagataccaatcttcttgctgcattggagcagctccagaatataggtaaccgataagtctatttctgagaataccattttttatgtcagtattggacagatttcataggtcacatttagcatgataccaatcataagcacacgaaataatgcctatatattttgtagagacaaacgtagaatctttgaagagaaggtacaattggagtatgccattggtcttctctgattcggcatcatctctcgatccaaaaattcgatatgttgaccagggcaaaggacatccatgtatgttttgataatcaattcctcgagcttaaaatttgttagttctaaattgtgcttaatggcatagcactctactcctttttagattacggatactaaacttaccttgtaaaaaccttgacacaggaggcagatagctcaaatagtgacagtggcacttatgttgtttctgaacacttacggtaattacatgatttttttgctagaacaaatatatcctttccccagggcaactttccaaaaatgcaacaaaaaaaaagaaacccaccattctgatggcctttttatgcagattaatgggagatcttacgttgcagcttttggcccctattgatgtaactgaaagcaagatcagagtggcccacggtgccttatacaagtaatgcagagctaaaacctgtttgaacatgcaaacccattgagagaatttattgtatttattttgttctaatctttccagcctcaagggaactttaccatctgatgttctggataaaaatttcgtgaagcgtaccagcttttctggacctgaacaaaaaaaggatgctgctgtgtagagtcaaggatcgctcagattatttataagagtgtcaagacaccttttgtgttgtttgtactagtaaagtaccagcgcattacaacggttttttttaataaaacgagaaggatcagaaaaaaagagaacgtggtgtttagacggtctactaaggccgtggcttggatggagagaggacaatccttccatgatgcaaggaggtaacggacgcacgagagagtcaaagtggatccgagtgctacgatgagaggagacattgtattccttccaaatttcaagcatgtacgtaccttacaaacgatttttctatacaagttgtaggcggaccgtaactggtcgcgcctacaaaaatcaacctacattttcacatacggcttcttaaaagacccacatgcaaaaacctatttttatagaaggacctcttaacacacccacatgcagaaacaagactatttcacaggtgggcctcttaagcggccacatgcgtgggcttcttaaaggcccaccttcaagtctaaccttcctcatttcctccgtctcagcattttcataatttgtaagtatcatccttatctactcaccttctctctctcacttctctttttttttccagagcctcttctctctctctctctcccctcctcctctcacacttctctcctcactctagctcaggttggcgacggcaggagtgcagtgttgggctcgagcaggcacggcggatcccgcggaagcacggcggtggtagggaggtgaggtggtggcggatccagcggtgggaagcggtggtaggcttgaacgggcacggcagggttattcagattcatgccattaaaccataccattatttggttggataaatgtatggtaacatttaaagaattgacatcatatttaacttatcctactaaaaggtaatgtgaaatttcggaaaggttgaaatttattagtaaacaagtccgtaatgtccaaaaatccaacaaggactccatggcccaatggataaggcgctggtctacggaaccagagattctgggttcgatccccagtggagtcgatttactttcgtctctttttttctctctcccttcatccatgtacctctcaaatttcaaaggaaaccaggttgtatctcccaaatttcaaaggaaacgaggttagaggaaatagtattttcttctttctcccttcatccatgtaactctcaaatttcaaatgaaaccaggttgtatctcccaaatttcaaaggaaaccaggttaagaggaaatggtattgtagataccttcgttatcttttgcataactcacaaataagttaatttgatacaagacagacattatttcctgatgataccatgagctcacaaaaatgaaccaataaaacttatttcagtctcagtccaaggagattaatacataagtaccataagacagatgagattaagtcaagtttacaacacataagctgagtcagattctgctgactctagatgatatcagggccaagatatcagctctcaaccatgatcaagaaccagggtccaggaagagcacatgccacggacttcagcgatgagggtaaaagtagccagtccagattagggcagcctgcggcgattagatcagtgcaatgctgctctcgccaccagggggcttgcggacaccgccgagatagtctcggggagctgccgctccatcagcaaagatgtcactgccgctcatctccttcagctttgctgagctcagagatttctcagctgatgcaggggtagcgtcctctttgaagatgttgttgcctgtcaactcttggaacttctggttatggattttctttgacgtcttgactacaggctcctcactgaacgtgatgttgcttggacctccagcaggctacaaaggcattcagttcatacaaatttaagggtgaaatgttcatataacaaggtaaatccaaatacattttgatgacatatggcaatgcaacatgtcaatatgtcatgcaagccgtatatctatcaaatagaaatgtcatcctttgtgctgctatttctggctgatgcttaaaaaaaaaaactgtagctgatgcatcttacacctatatcaatgcaacctaatttgagcatccattccctgtaaggtgtatggatatcctgtatcaccaagaggaacaaaagaaaaggtcccttctgtagttgtggtttcctaaagaaaggtggtatgaattcctttttggcgtatctaaccagtaaattattcagtctacaaaagattggtgccgtggtgcggtactcaataacaaaagcctgaaattccacattggccaatatgaaacagaaacagttatgatggcttgtttatattgaagatatacatcaagacgtactactattttttttcctatagtaagtgcttggttgatttcctgtcactaatggagaatacacagtaaaatgatacatagtggaatagaaacataaacaggatattcatactcatgtcacttacattggatactttcactgatgtgtggacgcttctcggttgtggaagtgcaaaatctagatttccttgcagctccatattgcgagcagccaatggccttgcagggatctctggaggaggaccaaaaatatcactcccactgagctccttgctcttggcttcagaatgctgcttattcattttagcctcagcatcagtctccagtgtaccactaagctctcgctgcttagccacctcaggtaatgacgatggcttctttggagaaacacttccatcagcactgaatgagatttggcttattccagttacagtttgctgttatgaaaaaagacgttagggcatcagtaattatattactggaagaatataatgttttgagattttgaataatcaacccaagagaaagatatatctcgggacattgatgcaactaaaaataaaattacataaaccaaaacgaaataagatatttctccagatgtgtctttttttttgtcaagtttcatgcatggaagagtagtagtttttttcttaaatcttaactgaagtatgaagtgtctttgcttgttactctatccatagcacacattatatggaatcctgcttattaccacaccacagcaacacgaacaagagaaacacatatttctcaataaaagggaggaagattggcatgtttctgaacaagaaagaagaaatacctgatacatccttacagaagttttgtttgcaggatttgaagcctctgaatcatcattttcactattctcagcgaatatcccacttccagtcatttcttttaactttgagcccgagcaaaattttcgttcactataacaggccaacaaagttataagttcaatataccatatcttcaaaaagtatagcatatgaataaaggatatttgactgattttgttacaactagacacttaagagttggtcgtcgaactaacttcatgtcttggtatacaaaaccaatgaagtcaaaactaaaacaggcagtacgtaccattaactgcactacaataagaaaatgctgtaaaaattcaacaggagctttacatgcaagatagacagtttcaagccaaagcttcaaccgcagaggaagataaatttctagcagagaagcaggaatactcaaaggcagataaactagaaaaatctaggtgcataaaaaagaacatctaccataattcggccaccacagaaagtggtccatcaagaaattttcatggactgttttccataaattatacaaatataaacagccaacactccacaaaattctatgacaggcgaagtaataacatagtgtatgcaatgacatggtcacaactgcaggtcagaacaaacagtcaggctccacatgacttgacttattaagctataatttctggtctctttgtggcacccacgacagaaatatccaaattttgaaccaggcatttgccgtttgcctcagcccaaatcactttcaagcatcattgcctgtactgctaaaacttggattctagcactaaaaatttggacattagcaaacatctcatgtttgcactgtaccacacatacacggacacggttgatcgtcacatgaaccaaccaaccaaccacctgcaagcgactattctccctccagcaaaccaccctgaaattaaaggcgtcgagagcgcaattttttcttcagctgctacttcttcctaaacccagagcaacaaccccaaccaaccttcctaagttcgaaatgttgatgcactaaaccacacgcccaaacagagaacacacgttcgtagatcaaaatgccagatcaggctaattaatcgaatgagaagcacagcacaacgaaatcatagatcgatcagatcagggacgaaacaatgaatgcggcaggatgggtacccccccccccccccagatctcacctcttgctcagatcctccgcctccttctcgctcaccggcgcgccgaacatcgccggcgtgatccccccggccggctgtggccgccagacatcacaccacaacaccagcacaaacaacccacacgcaccctcaaaaaagtcagcctcgcgtgtcgcactcgaacgcacggggaagcagagcagcattcgagcacggcttagtcatagcttaccttgaggctggggcgggaggaggcgaccggcgaggccgcggcggcggcggcgtcgggccccgtcgccgaccacgtgagcaggtccgccgtcgaggtgtgcggcttcctcaccggcaccgccctctccattgctcctctcctcctccgccgccgccgcttttgcctcgcttgggttgggtttcgttccttccgcggagctgaaaaaaaaatgcgagcgccaccactgccgctgtttggagagcacggccgctactagtagctgcgcaacgcaccccctccgtccccgtccgcgtcaccgaaacagtagcctgtacgtcaccgacatgtgggcccggaagatcgtgggtccacctgtcggtgggcgcagggcgggggtacgggttgcctggacaggtacagggaagggaaccgagcgggagcacgagatccgtggatatctgcgttggaaccgtgtagcccgcgtgtgctgggtggagcgaagtggatttttattggatttgggcgtagaggatcccgcgcggccgaggtgccggtgggcacgtggctcggagcgcccggagcacgcgaagcggtttaaaagtccacgtacgatcacgcgatcgagcggcgagcccgcaggtacgccgtgtgcgactgacagtagggtcccaatggcccgctgtcagaaggacagggccttgtgtcggagtgggagtgggacccttctctcggacgcttcatcacgcgagcccctcgtctgtctgatgcgtggggtccccctcctttccttgctcgctcccggtgtttggcccgtgtggcgcgccaagacactttgaaggaaagaaacgatctcgtgttgccgttgtttgttgcttgcttttgctgcagccgtgctactacgcgtgcacgtcttatgccttttttttttcctttggagtatagagtatactgctcgacttggatattcgaactgcaaatccaggtacaatgcggacgctagatattactactagtattcttcgttttcttctctcgagatctcgactgaattaaaggtccaaaggttgtactactctgcaaaaatctactcctatggaacaatcgagctcggccgtacgcatacgcgtacgccgtacggcgtacccgttttcaagccggtgaacatgatctcatggcgtgatcgatgggttgagatcacgcgccaatgcaaagcctgtatggctgtatcgcctcggaagtcagcggacggcggaaccaaaacgagggcgccgtggattgcgtgtaggccgccacgcacggtcgcgcacacggccgccgcgaacgtacaagcgcgagtcaggagtacgtggcagcacagactgacagtacttcaagccgccgttgccactcgggagtcgggaggcggaaatgaacagacgacgccactatgagggtgtttcactgaagattaaaaataaagtcagctcataagaaacaagaaaaccattatatgattaattaagttttcattagtatctgatatttttaaaaatacttctatatatatatagaatgttttcgtatgaaatatagcagtaagggatttaaaaaaacatgctaacaaaaatcgatgtaaaatatatatctcaatcaatcagaaaagaatgcggcatatataatccactaattttgagcgtagcgtatttatcagttttgacctcgccgaatccaatacatagttttgcttatgcggattataagctataatagcttatcatcaaccgaaaacaatttgtatatgtgtttttaacggtttgaaagctaatgcaggaaaaataagctatacaatgaaaaacctcaaaattaagttttaaaattaaaattttggttgcgcttataagctgaaggataatctatgggagtgcagaaacttttggggccgagacaagtctaattcacttggtgaatccgcccctgttttaatccaatgtaccaaaaatcattgatttatgatgccgaaatacggagtatgtcgcaacatatgtggacaatcgatcaaaatcccatgactaaattgcctcgtagtcgagagcttcttttatcatttcatcagcgaaagtacagttaggttaattaactagctcctctcccatgaactacgaaatcaacgatcacgccactcattcgtgggtgaacgttgctgccaggaacatgtcctcctcggtcccgatccacccgcactgcgcgcaccgctcgccgtcgctgcagcagtagtggtggttcacgccgccgagcgacctcgtcgccttcacggctccgtagttgtcggcggcgtggatcatcctgacctcgaccagcagcttgggcgccttgcacccgctcagctcgcggcacgccggcgagagcctcagccaggtactccccgacgacgccggcgcgggcgtcacggcggcggcggcgttgtcctggcacgcgagctcgccccgcgccagcacgcgcgacgacggcctcccgttcccgagcatcccgaggaacgccggcgagcgccgccgcggcctccaccggagctcgaacacgaccccgcctaccgaagccggcgcgccgccaccgcggcgctcgaagcgggcgagctcgccccagaacgcgccgtcctcttcgccatcgccgccgccgcacgggacctcgcgcgtgtccacgcggatcctccgcttcccgtccccagccgggacgtagtacctcacgaagaggccgccgccgccgccgcctcccccctccggccgcgcctcgacgccggccaccctcacgaccttcacctcgagctccacccccggctgctccgtcgcccacacgctcgccatgcacacgcacacaccgcaaactctaaacctctagctcttctctgctcttacactagcttcggttaatttgttctcttctcttccaagaacgcagctaccgcgtgtatatatagccagggtcacagtgcgaggcgcggttggaaatggctctcgctttcgcgaggggaggggattggcacgggcgcgcgcgcgcgcgcgtggactcctcggggttttttagtgggatttccgcgagacaatctcgcgatcccaccggggctcgcgagtcgcgaacccttgggcgctgcaaagggttgatctggtcgctggcatagagccggcggaagagtggcgcggcgtacgtgtgtttttagcgcgagataaggatatctaccggtgcgcgcgcatgttgcgtgaggttgacacggccgaatcgtgggctcgaacgcagcagctacgtactccatgaggggatagctcgctgataactaccggcactgcggaattttatttgatatccccgtgggcctctttaggcgctttggaaatctagaaacgcgagtaaactaagcaaaggtgagggactccgtccgaatcggattcggataagtacataagtagattgcgatcctgcgggacagatcggacagtcgattatattacgcatgtaatcatgtgcgctttgctacaaggtggagtaagtattagtttaagagggtgtttggtccggagattactcagtgatttcattccaagttctaactcgatcctccagaccttcacctcatttgaagagttgaatccgttgatcgagtgatcccgatcgctgctgcgattcctttatgcatgtctgtaaccaccaaagcacgtttgacaggataacagcacacaagaaccaaacccactgggtgccgtttggctcaagaagtcgtccatatggctacaggagctagcgattcgtgctagtgccggtttgactcgaaactcattgctgcagcgtggctgctggtgaatatggtgggacacgcaaatcctcctggccttcaacttcaacgggatgtccacaatgcaatataataattcagcgagttcaagcattattattgcacggccatttagtttcttttggggacaagacaccgatggaagtgtcaataattctcgtagtggtgctctttacccctaacatattcctccaattagcccctgggggagggcctttgttgacttgcagaaagagtgtttcgtcgatcttggagcattgggcgggctccatctttttggaatggtctacatcagatctgatcttcaatggaacagcaggcaagtttaccatcttcacattgtgccatcatatatacaaaagtacagcatagtaacatgagggacaatatcctacattttcagtgggtagtttgacttgacttcctgctactgttgaagtttacagcaatgaatgaatgattgacaactggaccacagggactcgtgatttttacattataaaacaaaagagagcaacaatttcaaacatagcttggagatgttgaaatggtacaaggggcagtgagaagttgaaaggagcacgattgcaattatgacaaaaatgaacatgtttttccaataagaacttttagaatcctgcgactttatttgcagtgtaacaatgtcaaggaaagaggatcaactatattgcagtcgtagcttttgctctgtcagcttcaatcatggcttttatgtagaactcaccagctttgtaggaagatcgaaccattgggcccgaagccacataacggaagccctgttattcatgaccatggcatttcatcagcaaacaagctaattactgttatacaaagtacagtagtattgtttaaaaaccttgaactgtaggaaagattctgagagccaacatgggagtattaagaaatgcatgcaaggctcctttggaaagcaagattcttaaaacacaggaataggaaaaatacaggaaattggagtgctcaagcacctcaaatcctatggactgaaaaattgcaggaatactataggaatgaccgtttaaatggagcccaggaaaaatgtaagaataagaagagagagagagagagagaagatttttttccccaagaggttggacctcatggaaaaattcttatgttttgagccaatctaaaattttataggatttttggctatctattcctttgatccaaacgaccacgtatgaaaattttccataggattgaatttctccagaattccttcaaaaatcctttcttccaaaggagcccaaatttaaagtcgagatttacaaatccctggagttaagattgttagacgaataactgagcatggaggcagattgtatgacaaagcaagtgcctacgttctcaaaaaatcaagtttggtccaccaaatgatagagcaaataaacagctatttagattggttgtattgttctgtttatcatatccctcattgaaaactaataaagattgactagctaatagtctacatgaggatgccaaggaaagcttctttattgtgataaaatctgatgttaatagtaaattaagctttgccatgtacactatgtatcctactaatgaaagccaatacttgattttactttgaatgatgcaaaaaacttccaggaagacggacgtaccatgtcaacaccaagggatcgatacctctcaaaggcttcgggagtaacatactcggaaacaggcatatgacgtttagatggtctcatgtactgaccaaatgtcattacatcaacaccagcagccctaaccttttccgtcgtgctgataacctgatcaggcgtttctccacaacccagcatgattgatgtctttgtgagggtaccagctggagcatactcttttgccaatttcaggacatctattgattgcttgaagttcgcacgatgatctctcacatttctttgcagctcttcaactgtttcaatgttgtgggcgaaaacatgcaacccagaagtagcaaccttctctacacatgctgggtctccacggaaatcaggaactgcaaaataacttgcataagggtacaatatagggaagcacaacattagcagacagaggactgataatatactgaccgaataacaaagcaatataccagaaatatgtcacttaccaagtgcttcaataagcatttctggcttcaacacctttagcttttgaactgtttcagcaaagtgaccactcccttgatcaggtaaatcatcgcggtcaacacttgtgaggacaatatactccaggccccacgaggcaatagcttgagcaacattagaaggttcatcaggatctggtggcggaggagttcgcgaggtcttgacattacaaaacctgcaaatcaatgacttgccaactcactaaacgatcaaaacagaagacttgcaataccttgtctaaaaggttagtgccaattcacgagaaggtagagtgcaacatcagcaaatcttaaactagcaactggaattcatggacaaatcacaacaataataacacagaacacttctttccatacaaggtcacatggatagtactagataaagagacagtaccctgaaattgtcatcatacaggacaacctattctgatattttttgaaatttatgctcaaaatatttccaacaaggttgatttatgtttaagaaaacaacctattcgaaaatacagaagaactggagatccctcatgatttctctacactaagttaattacctctttgcctatttctacaatttttgctaacatccctaatgcacaaatgataggacctaattttacatcacaagcagagctcaagcatccacataatctagcacaagcaactaaaataaactagaagatacaataaccacatcatttgcactaacatggctcaagttataccttcaaggacatcaatctgtgaaatttcatcgaaatggatagcatatgagaaagcttcattctatctctacagataaagtctctaatattacggagacatgatagtaaggtctccatgtacaatccgaaaaggatctaagcagcagcccagctacatctaatgcaagcagcaacaagaagaggattaatctcttacctgcagccgcgcgtgcaggtgtccccgaggatcatgatggtggcggtggcggtgccggtctcgccgccggaccagcactcgccgaggttggggcagcgcgcctcctcgcagacggtgtgcagcttcagctcccgcagcttggccttgatccccgcgtacttggcgccgcctggtatcgtctccttcatccacttgggcttgggcagcggcttcttccgcgtccccacctccaccgagtacgtgaagtcccccagcgacggcgcgtccgcctgcagccgctgccggagctccgcgagccgccccgcggtgggcggggcggccgcgggggagggcgtggacgggtcgagggtttggaggagcgacggggtggaggagatggagcgggagggggcgtaggtcagggcgcgggccagggaggcggcgaggtggcggcggccgtgcatggctgcggcccggagcgcacgaccgccggcggcggcggcggcgggagttggtggagtagggtggggaccggagcgacgatgagatggagtttgcttggtttggtgcggacgacgatgctatggtcttcctcgctttattttttcttattgttgtttcttttttattttttgaataaaatacattttattttgtttataatactattaggcacttcactgaatacagatcaagtacgtatggactgaacaaatttcatcgacatccactaaacattagtactagctctgtagctttgttaaagaaacaggtaaggttatgtgaaggtaagaacgagcaaatgaatacaattatttatgttcattgaatagaagcgcttgcagagaaagttcatgtgcacttctcacaaatacttcgtccatcttaaaacactcaatttttcattcatctcacacgtaccaataaaaaaactaaataccttaacttaatcaaaccttaatataattatctctctttatctacttccaatgcatttcttttttactttcatccaatgattactcaaaaataaatttattttttaaaaaaattatagttaaaaataattttattcaagacaaagaaagtggacaggaaatagaagtaccaaacagtaacaaaattcaatttgcacggtaagtaaactcaaaatggccccttcttaattacaacaagtatatacagcacacccatccatccttgaatataaaaaatatataaacatgaagttctagacatccagattcataaatacttatcttttttttatgacggacggagcaaaagacatggtgcattcattatgggataccatccacaccgtcacatggttactttatatctaatacaatggtcattgacttctaccgattacagtaaactttgtagagaacggggagcaagggagaaaagaaacttttcctcgaaataattacacattcttttacctagcatgtgaaagctacaggtaagtaaaagaatatgatgtataaaacacggagtcaggaaaattttctgttctacaaagaagcaagagctcattaacacggagtcaccgatttacaacaaaagaaaaaaaaatgcagcttacacaaaatgtttcctggtatggtgtacaaaattgagcatctctgaaatgctccgtttgccccagggcagtataaccagatgaaccatttcctttacaggtagcttctgctggaagcaagcagccaagtcacttgtactttgatgaccagttggttataaactatgcacgggaatcaatagtttcagagcagaaagcatatgagaaatattagtgggttggttcactggcgttttttgaacttggagcggcctcgccccctactgtgacaatagttcttcaaaagtaagtcctgaaaatggaatgagttgtgggtagtaccaacaggaaggctacattcaatattcagttgaattttccgatttccatcttcttcttgattgctctctggccatggtatacaaatgaatctatgattccagaaacagtgaagacgcctgcacatcaagaagataggcaccttaggttactaggatgttgatgacctgggttaatttcatagcttctaataatgtatggcccctagagctgacagaaaaaaagttgcatattttgcacatcgttcaggagtagactaaattagacaaaacaaagagaaatatacaaagactaaatggcaagacatatgtctaacttcaggtatcgttcacttgcttcagcagctacattttgtttgttcttagacacaaatgtagatatctcaggttttgaagaaaaagaaattcgatgcttaaaatatcaaatgcttaaatgaaacatatacagtttaataaaattgagtattaagtgtaagacaatgtccacaagggaaatattacctccaactatagcgcaaacattagttaagaagtgcaaaaatgacacatgctgttccgtgaatgtgacctgcaaaaggcatcgatgggaggtttatatgattgttgcagtaatatcactgcaagatgtattattaaacattgaaggcatgaacactgatttcccattcatataaggaaaatatggtataaaagacaacacagaagatgatgcaaattgggaagccagtctaatagcagcgtcagagaaaatacttcaaaacgataccttaattggcgaaaggtcgtaaaagaaaaatactccaggaacagcctgtatccgaccgctctcactacttctaaaatgttccgtcacagaaaactgcagcaaggaataacagcattttaagatatgtttaaaatcgtatccatccatacatacatgtg

SEQ ID NO: 46523 - DNA, 8105 bp, Oryza sativa
gaacagaatgcagtaaagaaggtaacaatcgaacatagaagagagaaatttctgaatataatcagatgagctaactggcaaaaaagaaaaacaaaaaaagaaaggaaaaagggaacaacggtgagaaaattatctaaaagaaatgaggaacggaaagtttctcaatatttggtagaaataaaaaagaaaggtttagaatataatcagatgcaatcaaagatttagaattaaagctggtcattacatttatgcgaagtgtttctccccttgaggtatcaacccttagtgttgtttctgtgaccgcatgaagatataatcctgtatggtgaaacattagctactgagcacaggatgaatcatgaatacaaaaagaatgttcaacagcactaggatatggaagcaaatttagacattgtgagtatatttttacactcagaaataaaacatgatattataaaaacagcccctctttttcattttaatgatatggtcttggactaatttgattttgtcatacatagtaaatattaaggaactctgatgatgatcaaaagttcggtttaactcatttctgcagcatctcaagtttctctgtacacaaggaaccgaacattatgcatgcaagtttgatcttcgtattcattatggagtccctaggagttgtgagaacacattaataccaaaatggtagaatgttctgcacgcatacttaaccaagcacagcacaacaaaagtaaaaatagaagctcacgaactgtccaattattcatgtaacagaattgagcaacaaatgattcttcaatgcaatataccagcagtaagccagtaacaaccagatgaagcaaaactcaacgctgtatagtcgaaatagtggctcgattccagcctcatcaaccagatcctcgaaaacagtcaaggagatctctacggtgagggcgaattcccgccgtaaaacgcaaaaccacaatgcaacaacggcccacacctcactagcgcaccgaattaaatcaatcaggcaaaccctcgtccagcatatcccccatggtcaaatactcaaatccatggccatcggatctccaaaggcacccatccggaggctagggttgagagcagcggaactagatcggaagtgagagggagggagggaggggagagcgaggaggcgtacggagctcggagacgaagaggaggagcatgacgacggaggaggcgagcgtgatgatgccgccggagagcgtgcggctgtagaagtcctcgttcaccttggggtaggcgtccaggctccggagcttggacaggagcccctccatggccggggcccgggggatctcgccgctcctcgccgacgaggaatgtttccggttcggggtcgagctcgagcttggaggcctttgggggagtttgggaacggaggcttactattacctttttctcttttattttctggtcttttgtttgatcgaaacgggaggagaccatggagttgttgcaggttttcctttccttatgtgcgcgcctcgttggagccggtgctctgcggtttagacttcagaccaaaaaggtaagacggctacaaacgcaagcgatcactataaacccatttcggacgatcagatataaatcaaacactagacaatgcccttcctttcatataatttttcagcttcctgtacaatcttgcacaactcatatcttatccattcaaactcagcacaacaacatattattttttaacgactcacacaagatgatgcgaagttctattgaactcagcacaacagtatattatatggcatgatcgtatatttcatccatatcagtcttgggatagtgatgtgattttatcggtataattagaaggccatgcggtaaattgagcttgatcatactccaatcaagttgtgtgaactatcaaaaccatttatataagataagttatcaatttgtatgcatctcacaagatatattaccactaattaatatattttattctttataaaaacttaattcttgatatcctctatatattttatccttatcagcgatccccttttctatatattttattctttctaaaaacttaattcttgatatcctctatctattttatccttgatcagcgatccccttttctataatcacttgccgtgttgcgcgcatctttttttagtgccgtccttctgtctacctctatatcaattactaataatattatgatactttaagaggtttcacttaacttaattaatatatctagccatgggttagaatcattgaaaccgagatgatattgggagcacatgtaaaatagaacttgaactagaagtaacattgactcttttaattttagttttataaaatttgacaattttaaaaatcagagttaatagtataaagttgtagctagcaacttgaaagtgaggcggactttcttactaaagcatcatacataattcagaaaatacccatcatatttcatatatgatcaaagttctaatatttataattaagaaagtaatagctatgtcacgtggatcggtgtctagtatatataatgttacattttatcatgagttagtttattttacgacgaagggattatgcttcagctacgcaccatccctcagaatatttaacaagccaacatattagctctggtcctctagctcgccttataaataccctcgttagcctcctctagctcacaaatcggtacggctcagtttagttcccaacttttttttcaaactttcaactttttcatcacatcaaaattttcctacacacataaacttctaacttttttcttcaaactttcaattttagtaaaacttccaattttagcgtggaactaaacacagcctcaacagaagtgcaaaataaactagctagagtcagtcgagcctagctactcgttgaaggttcaacaatacccaatggctgcaaataggaagctgctgttctgctttgccatcctcgttgctacggcgatcttggtacgtatgaacgcgcgtatatacacattagtttgttttgagctagtctcgttattgacgctggcggtcccggacttggtggtggccgccggcgaggagaagtacgggtgcgtgtactgtacaccgggacccgaggaccgtggcgatgatgcagcagagaccgggaccgggtcaccgggaccgtctatgcacggccaatcagtatacgatgctgctgaagacgccgaacgcacgacaccgccggcgtgctcgatcttcaccgacatctatcgtgctccactgtggagttcgccgtcgagcagtggctcgccggcgagccaccggagcagcactgcgccgagtggaggcgtctgcaagtagagcagatcagacgctggcttcgacgacggtgctgtgtgttgcggctcaaataatgcagcgatatatatacgtctgtctcatttctttccggttttaaatttgtgcatccttgcgcaatactgtcttgtgatatgtcatgtaatttatacgagaaaatccataaaataccatcgacaagcatcttaatcctaaaaataccattgacaaaaacaacttcctaaaaataccatcgtctgcagctattgacctgtttctggcctctcgtctgcagcaataggaggacaggcagattcccaaaaaacaggactgcatcacaggtcatcgatggccaaggggaagggcgtgatgggcagcggcgctactgctcgatgggcgtggggatggcgcgatgggcggagcctgggtgatgcgagggtgcgacgatctgggtgccgtcggacccgagatggaggagtcaccgctgggtcctggcgtcgggtcttcaggtgaccgtcggcagcacctgagagacggcgatgaaggcggtcagggaccggcgactgcggcctcctcgctgcccccagtgaccgtcgagccgccacatgcggcctcctcgccgctacagcccccacgccaatgccttcggaccctgcgccacagccagcaacctccacgccgctgcccccacgactgccgcgccgccaccatggaccgccgccgccgatagagccgcctggatcgggtctagacattttccccatttcatctttatctttttcctttttaccgtgaatgctagggtatattttggactgagggcaatttggtcattcttaaattgtaacggtgtgaaatcaacggtagattgacgacgatggtatttctgggagaaaaatgcttatacgatggcatttttaagatgttgcttttgtcgatggtatttttgggattggaatgcctgtcgatagcatttcatggattttctcaatttatattgttgtgatcgatcttccgcttcggtctctgtttcggcttaactgcttgagcgttcgctgtggaaataagcagtgcgggttaattactttggtatgtggcgaaaatgtaactttactgtgtagattttgctggaataaacatatattgatgagccttttgtgttatattcattctttttacaaccgggatattacggtatgattgattcctgtaccaacagcacttttgtcgattgataactgcgcacgtcgaaagacgtggtttgcatagtagtaagtaaagcaatatgtattaattgattgaattttttgggatcccctattacatgtctctagggactatttatagccttagtacaaggtcatgcaccctagacttaatgtgtataggggaatttacatggataacattatgatcatttaatttgataatttgaccctttccgaaatctaattttgcaaatgagccgcggccaaaacttattttaaaaatgactcttttgttcaacgccaaatcatatggccttgaacttagacatatcagcgccaaatagcacagtgctgaatgcacgttagcacgccgactcagcctcccatccgctgtggcacagtattcagcgccagttgacgtgatgctgaggtgtctaagttcagcgccatacgatgtggcgctgaacaaaagggtcattttgaaataagttatggccattgttcatttgtgggtcattttgaaataagttatggccattgttcatttgtgaaattagtttttgcaaagggtcaaattgtcaaattttatgccattatgataatacttatgagagtaactagtgtctatttggtcatgggctccttaatgggctttataattggccctcaagtagcaaatggcatctaggttgatggcgaatccctcctgcttcgcccgatgggttcgcccattgggttcacctaaggcgaaaaccttggtcttcagctggcgcttcgcctaagcctatcaggtttcggcagcctcagtcgaaggtcctcgtgccatgcctcaaacaagcgcggttttgcatcaatgttctctcctcttcatcatgcactctactcggcataaactcggataaaaatatagttggattagatccattcacatgcaagcgtgcatgccaatatcttgtgaagtagcataaacttcacagatataattaatatattggactatttgtgttcgaaacatataaatcatgtgcacacaagaattttttgcacacatcgtgcacactaactaataagttttatcaaaaaatctaaaaaaaatgtacaagtatttccaatagtgttacataaagtcttaaccttaaattcattatattttaccgtaacataaagataaattgttgaaagttttgagaatatcaatttatcaaaaataatatctttttttctcgctatatataataaatttggatatgagacttcatacatagatgtgatactactaaaactacatgtacaattttttttagaatttttgatgatattttttagttggtgtgcacggtatgtacacgagaaagcttgtgtgcttgcataggatatgttcacacttatgttgggtgcaattaataattcatcatctttctatcacatgattcacataagaataagaagaacaaaaagaaagactagatctaattcagataacataggtgatgtaaggttatatataagcatttgtatcccacttgtgttacctgtttggtcctcttattgtgcatcacatggccaccaattgtaagtgattcgttctagctagctaggatacatcgccccctcactgattcatattcaagtagttataccgatctagtccaaggagcagctaagccactgcaagtatatataggcacattttattgttttccaaatgcctttaggtttcatattcgaggcaagcgtaaattggcccagctattcagaattaggcaaattttaagaggatttcccattccaatagataagcaaagtattattgtatttcggataggggtggacacacccattaagcggggtgggtcagtcggtccagctacggtctgtaccgcctcacacccttagagcccatttctagcacattagccgtcagcccactttcaaaccattagataaatcaagtactttgaacagggataaaaatatttatggaaattcacggtcgaataagtattattttttataattggtactattttgactgttccccatttttgccatacataaaatttgaatttttttatttatttagtacctagtctatactaaatagttaaattggtaaatatatttaaaaagttctattttactgcctcgaactatgttggtggagcactggtcattctaaataattttttagcttattttacaacccgaactattgaagatggttcactcgcaccctaacaatatttctcatttttttatctctatataaggcatatttgcattgaaatttaataggattggtagatccattataatctacttgttaacatttttttatcattgtttatataggttggaagcactaattttgaaaatattttagaactttggttatggtgtcgtttatggcttaacattttttacgagttgtataaagagaaacaaaaaacaaaattgcaattaattagtaaagcaaaccatctttattagtttagggatacaataagaaataaaatattttagaggttaagtgatttgatgaaatagtacggcacaggagagtaaaaaggacctttttacaaatggaaaattttgtaaattgtttctaaattaataatttttggtttgaccattttcatccttaatttctgacataaggtcttcatcactgtctcatattcatgactagcttagtacctcacctacctaactccgagtttgttcgccggttaattttcattgttaacttgcttgatgtttgtgcggtgtgtcaccgtgccgggtccatgagccggtgactatgattttatatgtgatgtgccatcatcgaactagggctagctccttgctaaatgtcatcccatctatattttaaagttgtgttcgccacttatttcagatttgacgtttatggccgtgtttagttcatcaccaacttttaactttccatcacatcacatcacatccaaaactttcctacacacataaacttctaactttttttccaatcttccaactttccctcatcttctaacttttttcaggaactaaacatagcctatatccattcgcaaatatgaatgacatgtcttgggtcctactctatactactagataatgttggtaaactttgaagctgtcctaaagttctgaaatgtgaatcacaaaacaccgagctgggccattaatgcagctttctaacacatgattcacagaaaaagagtaataattaaattttaaaaaaatcattgccgagtatagaatgaaattcaactcctccaaaacagaagatgcatagatggtgatcatatctgagcactattgtgctctactggcaggccagctagagcagagcagttgaatatacagtaagctcgttgtttgacttaaatccccctacgtgatacatcatccttgtgcatcacatgatcgattcatcgattgatccgttgaagaatcctgtatcccctcattcttgaattcaacttgttgtctaatcaaagcataaaaaacgacacattcatctaaaaaaacagtacactaatcatctattatattattaaag

SEQ ID NO: 46524 - DNA, 17901 bp, Oryza sativa
  unsure (1)..(17901): unsure at all n locations
aaaaagcagagtccatatagaaatacaatttataaatagctgaaattctgaattaaaaataagggatattagaagaggagactagagtccatatagaaatacaattaggaaatagctgaaatttagaattaaaaaataaggaatattagaagaggagactagagtccatatagaaatacaattaggaaataactgaaattcggaattaaaaataaggaatattagaagaggagactagagtccatatagaaatacaattaggaaataactgaaatttagaattaaaaaataaggaatattagaagaggagactagagtccatatagaaatacaattaggaaataacttaaattcggaattaaaaataaggaataatagaagtagagtatagagtccatatagaaatataatttggaaataactgaaattcggaattaaaaataaggaatattagaagtagagtatagagtccatatagaaatacaattaggaaataatagaaatttggaattaaaaagggtgaatagctaatatggtccctgaagtttcgcttcaggctcagtttagtcaggtttcaaatcgtctatacatgtcctccaaattaattatttgggttaatatagtccttataccaaaaaaatggtacatgagtatgccaagtcatcctcgcatgcagcgatatgaatgaaatgactattctacccctatatactatatagaaaagaaataaaagacacaaaaaaaaagctaacctaggcccaacattgttgcggagggtggccgacaaaggaatttatacgattaggctgcagcaatcgtaagtgacaattctaaaatgtccatacatgtgtgaaatatttgttttcttttttatatggtatataagggtagaatgttcatttcattcataccgctgcatgcgaggatgacttgacatgctcacgtggcactttttgtgggtccaaggattatattaacccaaataattaatttgtggcacttttttgggtccaagcactatattaactcaaatgattaatttggaggacttgtttggacgatttaaaacatcaaggactaaactgagcccgaagtgaaacttcagggagcatattagctattcacccaatttaaaataaggaatattagaagtagagtatagaatccatatagaaatacaattaagaaaaaagtagaaatttagaattaaaaaataaggaatattagaagtagagtatagagtccatataggaattcaaaactaactaaaatttggaataaatataataaaattaaaagtagagtttagagtatgtataaaaatacaatttacaaataactaaaattcgaaattcgaaattaagaataacatgggaagaagagtttaaggtcaatataggaatacaaatatagaaatacaatttagaagtaactgaaattcgaaattaaaattaaagaatattgaaagataagtttagagtccacatataaatgcaattagtaataataacaattcaaaaataaaaataaataatattgaaagaagagcaaacagtctatatagaaatacaatttacagaaaattcagaattaaaaaaaagaagtattaaaagacaagtctagagtacatataggagtatatataatttacaaataactaaaatttgacattaaaaataattaataactaacacgtatataaaatataatatgaaaatttagaaataaaaataaataatattagaagaagagcatagagtctatatagaaatacaatttacagaaaattcggaattaaaaaaaattaaaagacaagtctagagtacatataggaatatatataatttacaaataactaaaatttgatattaaaaataattaataactaacacgtatataaaatataatatgaatattacacattagtagttttgtaaagttattgcaaaatttaaaattatgttttcattttaatatatttgaataatataatgagaaaacatatatgctattatatgagagaaaatataatgatgctagccgcgcaatctgcgcgggccaccatgctagtttaatcttacggtagcatttccaattcccctatccgttttgtctccgtctataagaagcctcattagccagctgaagtagatcatcgtcggtgcacataacatctcaaaaagtgcagataaaggtcgagacagtctgcttcttcaagccttcaacaatggcgcataagctcctctgctttgcggcactcatttccatggcggctttggtacgtgttctacattttctgagtctcgcttatgagtccatctcgtgatcagcttcaccatatataaccttgaatgcgcaggccgccggagcaacgtcggaggaggacacgggcgcgctgctgctcccgggctcgacggggtcgaaccagtgcgtgtacacgctctacgtggagacgggctcgatctggaaggccggcaccgacgcggcgatcggcgtggagctctacacggcggccggcaacggcatcctcatcaggaacctgcaggcgtggggcggcctcatggcggccggccacgactacttcgagcggagcaacgtcgacatcttcagcggccgcgggccatgcctgggagcccccgtctgccgcatgaagctcgtctccaacggcgccggcgagcaccacgggtggttctgcaagtccgtcgaggtcaccgtcgccggtccccacgccaggtgcaacagggcggcgttcgacgtccagcagtggctcgccaccgacgcgccgccgtaccagctctacgccgagcggagcgtctgcggcaagatcagcacggccaccgccgccgccgaggaggagagctgagctgagcactgagcacgtcctctagtttatgtgcttgttctgtcaaagtgttgagttgtgataataagccagggctgctggtaatgtgcgcactaataatgtagtaggtggcaaaaaaatgttttatgtttttcttgaataaacgtacctgatttatcaggtttttagaccactcgtcaagtcctaaatccgtctaaaaatgctcatcatgtactcgtttgtttgactttacttcccatactctctccttgtgcgtcacatgattgtcacaggcctgcttgtgatctgttctggaataatctttcgcatctcacatcgctaattgtctcgttcaacttgttgtcacctaatccaagcataaaaaatgttggaagatgcattcaatatagagtggcatacacctgcacgaactgttctctctataagaaaatctaacaagtcactgttagatctggcactgcctatatatcaacctcttcagcttagctcacagcagcgcgcatccaatccaaaaattccaaatagagggagttcttcaagcctttgacaatggctgctgacaagttcttgtgcttcgccttcgcctcgctcgtttccatggtggtcttggtacgtgcattttcttttctggtcgtctcgctgctgtgacctgtgagttgatctggccaggtttttgcatacgcgcacgtacgcaggccgccggatcgaaatcaccggacggcgtggcggcgctgccgcgccgtggccagctggtcgccggcggggacaacgacaagaacgagtgcgtgtacacgctgtacgtggagaccgggtggatctggaaggccggcacggacgcggcgatcggcgtggagctcgcggcggcggacggcagcggcttcgccgtcggggacctggagcggtggggcgggctcatgggcgccgggcacgactactacgagcgcggcaacgtcgacgtgttcagcgggcgcgcgccgtgcctgccgtccccgccgtgccggatgaacctgacctccgacggcgccggcgcgcaccacgggtggtactgcaagtccgtggaggtcaccgccacgggcccccacgccgggtgcgccaaggcggcgttcgacgtcgagcagtggctcgccaccgacgcgccgccttaccagctctacgccgagcggagcgtctgcgccaagagccgccccggcggcgaggaggagcgctgagcatgcgcctgagggtgttcttgaattgtgatgctgttgcacctgtcatttttcttgaggtggtccgagctggtcgtcggtgtatggcgagcagtgcgagatttgagcgttgatgcagcaataagccaatattggcaacatgtaaagtttggtttcttagggcattagcagcgcgtcctaggtttttatcggacctcatataccaactagacaagaaccatacatgctctacagtgcaagttatttataactaggaaggtagcccgcgccgcgcgggtatgtattgtagtttgtttttcaaacactataacgatagaatataaattgaagaacatttcctgaatataaatcggaaaggaattccgcacaaatacacgggcatcttatttgttattaaaaaaaatactataaggaatcatacatcactatatatatactgtaagggaatttagattatcctataataaaaaaataaatatatttactgtaaaatagatggtagattttaatatactatttatgtgataagaatgtctcttagatctaaataaaaatccctatatcaattgctagaaccttcgataaaggaaagggatgctgaatatgaatcactcacctattaaaatcccgatatcaattgctagaaccttcgataaaagaaagggatgctgagtatgaatcactcatctattcttccgaattatacgtatccacacgtttaattttttgtttcgatgtgcaaaagcaaaccatttccaatggaagcattcctataatgaattccttagcaacctttataataaatggaatataccaaattgtgatcaatcaaatattactaagtcctggtatttactaccgctcagaattagaccataaaggaatttctatctacactgggactataatattagattggggatgaaaatcttaaaatcgtatattaaaggctgttcacaataaatctgtgcaggcatcgatgatttttcctttttagtatttctttccgattctacaatgtacgtgtttatgttttcttttattttttggctttatctttttttcatcatatatggtgtaggtatttaaattttgttttttttccggtagggagatgatcgtacgacataagcacgttattttttttatagagattagcaataggaattttaagagctctaatctaatgtttaaaatgatgggtccactaatttaagtgaaaattgaaggttggatgattttccttttttactctaaatttctaggattactctaaattagagcgccacgtgaaaatatgtaggagcgtttgcagtaagtttcatagatttttagtatataatagatttttaggatttctctaatttatttgagagtcacgtagcagtgcaaaagcatttgtagaaagtttaatatacttttaatatataatagatagatttagaagatggtttaaagaacattgattggatatttattatagagctttatttaactaaatatatttatatttatgaattaatatattttatcaaaaatcatattttaaagaccgttaatttttatggatgtgtgtttcttctatcttttttaagttcatgtgtattttttttccagcaagattaggaaagatcatgtacgtttgcacgtatggaagtatttgtatcgtacgtatgaactcatacatacggtagtagcgcctgtatgttaaacatgaggaagttttcatctttatcgtgatgttttcttccttcaggcaaacattacatatagcataaaggtattatatatagatctggtttattggttaaaaaataatggatccaccaatttaaatgaaaattaacagcatagatctaatctaacggtataaaataacgggtccatcaatttaaatgaaaatcgacggtgagattagattgtgccacgtggcggcctaggagcaattgtaggagcgccatatagcggcttgagagcgtttgtaggatgtttaatggacttttagtatataatagatagatagatagaagatagaagatagatagatagataatagatgggtgcactagtactatcttttttacttcttaactccccccctctctctctctcctctaatccattccccactagcagactgagtcagcaggcgaaggaaggcgtcggtgctcgccagatccacccctctctcctcccccgaagcagcggcggggtcagcggagtgggagcgagggacgggtgaggtcggcgagttcagcggagtcggtggcacggcagcgggcgacgtgcgaggtccgcgaggggcggaagccgtggacgacggtggcgtggcggcggaacggtggtggcaccgagctgctaatctcgggaggtcctctccctctccgtcgcctcccccgccggctccggatcgacctcggtggcgcggcctcgacctcaagctcctctcgctctccgtcgcctccctctcctccctcatgtcttcctctccctcttcgtcgctcctctcctctcgccgcaccagcctctctcttctccggtcccgtcgtcgcctttcccgtcaagctcgaacgacaggacaaggaaacggctggatatcgagcttagcgacggcggcatttcccacctcgagcttctggcggcgtggatcgaggagggcctcagcggcgagcacggattgaggctggcgaggtccccacagcggctcaggcctacgccgccgcgagcttcgccccacgcccccccccccctcggtctccaatccggtggatccgtcggtggctcatgctgacaagggatgaagcgccgctgtcgaggcgagctccgtcgagggctgcggctctcccttctcttctctgattttgcctaccaatccctgcatctcgccgccattggtgggccatggcggatcgagcgatgaagatggagattggcggtgcaaactggagggagggtcgacaagctccctggcggcggcacggagcgggaggctaccgtccctgttgagctcttcggtggcagtcgatgcggcctccttcggtcggatgctttcttcccgttctccctctcccttccctgtggcgcggggcatgaaagtggtgggtccaaacatgcaaatcctggcgaggtacctgtagcaataattggttccgcgttcctcatggagcaatgaaaaacacagtcgtggagtagaatctccgagctgggctctccgggctgaatggcacatcagcgtattacgaatggccttagagcatgaccagcagctactccatcctaaaaatagagtatctgagagaaaattgatgctccagcagatcttccatctagtcatcgtgctccatattggagagagaaacgtcagatttggcgtttctctctcctcacgccatatcccaaccaccacatccgtcgcgagctcccgccctcttccggaacgagcaggcgacgccgtggtacaccggctggtggagccatagagcagtgaaggtggggaggaataggcgtaccagatctggaggtttcgccatagcacgagctcccgccgtcagccacccgcgcccaggttgtcctcctgccgtcgcctgatccactgcggcgctcccgccgtcggacacccgcagcagcgccctcagcttctcctccccccgtctgcctcctccccgcccatctgcgccctcgtccggtcgtccgccgccgcccctcgcccgtcggcctggccgcgcgccgaccctcggccacacacccaccgccgccctccgcccgcccggccgccgccgccctccgccgcacgcccgctgcccttcgccctcccggccacacgcccgcgccacccctcgcccgtccgcccggccgccgctgcccctccaccgcacgcccgctgctgcccctcgcctgctgcctctgcagaaagagtagtagtagtatgggattttttttggaaataatacgattttaaaggaaaatctcaaaaatataggtcggttagacgaaatcgcaagtttggcactctatcgaatatccgtggttcgacagggtacctatcgaacaaccgcagttcgacagggtgccggcagttcgacagatgataaaataatttttaaaagagaaaaacactgtagcacactgtagctgagaccaagttcgacatgccaccctatcgaagtttgcttgttcgatatgtcctgccaggcactgttactgtcctttttttattttttcccttggaccaactaccctatcgaactatggcagttcgacaggtacatgtcnaactgccatagttcgataagtacctctatcgagacacggttgttcgacagggtgctaaatttacgatttcgtcgaaccgacctatatttttgcgattttctattaaaatcgtattattttttaaaaaaattctagtagtatgttcactactgtgcagcctgagtagagaaagggaaatatacagatgtttatttttgttgtgttcatttttttttggatgttgctacgaatatatccaaaaaaaatgcttcactcaattcaaatatatcaattaaaaaactatccattaaaaatgtatccgttaaaatatactcatttcgaaatattatcgtgataaataacactgttaaaatttagtagttcaaaatatgtcccttaaaaatacaaaagtaaaagtaaggttagttggaagatattattaaaatataggagggtgggatatgaatgacgtaatatggatgatttgttggagtgggaatggatatgaatgaggaatctttttttgatgactatccatatgggtatttagaggattaaatatggatgagctgctggggatgctcttacaggagaagatgacaacgtggcattgtaccatttgtggcatgaataaatgctcttttcataagcagatgggatcaagggaaaagtcaatactgttaaaacaaacttaagaatatgttgctgttactgtatatccaagccggttgagcttgaatgcctgactgttccacatttcgtatttactcaatcatgtagtgtggagtagctaacttcatttgccaatcggcagactaagacctcgtttatttggaaaaaaattttaggtttagttatcacatcgaatatacggatacatatttaaagtattaaaagtactctaataataaaataaattaaaataaattacagattcggccaggaaactgcgagacgaatttattaagcctaattaatctgtcattagcaaatgtttattgtagcaccatattatcaaattatggcgtaattagacttaaaagattcgtctcgcaatttacacgcaaactgtgtaatatatatattttttcacatttagtacttcatgtatgtgtccgaacattcgatgcgatgaaggaaaggcttttttttttaactaaacgaggcctaaacaaagatgcaaaaggaacataggtggagccagtagcacaacgcatgacacacacggtgatgtcgttctgaaaaatatcaacaattgaacacgcttgggaggccttgtcctgccactatataccatatctccgtcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttcttgaattcttgactgcttatcagcttatgtactactatttggccaactatttctcgtctgacacctgcttagtgtcactgtcttcgccaactaccccaaattaacatgtagtagtagaccggcttcgccctcgccaaatgataattatatgatccctccgttctattaaaaaacaaatatataattgaatatgatacattctaatattataaatctgtacaaatgtacatgtatattcatagtactagaatatatcatatctaatactagattagtttttttatgagacggaagaagtatagagcattgaaactcattgtaatcaacaggatcagggccgatcggtggaggtcgtgctcctgttttcctagagatgaaatcttatctctgcttcccaagattcagggccgatcggtggaggtcgtggcctatttccgtcggttgtttgtcaaaaaaaaaaaagaaaaggtacagtaaattttggctcgagtgcgtgttacacgtgaacgcggcagaattgatttccttgcaccgtttggttggataagaaattttttttctctgtatgtatccagaaggatatgccacctggatgctcctcctagctagtgtcactgtcaggtgggccccacccggttccccttatggccttatggtactactcctacctcgttcgcaaaatcctcctcccgatctccaccaccactttcccattgaccgcggcgggaaagggccttcgagacttgggaggttggagcgagcaagctcggccatggcgaagctctcctgccttctcatcgtctccttcgccgtcgtcgcggtaagtcccgtccgctccctaacaacatagaggtacgcgaaaccccccttctcatcgtcatagggcgccgtatgtcatgcatgttgtacaggcgttggcggccacggacgacgacgcggcggcggcggctgaggggatcacggtggcggaggcgtcgtcggacccggagaacaagtgcgtgtacacgatatacgtgcggacggggacgatctggaagggcgggacggactcggtgatcggcgtgacgctgctgggcgccgacggctccggggtgcggatccgcgacctggagcggtggggcggcctcatgggcgacggccacgactactacgagcgcggcaacctcgacatcttcagcggccgcggcccctgcatgcgccaggcgccgtgccggatgaacctcacctccgacggcaccggcccgcaccacggctggtactgcaactacctcgaggccaccgtcacgggtccccacctcggctgcgcgcagcagctcttcaccgtcgagcagtggctcgccaccgacgcatcgccctaccgcctctacgccgtcgtcgacaactgcaacaaggccaaggacgccgccgccgccgacgccgacgagccgagggtcaccgtgctgtaaataaatcgtagattctctttggattcccgtgtaattatgtaccttacgcgtatgtggtctactgctcgactgctcgtgctgtcgtgcattgcagtgattgatccttttttttacattgaggggaggatgctaaaataattatacgattttaagagggtaataagatgaaaccagcgttggatcggtcggacgatccggtgctcactccagttggtaacatgtcagcatcactccattcacaccttcaatgtcaccatgactggcttattgatttccatgtatcgtttttgtgtcggcataatctctatatgaaatgtacatgcggcatcgagacctcacggctgtttacacatcagtgtccgacaggcctgtcgttgtgtatacttgtactggagtatacagtatatatgtgaaccatgggtgctctggagtctggagtttgatgttgtttcttcagaagtcagaactcagaacagattttgtttgattgcttctgaagttaggaaaggggcaattctgaaacctgcttccaagattccagaacaagtggacaaatgggacctgccgacggcctcttttctgcctagattgggccgtggcccgtggattcgacgatacggcccagaagtcctagataggcccaagcatggttctgttgaaaagtctgcgggggtaacggcgtgccgggccggagttgatggctgaacgagaatcttcactacagcacggagatgatcatcagaaacatgctaaaacttgtccgcgtctgtggaattcagtgccatagatcgggatcttcgtctcaaacgagtcaaatgcaacgtcgctagtagactggctggccgtgtaactatgtaagcattcacaagaaatgggaggacatacacatactcatgtggcggtggtagtagtacgtactccctccgtcctaaaagagacgatttctggaagggaggattcctccacagaaatcaagaaaacttcaaatctatcgtatcatttgtgggccctggtggacagcgacttcttctctcgttcacattcacaccgcaaaaatcttatcgcctgcccgtctctaccagtctcgcgtccctctctttctctcgcgtttctctcccgttcccaaattgactgcatcaatgcggcggcggtaagatgcgagacctcaccaagctttcgaccccctctgcacctacctcccgctcggcgaaggcaacggggagacgcggcttcgttggcggcggcggaggcgacgggaagacgcgtcgtcgtcggcggcggaggcgacgaggagacgcggcgtcggcggcggcggcggcggaggcgtcgaggagacgcggcgtcggtggcggcggaggcgtccaggagacacgtcgtcgtcgtcggcggaggcgactgggagacgcggcgtcggcggtggtggaggcgacggtgatacgttcttgattcttgcagtggtggaggcaaatcatggttcttgcgatgttcatgctctactagtactagtattttctcaactggagagattttttttttttagtatttgctttgtgcacgtgaagcgtttggcattttttactctgcatcagatgcttctggcatactactcctggatcttgtcagaagggcattttcgtcttttcacattagtactaaacttacattggggatccggatcagggatcgcttcttttttggacggagcgagtaattgcgtacgcggtgcggacgtcagcagcacaggatgatacagcatggcagtgtggcgccgtcacaaatggcgtacatgcatccaggtaaaacgctcgagtccacgagccgcccacacctccccccgcatcgtggtcctgtgcgatcgtgctacgtcagaactcagaaacacgcgaactcccttccgcgatccggcccttttatgtctgcagtagcatcccgtattcgataaaaccgctggtatatgtatatgtagtacacgtatatataaacttttatatacatcaaaagtatgcatatgcgtataaatttacacatatataaaattgtatataggtatatatataatttatatgcaaatattttttatacacacatataaactatatatatataaagttactttctatctaaaataaaagaattttacgccatattgatatatgtacgtatgtgtcggagggtgaactcctcgagcagggaaccgtgaggcccctcttttgttagtttggtcggggacagcgggtgaaagttgaggaactggaaggattgggagaaaacgagagggtcgggccctcggtgaagatgagacgctagggagttatccaggttcgggtcgctaaggagtataatactctactcatgtgtatgatgatttttctgagcttacaaagtctctgaatctctggtatacaagctagggctaagccttttcacctttcgatccccctccctcgctatacatggacctccctttatacttcaaagggttaccacgggtgttgagagtgctacctaccaaagaggaaaaatgttctctacattaaatgtgtgtgttgtgccttgtcttggaagccatgcgcacaagtgtcgcaacatgggcccatcaaattgaaccgcctaacacgagggacgctcgtgtcattcggcatttaatgggtgaagacttctgggttcccgtttgcaccggaaaacgggagccttgcttactagagtggatgaaccgactccggtcgggatgagaggcttcacgatgtgacggggcaggttagatcgcacgccgcctgacatgtgagtagtgcacaggcgcactactccggttccatcaatcattcaaccggtcacgtgcacagcacgcactctggccgctttaaatgcggttaggtggccgttgggggcgcccacctaactccgcatacgtggcatcatgcggtgggggttggggcagtccaacccccaatcatggagggggcagccgccgccctaccccgggcccgaccctcttcgggggagtgccacgtgggtgctaggagcagcctcctccctcaagttttaataccctcaggcgaagagggggcagccgtcactccacatcgggcccgatccccctcggggaagtgccatgtgggtttcggggtggcctcttccctccaaacatgatacccctggaccatattattgacagtagcccccggcgttagccctaaccgaatgaatatagttcttttcgaaacaacagcaagagtgataattgcatgaaaaagatcactagtgggcctgtttggtagccggggctgctgctgcgccgcagcccatagctaatgtgaacagtgccacactcaatatgtgtagctgcagctgcagccgttgtagccggcctgctgaacaggcccagtaacatcataaacaaatactacaagaacaataattgaaagataagtgcagggctcgtcattaccctcaaccttctcctagagagcagaaaaattatcgcgtccgcgctgtggcacaagaaagcacaaaagcataaaaaattaggcttcttagtcttagccgcgtgtgtattcttctcctacaagcatgtgcggtgcggacgggtgctaccgtacaccaccggtccaccaccaccctactccgcactcagtgagtgcctcgctggtcagtgctcccgtccctactccctacaagtcccttcgggctccaaggcgctgcgtgccacagcaaatccacctaccaagcctagcttcttccacatccttcgatccgcccggaacgtctgcacgtacataagtaagcacgccgcaacctttcccgccacccttccgtgccaccttttccacgagttccgcttcacacagcaagctctcctcatggaaagcctcgcctatccacagaaacagaaacctcctgctctcgagccgctgccacggccaaccgccgccatggacgacaaaggcaaagccaaggctgctgacgccgctgctgctgccgaggcggcgccggagcaggaggagttctttagtgactccgagtccgggtccgagtccatcgagatcgccgacctgaagaagcggatgtggaaggaccacatgctgctcatgaagctcgagggccggtcgggccacgaaggcgccctggcggcgcagcaccaccgggtcttcaggggggaggagcaggcggcggaggaggagccgcccgaggcgcggtaccggcggaaggcgatgctccgggcgcaggacggcgtgctccgccacatgctcaagatgatggaggcctgcaacgcgcgcgggttcgtgtacggcatcgtggacgagtccggcgtgccggtgtccggctcctccgacagcctccgcgggtggtggaaggacgacgtcgcattcgaccgggcggggccgacggcgctgtcgggccgaggcggccgggggagcccgcggagccccgcggcggcggcgtcgttcctgcacgggctcctcgacatccaggacagcacgctggggtcgctgctgtcggcgctgatccagcactgcgagccaccgcagcggagcttcccgctcgaccgcggcctgccgccgccgtggtggccgaccggcggcgaggcgtggtggggcctgcagggcgaggcgcaggccagccagggcccgccgccgtaccggaagccgcacgacctcaagaaggcgtggaagatctccctgctcagagctagcgccgtcatcaagcacctgagcccgcggttcgaccagattcgcaagctcgtgtggcagtccaagcggcttcagcacaagatgagcgccagggacgccgatacctggtcccgcgtcatcacccaggaggaggcgctcagccgccacgcgctgcgctccctccacatcacgccgctcgacgacgacgacgacgaacccaacgaggggccgacgccgcgcgagtcgcacgccgacaagcgcaagcgcgaggtcggcggcggcggcggcggcggcggcgaggagatgcagctctctctgccggcggacatcgacgtcgtcccggaggcggaccgcagctccatcgacgagctgatgaagctctactacagctgcctgcaggggaccgacaccgacggcggcggcggcgagcaggggaaggacgtggcggccggagccggcggggatgggagcgtcgctccggagaccgtgcatgtcgacgacgacgacatgctggagggtctcctcggtgtcgcgcaagtggtggacatgagcgacttcccggacagtcccatctgtcactgggggtcgagctcggattagtgccggataatctgatatagataggcgtggagttttgttaattatttatgcctgtttaattagttaatttcgttctcttccattttggattgaaaaaaatgacagctccaagcagagcagaggtatctagtttgcactaatttgcagagtggagtttggtaccggcaggtattgcaatggttgagattgggaatgtgatctgctcctgtacttgaaatcagctcatgttacgaccaaatgcagtatcgatgttgtatctgcttcaaggcaaatgcagccattgaagaaagagtggcaggtactctggagttcttcagtttgcagagagagtattcttcagttcttaccatatgctcctacttatctttgccagagctactatagcacgtttcttccttcggcgcaatggaagaaacaaaatactatggtcatttcgaacctcgaagagcggatgagatatttcgtagcaatgcggcctttagctgatgcaatttcgccatgcaggcaagcggccaaacagagtgcacatgacaaaggaatggcacgaacaccatgagatcaatgaaatatccttgctcatcctgcagccttaattatatatattacatatggtacatacactgggaagaaaaataaaaaaaaataactccttgattaattcccccatttggttcacgcacaccacccaacccaaaagcggccacgaacacaacaagatacattttgctactgctcctccgacctccaatcgttcgatccgagcccatgcacgcgcccgatcgatgcaacagctagcgatcaaacacgaagcgcgcatgcaagcgaaacccaactctgtgtgtcagatccatggcgagcgagagcggggttgattgctcataggccgagggcgccgagcggcgtcttgccctggccggcctcgaagtagaagatgagcatggcgagcatggcgaggcgggcgtgcttgatctcggcgagcttgagccggtcgagcttgtcggtgtccgggatgtagacgccgtccctggtctcgccgccgaggccgagcgggtcgaagaacttgccgccggggtagccctgctcgccggtggcgttggagaagttctcggcggtgcgcgaccacggcgtggcccactccaccgcctgcgagtccgggttgaagaagtcgacccaccgcttggactctacccagcccatgagcagcagctgcgtcccgaggagggagccgaaggagaagggcgcgatggcctccggctgcgcgccggcctcgaaccacggcacgccgctccacgcctgcccgacgaagatccccagcaccgccgccatcgcccaccgcccgtggatcagctccgcctccctgtaccacttgaggaacgccgggtccttgcccagccccagcgggtcg

SEQ ID NO: 46525 - DNA, 26441 bp, Oryza sativa
ggagcgagcaggacggtcacggcggcgagttgatatttaatcgtggcgccgcggagcgccgcggccacaggatggggaaatccccggggagctagggtggatatgtcgccggccaatggggagcgcgcgccatcggattttgccgcgcaggtggacgccacgtggactatatcctgcccacgacgctgcttgtgatttgtggggacgggtcgctggtgtgagaccgccccgcagtaaaatcctgagcgatttgacaagtattccagttcagttgcgttcttctttcatgttggactcgatttctttacgtgaaattaccgcaaaactgttgtaaaaaaatacatttgccggaaatggccgttaaggttaaggccaattggaatgtaagaataagaatttcatggtaatattttgccaaaacaattcatttcccacttaaaactgagaagcattatcactctccaaatgaactgttgcagtatcgtcagatatttgcagagcttggctctgatctgaacaatgatgcgcaactggtcagtttcaccgtgtgcacttgacgccccccaactacagcagatgctgccagacatagtagaatgcaaacttcaaacaatcagatcacaagtgttcgacccgtttgcgcgtcgaaatttgatttcctgagacaggaagatgcaggccatgtcaacagtggaggttgcaaggaaaccagtttcttcaggccacatatttcagattgccatcctttggcactacatgaacaaactagcaccgctattattacaggtgaaaaaagatggcatacactgggaggggccttttcgcttgaatgaatggtccctgtaaaactgtatgcaagtatgtattgcgggttatctgagtggcaacctctttgtcctttgaacttactgacatcagaagttctagcatttcatgacaatcttatagaagtaatctctaaaccatagtggtgcatagtacaacaagcttagaatagcactgaactggccgtaagcaaaccaggctggaggattcttcttaagaaccaaagcaacaaccctttttgcgaggtcttctgctggagtagaaccaggaccctgggaagcatcagtcctggctctgagggattcctcgaattttttgtagtacttccagtcacgtatttgaacatacttggatgtagagttacttcccagattcgactttgtccctccaggtgcaacaatcataacattaattccgaaactttttagctccagtctgcagtgataaaaactgtcgtgtcaactgacagtgtcaaaagtgaaaaataatttcagcgtcaaaagccacagatcatgcggtgcaagtcgaaaagaactgaatatacaagaagatgacatggaaaacaaacaaatgggaatttcgaatagtctcacactattgtatcgttattcatttttatttcttattatagcttctgttgaaaagcattttgttgcacgatcaaacaatttagcaagttctcagagtagtgataaaccagcagtaatacggagagaaaaacaatgtggcataataataccagcatagtatagagtgctccttgaatgtacagaccttagcgtatcgctcaatgcatgaagagcggcttttgatgctgaatatacaccagcccatggtccaggagccaaagctgttatacttccaacattcactattgtaccttgttccctttctatcatttggggaataacagcatgaatcagcctcattgctcctgtagatgaaaagacagtcatttagacattttcataagtgcaggcccaatgtaagtaatctcaaacaagctgttgcacaagcatgaagccatgaaccattcaagcattatgaaacaatgtggaaagcctaattgataactattcccccctgcgcctccatcatcattctagcattatgaaacaataactcagcagttcaaccagcatacatttttacattggaattacatatatttacgtccggttgaagactatttatcagcgtatgaaacagcgtggaaagcctaattgtaggttaacaggctatgctcctttcaaatacctttacattggtttaagagctattgtgaatcatacacttaatgggacaaaataatttgtcagatccaatgagagaatgagtcaattccacattccagttgcttcccaatcaacatcatcgcagcatcgtcactgcactttgactgtcaatttgtgcaactgacaggaagcgtgccctgggagcactgatctgactagtgttagagtgtgcaagtgtataatacatctttcaactattggtactgcaatttcgccaatgaaaccccatgttactaaacatatcatgccaccaagctattcttttggttggattttcattgtggtgcacaactagaaccagctcagtgtgatctactaaatattaacgcatctccttgctaacatagggttcctagttgcaaacttataagtaatccagtgctgcaagtgactacagaagattttacatacttttcctaaattagtactggcactaacaggataaaatgtcttgacaaagtaatcctaaatttgcaacttttctgccgttgtactactcaaccaatcgatagatacaagaacaaacattttaattgcctactaatcatacttaatggaccacctgatcgcaggatctaaaatcccgtcttcttcgagaacatcgcaatcaccaaataccagcaagcacgagagacagcaattaaaacaaagaagaaaaaaaagggagcaaaaatttccacccctaccatagacattggtgtcgaacacctgctggaactcttccatgggcacctcggcgagcggcgcgacgaggtggaccccggcgttgttgacgagcacgtcgacgcggccgagctcccggacggcgtcggccacggcagcgcgcgcgctctcgtcggagcgcacgtcgagctccagcagcaggtaccgcgggtccccctccagcccgcgcatggaggcgcgcgaccgcgccgtggccacgacggcgcacccggccgccgcgaacgcccgcgccatcgcgtgcccgatcccgccctccgagcagcccgtcaccagcaccacggggcggcgggcgccgccgccgccgccgccgccccgccccgcctccttgtccccttcggtcgccgtcttccccatccacgcgtgagccgagccggcacggtggcacgatgtgatccagaaccttgggaggctggatggtggacagctgaagtcagtggcatttatggccgaaccgtcgattggttgtactgaagtggagtactagtagtttgccattcgcgaagcagatcggaagatcacaaatcaaattggtagcatgattttgtctctcgttttcaacggaactagcaacacaatctgccatatgattttttttaagcacaggacaaataataattgcccacaacatgcatacgcattcatctcatatgaacgcacgcacactaaatatctacatgaacaccttcaaaagaatgtgtcggagggtgtggtccctcagacagcggggagtggagacctctctccctgagtgaagatttggccagggggttagtcggcgtacggttcatggtatctgcgatcgcggtggattcatggggtctgaccaccccgcgaggaggaggcaggaggttatataggttcaggccattcgaagatgtaataccttacttctgtgttggtgttcgttctttttctctagatcaactaagtacgaaggaggccttcttcggctacaaagcaatagatttggcctagaagaatccaacccttcatctgtatctagtccccttccttttatagtccaaagaggggctcacattattacaaatctactcttagtcttgtctcatcaaccgtcttgtcattgccagccggtgtcataacgcagccccaagaaaccgttcaagtcttacagttcatattaccccgggctcccgggcttcgtctgaaatagttgagctttcgccagtgtgctcaccacgtggtgcgtggtgggctcgacgaggcccgacttgcccgaaacaaggccacagtacttatctgtctatttggctaaatgaagtggcatggggcatgtgcgacgcgtgtcccaggcgccaccgtccaaagtgacttagctctggcgtcttgtctacgtcctttcaactcagactggtcgggaatccccccataaacctgtttcatttatggcggggcgtgctaccttatagttggctgtggagcacggccaacttcctggaagtttctgagatcgcgccctgtcgcacttaaagaaggttaattattccgtgaggagcttctcgaaggcgttgttgatggaagaatatcttaagattgtgcgtcttgtacctttggacaaccctctaagcagaggaacgcaagctatacaaggtccaagttgagctcggggcccgaagcacaccttggtttacgcctttatgcttggcaagccccgtcacccctcttccttgagtaatgcgtgacttgtaaggattaaggtgagcctgaggcccaggacttggccgggcccgaggcagaccatagtttatcctcttaaggcatataggtcttgcatgttttacactcctcttgccgggaaccgtagaacctgcgaggactagggtgagcctagggcccggaatgggatcgggccccgggcagaccttaggttacattcttaaggtatatactttagggtatgcttgggacccaagctaggccccaagctgctttgatactcagagttttgggccatacactcaatattcctcctcagccggagtgaaccccatgtatgaaattttaggtgggcctggggccctccggagtgggcccctagctacgccaccctagggtttccttttttatttttaaggacattctgagcatactatttatttgataataatgcttttaccaggtaaatgggtattacagttcccattttaccaacagactgaatcaatatatctttagatcgacaaaggtgcccatcaccacgggcacacaagtacaccatatggctaagaatacctctaaaagattcaccacatcctattcctacgaacacctctaaaatatgattctttttaaacacagtacaaatacaagtactcacaatgcgcacacactcaccctataggaacacatatacacattatatatccatatgaacacctcgaaaaaactcacgcacaccctatccctattaacacccctaaaatattagaccaacatatcttgagattaatgaaggtgtcgatcaccacacgggcacttcgttgtcaataggtatgccactgacggagcgcggggctcctcaccgggagaccgcgcaggcccccctttgccggttcgaccgggggctcagggtgaaatcctaagctctctgtgtgtacaatgttcgcgagagtcgaaagagcacacgaggcacaggcgatgtatacaggttcgggccgctgaaatgcgtaagaccctactcctgtgtttttggtggatctgtgtatgaaggagctacaaagtatgaaccagagtctccgttgctctccgttctcaatctaccagagtcccgtccctctctcttagtgggcaaggtcctccttttatatcttaaggggataccacatgcaccctctctccctttccaaactggacttgccctctcttcataaatggacggagatttgtatcattgctgtccgaatgatcttctgatgggacggcacatacctacctccacttccgccggaggcaggtgcgacgtgggaaacgtggctgtctgctgacgacatgatcagtgtcagactggtcacaaatcggtcattcttgtccaccacgcgtcagcttagcaatatgcatgtttgcccttcttcacacaacatcttgtctgtaatggttagaatgaagcctggcatatatctaaccgggactaacgtgccatctctaagaggtaacacgctagctccgtctgggaacgagcgcctagaagccctcgtcctgacgggatggggcgaggcgtgcgtcagaccgcctgtcgcgacctgaccgcgatctgaccggtctgtgacctgtcacagaccggataaacgagcgcactgcactgcgttacatgcggcatgacaggttcaaccaaaccgcaataaatgcgggtaggtgagccccgctgtgctcacctaacccatacacgcggaggagaaaccactaggggtcgaggcgcttcggccctcggggcagaggcgggagtggccccacccccttggggagactaagaggagggcgaacacgtcaccctcgggcccgacgtcccccgagggtgccaggccacgtgggcgattatgtctgcctcaagcctctagtcatggtactcctggtcccgtgtcaccgacagccacctaccatcgaaagaataattagatgtaaatatgagcatcgatgttaagtataggactaaaactcaggtgggttgattccaccacaagaaaaacataaccagttgagctacacttgcatcaccgatttgccatgtgattaacatcaaacattaaagcctgatacttaaatccaacattagcccacatgacggttgaaagcaagcccggtgggctttctatatgggcaccgtctaaaagagtaattgacccttgtgcgttgcgatttgtgttttttttatttttggaaaacattgtagcccttctcatattgtttgtatactagttgggatctctgaaaagaaactccccaattaatcaaaaacatcttatagttggtcaactggattgaactatcacaactgcagagaattagtaatctattctaactctttttaaaagagagtagcggtggtggtgagtggtgaatttatcaccacccttattaaattaaggtgttgatttgattctggtgataaagaattattaagagtgataaaaaagtgattgagctgatgtttgtgaagtgatgttgaatttggcgaagtttcatggcaagagtggtctcaccaccatggggccagcgatctgactgccatgggagggagcacttagaccggcaaactcctgatgaatcagttttgggttgattctatcgaatatgttgattgctaaatgtttatgacttttagatggtttctatacgtgagatatatgtgagtcaaattggggaagatcttgtgctcaaatatggtttctttgtttgttaacgtgtagctgttgcttgaggtcacgagagtattgccgatgatggatcaagactagacttggtagaagttgagttctagaagatcaaggagatcatgtggataccaaggctagagaataatgcacatggaggtgacaaggggaattgtgtgcgtatggataagttgaatttggattggagtccaagttcaagagagttggagtttagtttgattttgtaattagatgtgaataagggaggctatgcattgagggtaagccacaattgagagattaaagagtttactactctttgtgttagggttatgtgagaaattcgtgagaggtgcaatgaccgtcttatgaatactacttgaaaaagaaatatcatattcaatcaacaaggcgtcaacgatcttttctggttttgtaatctttatttttttcgtttttggcattaatttgtgattcttagttttgttatggttttgttcaagttaatccacccgaaacatttctattatattatagatcagatctaaaaggtttcattggtatttgcttgactcgaatttgcttaaaatttatgttttattcatatttgatgaaatttctgagacgtctagcttttgagatgttttctcttaaaccgtttattacttttgcatgacccttcgatagatttgtctcttagtttcctgtcaagattagagctcgatctaatggctggttttagagaaaacaagattttacacaagtgatgtaaggttctttttaatctgacgatcgaactagtaattgtacttcagtcaaaccagttctaagcccgattagccacccgtacagatccggttagagtgtcaaagtttgatcttttggtttttaaggttggggtgagttttttatctatcgaagtttggttatttgacttctgctaatgttatcacttttcacctccctatggtaagctcggtttttttttgatcttacaaccccaccaccaacttcctactatttaggaaggaaaaaggacaccgtgggatcaaaagctataataaatttatgtagaaattaaaaaaatatctagaaaatgatataatttcctttaatgtacacacaatgtgctactttttgttaaaacaaaatatgctaaaatttaataatctgtagatcttgaattaataataggatgtagatttattttatcaaaccccgggcagaatgattcgtcatatatagtaagcgagcagtatgctgacgaattgacgattgaggaagaagatcagatccacgggagcaggagtatacactatgcagagacgtggactagttattctctgtctgtcggtcggtttcttttgtgaaagggaagatgagaattgaatcggttgaagatggaatgatggatggatcatatcatcgatgacaaataaatgaacgaacgaacgaatactgataagaagaatggtcgatgaagatcaatattcgttagtcctcctaccttatagtacgtcagtcaaacagtgcactgcatacgtacgtgcatactccagtgatacagtatcctcctatatataactatttttttggaagggttttttttttcggcctttatatccaaccggatatattatgcagccattttaaattactcccttacactaggatgtgatcacattcccaattatctctcttatattatgaaatggagggagtaggaatttaacctattaaacatggaacttagccaaagatttgaacttatgaaacagggtgttactcagatcactacaaccactagactacatgctctttcactatatatatatatatatatatatatatatatatatatatatatatgagctaacttatgcatatacgcacggattaattgcatgcagtatttaactaacatttgacgtttagtataagatatgatttgattataaatatatataatttaaaataagattcaattgctccaactattactttttattattaactttataaaatataatatgtttaaaatattaagccaaatatacatatatcactttttaaaaagaacttgaatatttgagaattattgatgtcaaagttctggaagttttattatatgttcctcgtaacgttaaatatttagacaaatggaatatatacttgttcttcttcctcttctctgccttttttttttttgcgaaattaaggggaaaactaaaataaagggctagctagaagtacatatactctccatccatccatcgtttgattccaaacaattgaaaaatattcatacgatgattacaaggcccgcatacaaaagggaaaaaaaagatttgaaatttatcgaattaactcgatcaagagagacatagaacgtcaaggatcgaatgcctttgctttgcaaaccattaattgtcagtgtcggctaccagcatatctcagtaccttccacttcgatcgaaatcttacataggctatgtttagtttgtgtgctaaatttattgtaaagtatacggacacacatttgaagtattaaacgtagactaataacaaaataaattatagattccgcctgtaaaatgcgagacaatttattaagcctaattaatctgtcattaacaaatatttactgtagcatcatattatcaaaatcatggcataattaggctcaaaagattcgtctcgcgatttacatgtaaactgtgcaattggtttttttcgtccatatttaatgctccaagcatttgatgtgacggaaaaattggaagtttgaaaaaacaattttgaatctaaacacggccatcgtgcaatgttttctccctttcctatatcttttgacggatcgatcgtgcaaagtttcatttcatataaataaaatcaattatattttcttgtatcataaaataaaatgaatattaatacgcttaattaatgaagcatcatacagtattgttcctggaaaataaaaggagcaagcaaaagcagaggaaataatatattcagcgcacgtacacaaaggttgaatttttactgtttctgatatgatgcctggtcggttagcatatattatatgacgtaggggggggggcataaaaatcagcatattaatgcactacttcactaatatcacgtcagtgtgcgttggatttatttatgcgtaaactttataataatgggtagtaactcattaaacaaatatcaaaatgttattccattataaaaaaagagcattactgcatatgtgatgcttataatatgactatatgagtatgagtatggccggtacgaagtgacagcgtgtgacacggttgctttcgcttgcaaacggaagaattccagcggaagaaaataatatttagagtaattaattaagatgccctgaagaagactaaagtaacataattgtgttagtatctccttatacaatgacgtgccatccttagaaaaacttaattgttagtaacataaattggtcgcccggccagcccatgtgttccatccggcaaaaatgacacatcggatcaattccttcatgcgtacgtgcattgaatgttctactagtattcaatggagcatcggatgctctagctgagaggagaggcccagctatgcatggtatctgatttatatagtttaattgctatatatatttgttccatcttaatgtttgtttttttaatgatcattcttttccttgttggggcatatactataagtcagctttaacctttttcccccttccctcctagtcaccttgctgaccaacaacggatgacgcaccaaagaaattaaagcatctatctcattttctttcagaataaaaatgttttttaatccctataaagttatacatgttgccagctttgataaatatatatatatatatatgcagccagcatctctctccctgtgatcaaattaaaactgcacgacaaattaattaatcactactaggtagctagatatgatcgatctaataaggaaggagaaaagaacagacctgaagatctcatcatcattactactaacctgaagatatgatttatatataatactaactatactacagtatgtggcaccaaacaatacctgaaaatctcatcatcattactactgtctttgacatacatatattactccttgttatgtaatctaaacgcgtaccttgtcctattttccatgccagccaagcatccaaccttctcattcttcttttcttttttttttaaagagaaaatgcatatataaagctgatgaacaaattcttcctctatctttttcttaaaaaaatatttttgggcatgaagatgataagttgttcaacttgagtggtgtaagaaagtaaggctaattaatactataatatcttattggcatccttctaattgagtgcacataattaaagcaatgcagaaatacgtacgtaccgcgcgatatatgttgatatatgtagtaaagcaaggaacggaatattgtcaaattgtcacttggaggccaggcatgcatataaattgttgccaccagcagcatgcttgatgccatatagcaaggcgaaagcaacattagcaagcacacatatacatttgcagataggtatagctaagctctagccagataaaaagaagattatggtcaagagatcctgaattaatgggtagctgtaatagttggaagccaacgttgacaatggttggggtggtggtggtgttcgcggtgatgaacaccctcaccaagatggccttcaacgaggggatgcgctccaccgtcctcatcacgctccgtcagctcatcgccactctcttcctcgccccaatcgcctacttccgggagaggtaaatatacacttaattctttttgattcacttgaattacgacctttaccacaatggtgccgtccatggattaaattatttcatgaattggatttcacttacctatctatggttcccttgagtgtgctcaggataagtgttttgtataaatggcagttattcgtttagtccgatgcatatcagttaattgataggttttaatttcgtatatatgcgttaatcgattagtattggtactactatatattgctagctagcagctgtatagtaccatatatatgtgtattaattactagttggttgatacgtatgtgccaaatatgcatgcaggaagacaagaccaaagcttacggctgaaatcttggtgtgtctcttcttcagtgcagtgctcgggcaagtcattttcatatatgtataatatatctagtagtagctagcaattttaacttgatgaattgaaagatcgatatatattcttttctctaacaaatgaattgattaattacatagtaattaataataataaaatggtgcatgcagagcgtcccttacccaatggctcttcttcttggggctgcagtacaccacagcaacattcgcttgcgccttcatcaacatgactcccatcttcactttcattgtagcactgccttatgggtacgcaattaacaacctaactactccctcgttttagaatatagtaatctagaaccggatgagacatatcctaatactataaatttggacagagtgatattttggaatggagggagtaactacttaggagtagtactaaagaagaagaaatatttgaaagatgggatgtggatttttattcctcaaggagacatcctttcgttgtttgcatgtcatcaaaatagatattaatttttttaaaaaaaattagcaatatagatgacaatttttttaaaaaaattataactatttaggtggcatgcatgaaatcacttcctcggaaagatgtaagctaagctagtactagtgcaggctggagaaagtggacctgaagacaggagctggcatagcaaaagtgggaggcacagtgttaggattcagcggagcgatgatcctcgctctctaccagggtccatcgctcaccaagctaggacctgctgctgctcgatcatcatcgtcatcatcttcttcttctgcaacggcggcagtcgtcggtcatggcagcggcggcggcgcgcacaggtgggcgatcgggtcggtggcgctgctgggcggttcagcttgctggtccctgtggttcatcctgcagtcgaggatcgccaagaagtacccggcgctctactcgggcactgccctgatgttcctgctcagcttccttcagatggctgcagtcgcgttggccgtcgacagaattagcttatccccatggatcttaacaacgaagcttcagatcatcaccgtgctctttgtggtacgtttaattgatatatacaccttaattagttagtagtaattgctacagtaattgtgatcgatatgaatggaggacgagtaggggaagcctatacccgttactttccaacggaatacttgatttactggcgtcaggtagcagacataatatacacatgatatacctagatatcatgctaatgtcagtaacgtaaactgtatagtattcaacattatagcgttttgtagtatgatatgaatataaatgcaggggatagttggatcaggaatagcgttcttggcgatgtcatggtgcgtggagcagagagggcctgtgttcacgacggcgttcacgcccctcatccagatcatcgcagctgctatcaacgtcatcgttctccatgagcaactccatcttggaatgtacgtacgttagttacgctcatcacatcgatcgatcatgtctaattactagtataaattgattggcattaatcatgtgcatatatacatatatgcagtgtgataggatctgctctggtaatcattgggctgtatttcgtactgtggggaaagaataaggaggcctcgtcgtcgtcttctccagcaaaggaggctgtgcctgcgctgcggcaacaatacggcggccatgatcaagaaacgactaatgatgtacaaatgcaaactgtctagtactactacgtactgaaacaataattagtagtagtagctaattagcatgcacaccgcgcacttgatgatcgtggataaagaaaaatgcatcatgaaaaaaggagtaaaaaaaatccggccctgttttttttcccttcctcctatagtatatgcccgagtatgcatatcaggagggaagttggtcaagatgaattgcttttgataatgaaaatcatttcgtcctttactttaaagaaactataactagttattaaaaacatttcatgttaaattaatttgtattataaaatcatagcttaattgaaaacaagaaatttacttagattaccagcctaaagataaagataagcttaatctatagttgacaaaaatatacacaaccgttatttatccccatagcttgcaagttatatatatagttcttgtcttcctcaaataaaaaaacagtacctccgtataacatttataccggtcgaatttcgctgacatagcggctgacgaaaaccacaaagataatgttggagattaaatgagagttgtagatcggtcgttcacccagatcttgtcaccaccctaaccattgaattgattcggttgggacatcgcacaaaggacaccctcctatctattttcatgagcacactgatggaatatcagtgagctcgagcatcattgctggcctgcacgcgggtcggtttgtagtgcaaggtgcacgtgtctatggagccacctaaaagcagtgcttgtaagcaccctgacataccctgacccactcctctcccacaatcgtcatgttcacgtgcactagcacggataggaccgccatctgcaaccacgccaaaacttcaacaaatcaatgaatcgggcattcatgtttcgtaccaaatcttcaacgaaatcaagaaaatagcacagaggcggccacccaggctcgaggcaagaggacagtagctgccgttagcacgtgctcctccttgcgaacatcatcacgttgcgctcctcctgccagtgctggctagcggtggctaggtaagtgagcgctaccccatctctttcctctcttcccctctctcctctaccttcacaccctcctctcttacaggctgacgaggaaagagaacgaagaggccagcagcgatgatggcaggttggcaacaatgacgaggatggccaccgttgttcctccttgtgcgggccacctccttactgagcgtagcgatgctgctcctcttccctcctccacatcgtgctcttcttctcctcatcctgagactaggttaacctgctgtcctccgccgttgctttagaggcctacttctgcatgactcctcgccatcacccctccatttacatgggacgagagagaagagaggaggaatggctaacaagtggcaccgcaatttttttccctagtgactgacatgtggtcccatggttttttttcttgtaaaattgacacgtaggatgaagactatgtcaatgtgtcacgtcaatgaaaactaccatcaatattatcgaggtaatcattttgcacttgttttaatagttggaggtgttgttatacctgattttgcaggtgagggatatgaattagactcaacctatagttgagggaatcaaattggatagtttctttagcaaggagacttaggcccaatataaagaatcccataaagtagcgtggcacagctagcccaacttatggcccaaagtgctatttgtccgcttacacagacaggacagtataccacagcacgaagagcggccggatacagaatgcagtttgatgctcgtgaaatcctccagaactcaggtgaaaaggagattaggagtttagggtactagaatatttgttttgtgtctttaagtaacacgaggtacttaggtaagctgctgttaccgtcccttggcttgtcgtaagctttgtgcagcttgctgaatggccggcacgtacgctgcaatttttgttagcttgtgaactgtaactaatgatatgtccttctttagaagtcaggatcttccgtgttgaagattttttagggtctattcaaattgtaactaaaataaatattgctaaaattttggtaagttagtaatattatcaaaattttaccaaaagattttctatgtatttactaaagtttggcaacaaactaaacgtagagatatttttagcaactatgtcagaaaaaaaatggtatgattaaaaatgacatcaatttgaacagccccttaaaacccattttccttctccgagaaaattactaaaacattccacaacattttgcaaagtaaccaagaaatttgctggttcatgccttcatgtattgccataattatacacttgcactccttaagagcgaaacaaggaaacacgagaacagttttacaggcttaatttagagcaaaaacaacctagcaacaactatgtgccactgacgagtgatgaccaagccctgcaaatctgcaatcagtggtggtttgaagatagctagctagttcgatctgctagcttacttcgggtgcaccttcttcttcatcatcatcagcccagagaatccccggcgttctcccttgctaacctcaggcgccgtcttcttttcggacgatccaccgcccaccgccgtcttctttcctgtcatcgccgccgccgctgcctcgccggcgtttgtttcggccctcatcttctccttgcaggctttcttcaacacgtaggcctgtacgaggtctcctgctaccatggattccatcttcacctctctctttctctctgggcaagctctgtacttcttttctgagaagtgtgtcttactgtaattactagagagagtctcactgccatatgtgtaggtactaatagaagagtcggagtcttggttagctagcaggtaaacggcgtgtaactctcttgctctctcgattttgggttggtgcatgaattccattgcccgttgccatgacacgtacacaacacaggcacgctgagaccgatagggagagccttgacccggcgtgagaactgatgaaaaattaacttcccagcgatacgtcacaagtaaattaactggcatgtttggtagctgttgaagtcaagtactagcttgtactagcaatagattaattagtggggtgtgagtcgacatggatcgaaacaatgcgtatatgaaatgttcaaatcagtgcttccttgtgtacctaactgagccaccatcgacggattgtgatagcagctgccactcttcggaagtaacgctccacaccgatcgatcgcctgccggcgctctccggtcactcactctcgtctcgtccgtgccctcctccttgctccttctacgcaggatttgaaacttgaatttctcttttttttttagataacacaggagataacttgattttctcatgagtcctagccatgcgtttccatcgatcggcgaccagtgacacagtggctctcgacgttgccagtgccggcacgccgccgccgccgccgccgaccatgatcaacacgggtcacagtctcacagacgacagccgcacacatgcatgtacgcgtggtatctcctacgattcgctattttttttccttcctcctgctatgagcatgaggtttgtaaatttaacataactcaagtgattaagtttcttatggggaaatcagttcacctaggtttaagtcttagacttaacaccaatacttgtatttactgcttattattattttttttaagttgagtgtctgcgtttgttgcgtttgtagtgtgtctaaaaaaaagaaaaaaaaacagtacgtgccaaaccccaaatccggcgcaggccaattctgattcaagtgggccgtaaacccacaggccacggactaggagcaaccacttagccacgtccagtccaggccttagtagtcatgggatatctgggccatctcaatatcccaaacgcaccgtgacgtgtcacgtgacaaacgtgtccacaaaacagtactggagtagcttattttgcacggatgatcgctaacaatttcaaacaaaaatttaaaattcactgcagttattactccatccgttttaagttataaaatattctgaatttaatcaaaatcaaactgcttcaagtttgaccaagtttataaatatttctatatttgtctataaactattttttccgtttcacaatgtaagtcattctagcatttttcacattcatattgatactaatgaatctagataggtatatatgtctagattcattagcatcaatatgaatataggaaataatagaatgacttacattgtaaaacggatggagtagttaaatttgaagcagtttaagtttgatcaaagttaaaacattttataagctgagggagtattatttattcgatagaatcatagaacagaacgacgtgtacaaatatgtccatgaatggcgcagcaagcaatcatcgctgcatcaaagctaggcagctatagctcagccactccggtctaatagccggccgggaagccgcctttcctggggtcgctgacggcggtcagaccgccgtggcgctcgacgtcgtccacgacgagctggctgatggtccctccggcgagcggctccaagacgtggcctttcctccgcaggtcggctctcgtcgcggcgtccagctcgaagtggtcgccggtcaccgtcgtccagttctcgtactggaccacgttcgggatcagctgcagccagccagagagggcaaacagccatggcaagaatcaaaccaaagctcatcagaaagaagaatttctacgaagagaagaaaaggcagacgttaagcccagatcacctggtgatacactcttggcgccatgacagaggacaacgggtccatgttcttgacgaaatggttgaggagcacttccatggttccagcagggatcatgctcccaccactagctccaaccgcagccttcagattgccatcctacgacagataaagcacaaaccaatcagaacaaaaaaaaccatcttcagaagactgaacttttcagacatttcaaatgaactttcttcagagttgagagttcgtgttattttccattgcgcgaggtggtggtcaccttgagtattatcgtcggagtcatcgaggagagaggccgtttcagaggcctaacgaaattggcgggggcaggcggcggagagttggccgacgtgttcgccggcatggagaagtcgtccatctcgttgttgagcaaaatgcctgtgctcggagacaggatcagggatccaaagtacgcgttgacagtggtggtcatcgaaacggcgttcctctcgctgtcgacgatggacaggtggcttgttccatggtcctgaaggatgttccacctgtaataatgcagattactaaattagttcaccagtaatagtagtatactagtatatgcaggaatttaataggactttgctgacagttctacttgaaaaggaagacatatttgtgcacaaaagagaagctttacctgccaccatagtgtttagggtcaaatgtcatgttatcatagatggttttcttcaggtcagcagcaaatttaggggacatcatatcagagacgacttcgttaacatttacaaactcagggtcgccaaggttcatccttattgcaaagtaatgcttcaaggactcaattagacgatggatcccaagtgagccagaaaaaccagcagggaggccatactgagtaaggatattcagaacctgtttgttgagcaagggtatcaagataaaatgataatactagtgcagaaaagattaagatttttttaaaggttctattatccgatagagttgattctactaattaaatttgctacctgaaatcaacaaacttaagctaccaaagaacagtgaacaaaatttagtacaaagaaaacttacaagcattagcccagcaccaccagctgaaggaggaggcatgcttaatactgtcagtcccaatacattctctaaaagtggccgacgtatcttaacttggtatttcttcagatcttccattgttatgatccctccaacttcctgaatatccttcgccagctgatcaccaactgcgcctttgtagaacacatccggccctttctccgcgacagccaccagtgttcttgcaagcctaatgttgcggcatacatctccaacattaaggatatctccatttgaggtgtacactccacttattcccttattttggagaattccatctctggttgcctccatctgcttcctcagataaggtgacactctgaatgcacgggcaagctttgctgctggcatcactaacctcttccaaggaagcttgccatggcgcttccatgcctcatacagacctgcaatttcccctggaactgctatggatagagctccccttgctttcagcgtttcgttgccaccatacatatcctgaatgcacaattgacatttctagcgttaactctgtttgtttagaatggagcatgataataccagtaaaagaaaattaattaggacaattctttttactatggatacttgattgcttgtggatataccctcctaattttctgccacttcggttccagtcttctttggatcaaattagagcaacatttttttttattttaaacgattaggttctcctagatatctcttatatttcctaacaaaagttagggtggtgctttgttttctgctttgttttctaagtagtacttcaatactcaaattgacacacttagttcaaggcttggcgagtatataaaacattttttcttctgcttaccattaaaacccatttagattaacttaaaccatgcgaccaacactctcctaaatctttcgaattgtaggccattgaattactttaagattcgtgtcgttctccccaaccctaaccctccctcttcccaatccaccaccatcgcacatgactagaactccaccccacccccttcgttgccatcgccacctagctggaagcccagaaggcttcggtgaggcctccccaaacgatctcctcctcaagccagtagtgatgaggtgtgtcctcatccgccatctttcctgtctctcgtgactccctgccaccgaatctgccaccacctaccactctcctaagcattcactttgctttgccccgtcaccaaagctggcccatcgccttcctccatccccacggcttcggtgccgccgccggtggtgcctcgccaccctcacatgtccaccaccaaccgccaagccgcaggccgctgcctcccatccccataccccttcccacccccatcccaacctaggatccaaccctaacttgtcgcgggtcatcgctgatactggggggatggattctaatagctcgagtggacgtccacccgtttattgcatgtcaactaaatggctacgaaaattttttaaaaaaattggcaagatagatcaatatgtaatatatcactccacaaacatgcaagttaaaattcaacttctacaagttgtaacaaaaacaacaaatttaactgtaaatatacatatagtaatttgagttttgtttgttatttttattacaatctgtagaagttgaattttaacttgcatgtttgtggattgatacattacatattgatctatcttattcatatttttttaatttttttcataaccatttagatgacatgcaataaacgggtggacatccactcgagctgttaaaatagtttccctgatactggggatggattcatcggagctggagaaggatttgggtgcacgaatcttcaagcaaatcaggtggttcaaaatctgtaagaaattccccttgattttccgtcaaatgccatttagcaatttcgttttctaattatgttttctgaaaaatacatggcaatacgtggcatgtgtttgatcagttaacagcttggtgtgtattttctctcactgatcaacgactggcaggcagatttctcgcttctacaatgctgcacatgccctcgcaaaagcaacacgaactgatattgacgtgattgtatcgctgcatgaggcgctatccctaactcggattccatttggctttcccagaattcgggctggaccagccatgaatggtgcgaaatgtagggggcagacggctagtggacgatagcgtgagacacattcaacaggatgagaggcgaaccaagacaaggaccggcatagtagatggcaccactagggcatgtacagacttcacctacaaggatatgtttccagccacatggctcgttatgctcattgttcttcccgtcactccatggcacatccgccactgaagcaacatgactaataaatccccaattatgctagctatcaggggggggggggtgcatctaagtcaattaactcatgcccttttctgtgttttctgtttaatttgttgtgatagaatagaatagaacaggtccagaagcattcgtttttcataaaagagaggaaaagaaaaggaaatcaggaagcaacaagtaccatgtgaatcaaccaactacccactggcttagtggactagtacggatagtggtagcataagcagtaacatttggcatgactaattgttactccatgcattttctacagatcaatcagacgacctggagacctcggccaagtcttgtgctttttaacaaggattggaaaatgactgctctcgagttgattaatttactgataagttgtgacagataaagagaaatatatatccaagtaataagatatcataaaattcttcagttcagtcagcattgctgaaggtttagaaccatttaaatatcgtgttgagtggttagaacatcgtaatcagtcgggaatcatgtgattgaactcattatctagaaaaccatatgtaattgaatagcgtaaacgtaagtgaagtcgccggctttgactacaccggattgtacgctaccgtacgcgagtgattgggaggatcggaatcgcgctgacctgggaggcggcgaggggggcggtctcgcgggagtcgtacgcgagggcggtgccgtcggcgagccggacgagcatgaaggcgccgccgccgaccccgctggacgccgggctgacgacgccgaggcagagcgacgcggcgacggcggcgtccacggcgttaccgccgtcgcggagcgcgtcgcgcccgatcctcgagcaccgcccgtcgtccgccgccacggcgccgtgcggcgaggtcaccacctccctgcgccccgccgccgccgccgccgccgccgcagcagcggctaagaggaggagcaccagccgcgcggtggccgcccatttgtgaaggcgtcgagctggcggtaacagtggtcacagtgagaaacaaaaagaagagcaaaaagcttggcgaattggtatccgttgctcccgcgcgcgcgcgcgcgcgggggctagcgatcgagagtgagagtgagggaaggagaggagaacacggagcatatactaccgttcatgggcgggcggggcgctgccgcgcgggagatggcgggtgccgactgccgagccgagaaaatcgcgtggaatggtggaaggatttgccaagagagctggaagccgcacacactgtcacacagtcaagagtgtcagaccattggacgttgtatagtaaaaaaggcacatttcttttttctccgattagatggaagacctatacaactcgcaaaccacacacaccccccttaagtacgaccactaacacgttgcgaaagagattagaagcaacggcaaatctctacggcactactccatccgtcctattttctagtgcatcaatgttttttcgcgtccaattttaatcgtctgtcttatttaaaaatttttaaaaaacatttaaaaacataagtcacaagtacagtactgttcatgttttatcctctcgtaacaacaaaaaatactaattataaaaaatttttaaataagacacacgattaaagatgaacacgaaaactcatggttacacttaaaattggacagagggagtatatactcaggcgtatgtaatattgtacttaagaatgtactaatattttaccaaatatctaaccgtattgtattttataaagttattttaatactacatatatgagataagttcacttttatatataaatctggacatgtgctatattcagattcatatacgaacgtagacttgttttgagataaagagagtataaattatggcaaactttgctacagaatacctaaaattcgtgcaatttgctgatagacatcgaaaaatgtgtcatgtctaagagacaccttaaaaaactggtgttttgctagaggccatttttggctcaattaaagagataaattcttaagaaagacgagaatgtatataagaccacatgctttaaacatgacgttagagtgaaaatttagaaattatgcaactctaaatttgtcatcatcccaagtacatcactagcatacatcgtatttcatcttcactccagcctcagctcaaaaggttttgactctctagggcattcttgtccttttgaagaatttctcacttcaattgagttgaagctgtccttcagcaaattactagacttgatgtctttcagccatgataatatttttacgatgtatcctagcaaattacacaaaatttaagtgtcctgtagcaaaattagccataaattattgattaaagtaacacctccaagatttaaaaagtcaaacacaatgtattttaccattaattttccttagaaaaaactagcgtagtctagtagtcttagcaaacatcaacactagtttcgtaaaaggatgaattacctctctcaactccaataccaaatattttacaccctctaagctcttacaccgaatgaattacccagcgatgaattcaccgcccggctaggtgggcagttgcctaggctcagcgtgcgatccattgagattcgagtgatttatgtgtgttgatttgctgcttttttggcaaagtgtcagttaatcacctcatctagtaatgtatttcagtggagcaagatgggttcttgattcttgctggtgcgtgcatgcaagttcggtggatatcgtctatttgtgcatgcactttatgccggaaaaattagttatgtgaattaagcagcgtttaagcatcaatgcaggagaccaggcatactaacagtccacttctataataattttttttgtttttttaactgtttaatatgtctggtagcggttcacaaaatgcctagctctgccactggaattacctcaacttagttgagagtggttttttattctacgtgacacacacgtgtcaattcagtcagtaaattacacaagtgccatttcttcttccgctggaattcccttatttattgtttctttatgtatttctctctcaatcaagcggcagaggaacacataggtcccctatcattgagctcgctaaggaatagtgccgttgggatcgtccacctggtccgtcaccttcgagagagaggatgtattgctgagtaaagaactattgtgccgatatggcggcagagagaggagagttgcgacatcaagctaacaacaatctatggcatgggctacaccgagttggaggtggagaacctgtgggaaggaggtcaccgccactggtattatagtttaggggaataaatcagatatttacgatggttaagagtagcaaatcgaacttacctttttttcccctcaacaactcacatggttcacgcttaaagttagttggcaaaattcattcatgacattaaagacgatttttacccttggagaaccttaccgaatttaaatttgaaaaacttgtggctgattttaaacactttgtacaattttaaaagctgtcccaaattgtagaaatcaaaaaaatttacaaaaaaaatcaactatttttttggaaaaaaatgaatgactattatttccaaaatttgggacaagttctgaattttgtaaaatatgtttgaattcagccaaaatgggaagagttgatgggaagagattggacgtatcacatcagatctatgtcatctttcatgaacaaggatagagacaaaaatgactatggccaagtttagttacaaactttttcttcaaacttccaactttttcatcacatcaaaatttttctgcacacacaaacttctaactttttcgtcacatcgtttcaatttcaaccaaacttctaattttagcgtgaactaaacacaccctataagcaacaacaaaaaagaggttgttttgacca

SEQ ID NO: 46526 - DNA, 2025 bp, Oryza sativa
aaaactgtggatacctaaatatattgtacagggcaaaaaataatcaacaacagactgtggatacattaaataaattgtacagcggcaaaacatgatcgacaaattgttgtcatgaaaagataacaacaaattgtggatagactaaataaattgtgctgggcaaaacataattcaaatttggattggggtttgtacagggaaaaaaaagatcaaacaaactgctatcatggaaaggcatcaacaaattatgggtagcctaaatataaatgtacacaggtgaaaaaaataatcccggcttggttcggggtattgaaaccgacgtgaatcgaacacgcaaccttctgatctggagtcagacgcgctaccattgcgccacggatccggcttgacatattacgcaaaagttttataatcaatgaaaacagaacacaggaatccttcatcaactgaaagtttaggaaaaccgcatgatttcgtcctcttcctctattaaactttcttcgctggaaaaacatacttacatatatttcattgggtgaaccgttacatgctatcacaccgagggggtgaaatcttcctgattttgcacctttgggccaacaaagttcagagaactgtatactgttcttccgtcctcctttacatgaaagtgcagatttcaggtctgcaaaaagcagcataataaggattcagcagcacaattgtccagatagcagaggcattcaagcctcccctcggcctttcagtgaaccccattattgaagaggaggcaatgccagaaatgcctgcctcttcattcaaaaactcaccctccatgcatccatgacccaaatctcatgcaaaggatgatgacgatagtacctctgcttctccaaaacgcagtccggatggagtacaaaactccagtctacctatagattgtaccaaagccaaaggcccaaaacatatgacaagatcacacaaagaggtcagatcaggtcatgaaagctaatactcctaggctctgttcttttagaagcaaagaaagtttcagtttcagttcatatcccatattctaaactgaagaagctaatacttctgactgaagaagcaaagcacgaacaatcaatccaattctgatatccatgggcaaaaaccttggagcttcatttattggagtacatctcttaactgcaacaacggatttgcaggcgcgcattgatgagaacggtgacggggcagtctgactagagctacagacttgcagttttgcacatcgtcgaaagcacgaggcagcaaaacttttttgagctcgcgatcagaatttcagttcttcagaaacagtagcagcggcaggtacagtaatgcatctccacgggaacccccacgtcggcctcttctgacgtatagtgcgtagtagctgatctctcgccggtgcggtgctcctctccgaggtgccgcaattataacaacagcgtctccctgcgccgctgcataaataatgcaccgggcgccgcagcggggcttcgccattgctgcccgtcacacgcatcgctacctccttccctcgtcgtcttcttcgtgtccgctctttgggcctcgcgcgcgcgcagccgcgcacgggctgcgtgtggtggatccaccaacgtcgaggatcctgtgagccagcgcgtgcatgccgccgcagtggggtttatttatgatcgcgcgctcgttctcgcacgcacgcggcgagcgctcgcgggtcggcagccggccatatatacgttcgcctcgcgctgagcctctccttgcttgcgtgctcactgtcgctgactgctctctctgcttggcgtgtcgatcgatcttgtgcttgtgctgatcagctagctgctccaacttcgcgttggtgctttagtgacggattcaccggcggcaatgaggaggtttagtgccatggcgctagcgtttgcagtggtcgtgatgagctcgtgcgttgctgatggcgtcaggacgataccaggtaattcaccagagcttcccactggagtacgtactaatctgact

SEQ ID NO: 46527 - DNA, 3819 bp, Oryza sativa
  unsure (1)..(3819): unsure at all n locations
ttgttttggccagttatagttttgcacttttggctgtccttggtagagtacgtaattaacctgggcgtgaacttttgtcgatcattttgttcctttgttggtatggcctaatatttaggccgttctggcgttctctgatgcagaacactaacggtttgtatggctaatcgggaggcagaaaatgccgaaaaaacgggacgctggctgaacaccgtgtcaggcagcagtggatttgtttatgtgtagcggttctggtgatggtctggcactctggcactcgcatgcatgacaccatgagagagcgcacacaggcaacctgcacggctgcatgatcattgatccagcctgcaacctcaatacaccagctcgtccgtatcagccgttgcatatgccatggaccttgtttttttcagataaagagttgagtttgctaccagtatagtttttcaacgaagagtaacaaagtacaggcggacacggtgtgacccgggagaccaaaaaagattgcctaggatgtttagcaccgtcaaaagagagagttgtacgtacaatacagcagagagagaggcatcagttgttcagccattacagacgcagagccgccacaacaatgtgttgcaattccgcccggccatgcatttctaacgacaaccaagtgcagagcctacttgaaaattaccgaggcaccagggagggttacaagtaaaccatttttccctccagatttgccagctatcgatctgtctgtcatatacacaaacaagggcgaggaagccgtcgagcaaaggttggatgctttgtgattttgtctttcgtttcttttacctcgggccggacagctccattgcccggagattgtaggtcgagtcgacgatccagtcgttgtggcggggggccagctccgcctcctgccggaccacctccaccttctgccactcctcccaccgctccgcgaggccatcgccctccagcatcctcaccacctccgacatcttgggccggtccatcggggagccctgcgtgcagagcagagccacctggatgagtgactccacctcatgctccacgaagccgctctggaggtccgggtccaccagcatctccaccttcttctctttcaggagccctttcacctgaaaagacaaaaaccagtttagttacttgcctgtcagtttccaaatgtagtagtacaaaattttgctaagtcatgcgtgcagatggatcatgtctcggtatcagaaatggcgaaaaactagctgccaatttgtcatggcgtgcatctccataattgatgacacatggagactgaactgccagctcgctttatcactgccaacagtccaataatttcaaccatttgttctaattcctggactagaactgagacacagctaagaaagatgtgtcctggaggacaactagcatgcacaaggaaaaacaaaaccaaaacttccatggttgccccaatatataaagatgtggtggtacttacccaatcgagcaacatcacatcatcatcgtttgcaagacgagcaagatcaaatgccctttgtcctgtaatgagctcaagaagcatgattccatagccaaaaacatcagtcttctcagaggacttcccagtagagaggtactcaggagcaatgtgtccgatcgtcccacgaacagctgtggttacatgagtgtccttgtaatccataagtttggccagtccaaagtcacccacgactgcctcaaaatcttcatccaacagaatatttgcagctttgacatcacgatgaatgatcttgggatcacaatggtcgtgcaagtaggacaatcctctggcagatcccagcgcaatccgagttcttgtttgccattcaagcggcggatcatttggctgccgctctacaaaatcatataccacgactcaaaaactgaaataattaatttatgggcgtgcatttttagatgaaggaatatatttattccggactctgcagaaggcatgcactcaaccattcattattacagtcttagtcataaccttaaatgaacaatgtgatatgtcaactgaaacaactaggtatatgctgtgagtagatgaaattaaaaagagtgcttaagtgatttcaataaccataatagctgtgccatttatgtttaagcatgcaaacaaacgtgtaagaaactattaatggatttactctaagaaaaagtaaggaagattaaggcacctcgcaatcgtgatgcgacactcccattagccatgtagggatagacaagtaaccgttctgtaggcgtcatgcaaaatccacggagccgaagcaggttcctatgcaccgccatgctaatcatttcaacttctgtttggaactggagctcaccaccaggggtacgttcttcttttaatcttttcactgctaccaacgagccatctgccagtctacctttgtacacctttccaaagccacctcttcccagaatattcttattgctaaagttatcagtagcaacttgaagctcccggagtgagaatctcttaagttggccaaggtgcacttccggatcctcctcagctgaatttaaaggagaatatagattatttaaatggataacataagtatcatgaactgcagtatgcaactataataccaaccagggacatcaaagaagtgttcttcaggtttacgccgccgccaccatgcaaatccaattgccggaaccgcaaacagcaatgcagcagctgcagcaacacctccagcaattgctccagttttggagtcacctgatggaatagaattaattccacccgaatatgtcaaatcccctgtctgcatcatttatgcatatgcatatcccaagcagtatcacaaatgtaacagaattaaaactatagagaatcaccttgtgacacagtaggtgttgggggattgaaaggaggtggtggagaaaaaggtggagctccagggcagggttttgtagtacccgggccacaaagatctttattattagcaaaactgcgacaatgaaataaccatttgtcagcctcacaagatgtagtaagcactaagaacctaaattctatctagaaaaagcaccttataggggtaaagagtgaaaaggagccagtagacggaacctctcctgagagattgttatttgagagatccctgcataaattattggacattttgttaatatgtatccatcttaaagtctattaccatgtaagcaataatttctacaggtagacaccaaatatgaattagcagaaagggaacttacagaacttgaagagtagtgatattggtcaaggattttggaattgaaccagaaagactgttgttgttaagacgactatccttacaagaagacatgcaaataaagaattatgttatgatcattcaaacaggaaggccttcaatgatatacacaatttataattctattcataataaaaaaaaagtggagtacacttacaggaaacgcagcttgtagagttgccccaaggtttccggaataaaaccagtgaagttgttcaggtaaagatccaaactgaccaagttagttaagtttcccagttcattaggtattgtcccacttatgttgttgctgtaaagctccctgtaattagtcacaacataattaaatttcacaataaaaatgcaagaaagaaggtggcaacacaaccatctttaccacaaggataagccatattccaagagttttgaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46528 - DNA, 20946 bp, Oryza sativa
tgtaggaaaaatcatcatagcaagattctttacattagtttgtattcatgataggtcatagcttgcttctacatttgtttttaaaaatcgttctttatccactctctacactttgatttaacattaagaacaataacttctttttgtatctattgttcatcgtctacacatgtgaaaactgcacttcaaatcatgtgtgcatatttttctatgtgtatatctatttaattggttgtgcgttgggagtcatttattatacggtgatcaagttttttttaatgaatacggtgatcaagttttttcatgacaaatagatggaacctagttctttcccgatagggatggatatcaaatcgccattagtaggtgcaatctcgcaagcacaattgtctaccattgattgccccattggaacaattccaatagtgcgcaacaacaatttggccaacatgatggtacaacgtattggcacactggctaatgatgatttaccaatgctggtaggttttttaataaaattttgaaattatatagtaataaaaggttggttatgatattatagactattgtatggtattgcctcatgaatagttgttgcatatttacgaagtatgatcattttcgactcaatctttgagtgctaacatcaaaattctcaacgagacataatataagatgaaatatgtgcaatgttcccatcttatgagcaattatatataaaaaaatagaaattcagagatcaaatgcaattttaagaaataagtaacttattttaattctgaagctttactttttttttcaataaaaccaaagggagatttgaaatatgtttgttgtatccaattactaatacttatcgggggaaatgtattagtgttggtcctatttgacaacactagaagattgaaatttctgtgtaatatgccattagaattatatatatactttgatttgggaaatctgcccaataacacttgagcatgcacaaattggaaaatgatatccaatgtgaggataactgccaacctagaccccacattgttatccttgcattggatatggcaatggaaattttcaactcgatcagctgatcttcgtagtatttatgttagtctttttatcccaacaaggcatcataatttttgcttgtagggagcaggaattgaatattgggatgagatatatggcatgcaggcatcaataaatgtctatgaaccaagtgtgaagaaagatagcaaagatgttagtgcatcatggatacaaattagtgttgtcccaaaaggtaccaacggaattggtataggtgctgggtcttgtgtatatccaagaagtggtgatagctttgctaggttccatattcgttgggtgagacataaacattttcttcagtaaccatctatgatggaccatataaatttgataacccggatattacaaatataatttgttacagttccttgctgactttggaataaattctaataataggataatgaagaattgaacaagagttgcagtgatcacaattgccctggtttcatgcaagttagtcacagtgttggtcttggaggaagaatcaatcccatatctgtctataatggaccacaatatgtaataaatgttcttatttttaaggtaatattatattcttaatatttgtatgattggtcatataggttccatgtctaagcatgtagtttatgtgcaagtatttttgctatattctttttgttcagctcacaatgatattagttgagctattcatgataagttggaatcttttttctaccatctcatagccaaataatttatgccgatgcatgtaaagagaatttcttgaacttttctattgtaacgccattaagataagataaattaaatggtgcacgccatatgggaagtgggcattttgcttctgaaggatttggcaaagccgcttttattaggaatattcaagttattgaagacaaggataacaagcttgttactccaaacatccgtaatgccaatcctttttctaataatctaaaactatatagctatgatggttatggacttaatgacgatggtatgcatgtatactatggtggcccaggcaagtacatctaaatgatgtgatgtgctttgcaaattgtaataacataagtttatgtgttagaaataatggaattaaagggaacatacaacaacataacaccatgtatgcatgcatgcatgcaccctctatttcctttttaataatcagattcgggctcctatgatagttagactgatgagatattcattgtcccaaaaagaagcaaattaatgttgtgtgttggagggggctggagttttgagcggaggctcctttgaccagccagtcagtagctagctcccatatccaaggactaacaagtgggcttgccggagcaaagcttggaccatttgagtagttggtggtgtccgatcgaggtggcatagagtggtgtcggcctaccagtgaggtcccacgggtggcgtgacgcacgcgctcctcttgcgtccactgcaactacccacggtcacatgcactacttaggccaccagcccatgaggcccacatgatgcatgcccactgcctacgcgacaagtacaagtttgtttcgtttggcccacactaggatccaacctaacctcattgcggagcaaaaaaagtgacagtgacatggtgtagaatagttcacctgaggcatggcccacatggtagccattcgctcactgttttttttaatttttggaagcaaccaatcatgagttttttaatttttaagaagcaagtgagcttcattcattctttcgaaactcgttatttccctaaacgcattctagcgggacctcgagatatattgcgtgccacggatatgttcttacgcacatttcaacctttgaagcaccaataaatagttgtattgcaacagatttgatgatttacaactctttagataaattagataatttgccatcctagcccactcatcattggcacgaagagtcccatgtatcattctcacagggtggcagttggcaatacaaagagtgacaaatcatcaaatttgcattgtactacaaggtagtaccttatgtggattgctaatttgcactcacatgcaagatgacgaggtcgtgaatggtttcaactcagcagtaactttcacacgattcgcgtgtcctgacttgaagtatctaggttagagtcatactccgaatctcaacacttgtgcccatttccttttccaacacggggtgttttcctttccctatttctatacaagaggctagagcaagctgtgggagttaatcaaattctcaaacttcaatctagaatttctaaaactttctacttgcgttgttgaaactttcaaattgaacaacaacactttacgattcaaatatgagatcttctacttgtatcccgaaacttctagttcgaaacacaaactttcaattgaaagtctaaaacttccaactaaaatctctttttttatataccaaaatccctaaacattcaaatcaaaagtggaaacttccaattaaaacattctcaaaaattttataccagaatccctaaacttttgaatcaaagtctgaaacttccaactaaaatctcaaaaactttcaaccaatatttttccaactttgaaaatttcaagtaaaatattcagaactttttaagacactttattttttttttgttttggtttgtaagaaactttcgttctttctaatatattaattgtggggacctgcagtggtttaagtcaaaaaaaaattcaaatctttctacgcatgacttcaaactttctactcgaattcatggaagtttctaccgataacctgcctccaaatctgatgaagacatgggacctcatcggcgtcactaggatcaagtgtggggatcactagcgaggaggaggccgaggtatcaaaggatagccattaagatatcccactataggagatatgagtcatatcaacgttagtgagagagcacatatgtcatatgtggatgtagttttcactagttcctttgctagagaatgctcgctaattagcattgctgctacattatatatgtcactttagaaacatgaaattaacaaaataaatcatactagtatatggaaaaggatttactgcatcacaatgacaatcagcatgctttaaatattttgaagaaacattaaaacattaaattaatgtccacccgatgtaatctagtattattatcatatatcatgtaattaatatttcttacattaaatattttaaagttcttccaaaaattagtgtaaatgcaataagatgatgtaagtaggctataggaaatgctacaccatatttgtgatgagttggaggatagaggagagtagagagaagttaagtggactataaatcagtagccaactacaacacgggctccaacaaattttgtgaggggattaggcaagccatgtattgatgcttaatggtgttagcatatatctatagctaactattgcatgggtatatcgctagattagctatagatgatgcatcaattgttataggtagcagttggctatactattaaatttgttcttactacaataaatttacatcgtacggttgtctagtataccaaatcttgtgcatttaatgccacatttatcatttatgcctttcctatattatttttcccacaatgcattaaaaagaggattacaaaatctgtaaagatatcttcaattaatagtgtaaataatcttgaagattacttcattattgtggcatgtccttacaccctcaatattaattgcaaattcattgaattctcattcagcaatgaataaatgtttcattggccttgtgaagataaattgtttcctcaagctataaaatggtccatttgcatacagaacagatgacctcttgagactcaacaatggaagaaaatctagctatcagtattgtaactctatgcctgacatatcttgttctagtaggaggagtgaagatacatattgatcgagatgggataattggttcaaccatacctagtaaagatctaaacatgacaattcaggtatgtgattaataaatccttctcttctgtatttgcattgcatttggtggctaacaaggaactaattgttcaaaagacaggagatggtgatgtttacgattgtgttgacatatacaaacaacctgctatgaaccatccattattgaaaaaccatataatccaggtagagtattacttttcgtatagaagaatatgcttttgagcatgttacataaatattatgcttgattaagttttgtgttttgtatgaatagaacagcagtttcaagatccaagtttaatttatttaggatccattagtagattatataagatatcatcatgatactttaatatgaaatattgggaaagccatcaactgagggattcccgtatttattccctttaccgtccaatataaagataagtgtattttttggtatttgttttcgatctttgattaggattcatttttgttgttacgcagatggaaccaagctcttatccattagatcttgatatacaatctattctgtcatccaatatctcagaatcaaatttccccgacatcaagtgcccaaccggaacaattccgatactgcgtcacaatagctcagaagcacatatgcctaatggtggttcacaagaagaggtataccctttaacatttttttagttatcttattgtcaattatagattgtatataaaaatagtttatcttcattaaattcttttctattctaatgtggcatgcaaagctatttgacttaccttcaatattattctttcacttgtagtatgcaggtatcaaatactgggacgataatagtttctatggaacacacgctaccctaagtgttaaccagccgttttgaacacgaaataatggggaccacattgcatcatttgtacaacttaataatggacccgaagagatagctgcaggttccattgtaagtatatagtcccattgcataccgtgctattattttcaacacttgaaattatcacggttccattatattgtgattaatcatgagttatatcattgtttatttatatcatgattaagcataaattcttttgtctaagaatttctgcttaatcatatgtattccctctagcttagttattagtaataattttgtcacatctatagtattgcaaacttaaacaataattatgcattcatgtactatataattgttggttttcatcatcatatttttcaggtatggccaagttttagtggggacaactttgtcaggtttcacattcgttgggtaatacacacatacttttctatatgttttccttacttgacgtggctataaaaacgaatattagtaatagctctacagccaccaccacaaaatccatccaacttacatccttggcattacttttggcgataggtagacagttcaaataagccatgctatgattttaattgtcctggttttgtgcaagttagccaacttgctggtattggagggaaaataacaccggtttctatctacaatgggcctcagtatataattaccgtcatgctgtttcaggtattttccttgtggttaataattctacatgattatttacttttgtgactacatagtgtgattttacaaaaggcaataaacgagagtggattttaaactctcaaggggacgtcccctcgttatttgtatatcactcaaatagttatgaaaaacattgaaaatttttgagaaaatgtattaacatatgatatatcactttacaaacatgtaagttaaaatttaacttatataagtcaattaaactacaactagttaacgtatattctagttaaatttgtttttctgctgcaatatgtagaagttaaatttgatcttacatgtttgtgtagtgatctatcacatattaaactatcttgttgaatttttctataaccatttgagtgacatgcaaacaactaggggacaacccttcaagagtttagaatagtttcttgtaataaaccggtctaagggtactcatataaattttttttcttttgttaattatataattaggaccgaaagactaaagattggtggctagcacgcctagacaagagcagtgccattggatatcgaccacttggatattggccgagtaagctctttgacaccctacaagagaaggctacatatgcattttggggtggatgggttcgtggaccaactgtttcattagatcctccaccaatggggagcggccatttcgccaaagaggggtataggaaagccgcacttgtgaagggtatcaggatagccaacaaggacaacaactttgtcaatccaaacgttggtaaggccactacagtgaccactaggggattgtgctacactgttgatggttttggtgttctcaagatgggtatgcatgtgttcttcggtggaccgggccaatgtcccaattgagagaatagttgttgctttgtaatgtagaatattaattagatatagttaatctctaataataatgatgttgatgcaaatgtttttctttctagagatataaaaggagttctattgatatcaagataattacatcaaagtgatacaggagtcataaaagcggtggtggacagtcccagactgacttgtggtggggactaccaccattaatgcatggaatgcgttgccaaaatgcaaatgggctatcggcccaacatactccattgtaagcttctggtctggtgggcctactcctcgattcgtttgcgttgcgtcgcgtcttcctcctctcccgtcttcttagcttgtagcttgcggttggcaatcaatcgatcccctctctcatccgctccgctcacaatctctcttctccctctcggcgcacacccagattcccgccgactccggcgcccctctcgccgccggctgcccccttccttcattctctcctcctcctacgtacgtaagtattgattactcccccatcccccatcatacgatttctagggtttcatgtatcgaggatgaatcgttcatgcgatttaattctcttccctattactatattataatcttactagcaaaatgcccgtgcgttccacagggtaatgatatggttaatgaaatttgatttgaactatttatatgaaaaaaatgaattgtaatttaatgaaatataaaattttctgagcaaaagtggtattgcgttgcaacgaaaagaaaaaaacagataaaattgaattaaaacatattaaattataattaaatgaaatacaaattttctgaaatatttgggtattttttaagtaggtaggtatataattaaattaatttataagtaaagtaagtgtaagaaataaaatgttatggttggatttaacttttattaaattttctatattaattacactcattgaaattttcttggaatttacatagcttaattgctaattttgataatacaaatatcatttcagaatttattgaaataaaaatctaaataaaaatcctttttttctctatgggcctttttcagcccattttcttcttcagcctgcaagagaccaaagtctacttaatacccccatactcctcctctcacttagtggaccgccggcccacgtgcagcccaagtggtgcggcccaaacccacgatcgatctcagccgttcgttttgatagacggctcagataagtttaaaattgatgaaaaccctaaccctaaccctccccctcaccctccccccagccgagccagccgcctcctcctcccccgcccctgacgccgcctcttcctcccctacccctgacgcagcctctccccctccccctctccctctccccaccggcgcctcttcccctccccccagccggccgactctcccgccactagcgtcgtctctcccaccaccggcgctgtccctcccttctcgccggcacggcgcgacgacggcagggtgcggcggggtgtggcggtggcgccaccttcccccacggcgagcggcggcggcggcaacgctgcccttcccccacggcgagcggtggcggcgccctccccccgcgagcggcggcggcgacgcctcccccgtatcgagcagcggcagcagcggcggtgcgccctcccccccaacgagcggcggcggtggcggcaccctccccccagcgcgacgccctcccatcccccccactctctccacttttcccctttcactgtgtgtggcagcggcgggagagccggcgacgccctcccctccgctagatcgaggggaggggaggggcggcggcggtggtcccggcggagcgggaggggtggcagcccggacggcgtggaggcgggcgtcgacggccgcagattttttttttgcaatttttttccatggctattgctaaccgaatcagattgggtatggacgaaaaacggacgaaaatttagatgtgacgaccggaaaaatacgaatatttatattagttactagcaaaatgcccgtgtgttgcaccgggtaatgtcgcattggataaagtttaattgaaggatttttttaatcacaaaggttttctttttgtttggacaattattccacatgtatgtgtatgatatcaactacattcctaacgtgttagcgtaatgattgtatcatgggaggaacaaatggtgaattctttaggtcactttcacgcaagagtagatggacaaaaatttgtatgattaaaaaatttgtatttaaaacaggtaagtttattataaaactaatgaaaaccacgatcgatcaaaaatacttttgcatatttacacatagtctcgtagtggtgacatgtggatgatatatagcgcgcatactttaatatgtcgtgtttcatggaaatttttatctcaaacaaatattaaagtaaaagtttcgatgattatgatgtcaaaaattaaaaaataattaaaaatatcactcgtctgtaaagtatgtacgtgtaccttaacaattatttttctactataattgtattttttaaaaaagtatcggttgcctggtcagataggcttatctctctcgctatacattacgattgaaaacgttaatgaaaattctaatattgggattgctatatactataatttaaaagttaataaaaaaattttcttggttttggaccgaaagcccattccttccttcctattaggccctaggctagtatgctaactccctcaactcaacctgcctcccttcagcccagtccccaagtggagccacaggccttgctcccacagtcgactccgtcttcaacgtccgaagagagtctcgtgcccatacgatgccagagcagatcttccccacaaatctggccgaatctttcctgatctcccaaaattagatgagggctttcaatccactcgatctactctttccgtttttctcaaatcaaaacgtaaaattcacgataaaaaagaccaggaaggtcactgatgatgaaggagtggggcatcaatttttgcaatcaattggaggaggaaacgcacgatcgacatggcggcggggttgtgctaggattcagccccggcagcgttgggaaaaaaaccaactgaccaaaataaaccagaagctttgcatttttttattaggtatatatagatatagatatatattttctaagtaattgatcataattttccaacaattttaaatggctcaaaataatgccaaagaaaattatgtacatgactaaccggcctaaaaaattggccggcccgtttagcgcaagcgcacgagttgatcgcgcatcgagttggccatttatcggcaacggcccatcgcggggtgaactgagcacggcccagttgtcatccgcggcccaaagactacgtggcccaacagcggtggcggcctgacccagggctgatctgagccatcagatctgatggatggctcggatcggtcccgcgccgatgaaatcgccggccagagggggcagggtccgaaaaccttgatctccgataaaatcccctttctctcctactctccccgatccaacctccagcgacgcaagagagtggacggcggtgatccagtctttcttcgtctgtctccctcctccatccgagttgtcgttgaccatatcgaacaccggcttaagccgtctttgctacttgcgtggatccgccgccgccgcctggatcctgtcgtctctccgcctcactctcgcacggatccaccgtcaacggcgacgggaggggcgggtccggcgacctctcgatgatggccccgcaatagctacggtcgccgaggcgcgcgagcggcagatccggcgtcaggaaaggctcgagggcgtagaggcggctgagttctggtgaaagttgaaagattttagattttgagttgaaagttttcaattttaacttgaaagcttcaaaaatttgggttgaaagtttgaaaatcctaatcgaaagttttaaattttgtgttaattttttgaaaaccaacctgattcccacagctcacagccatccaaccttatccacactaccgcccctcctcctcctccacccacccagcgccgccgcacgcctccacagcgccgccccactcccacccaccccagcgtcgccccacccccagcgccgccgcacgcccacctcccctacctctgccggcccgcatccgcctgctgccaccggcccccttcacgtggccgtgcctcctcggtctcgtcgtctccgccttcctcctccctctccctctccctctcggcatctcccgaggcagcagcggcgcaggggcgggtcaacggctcccagcgcagaggctgctcagtggctccctggcgcagcggctgcccggcggcgccgcggctcgggattcggctccgagctcgggacctccacagcggcgaggataaggtccggcgacctctcctctcatctcctacgtgatgtgattttattttgtgatttccacctcttctctcatcttatgtgtgatttattttgtgatttgcaatttccgattggattgtctcatgtgctggatttattttgggatgatatagatttagttatagatagatatagatagagattgatagataaattgttcttacaaaataaaccaaccccaatttttttcccaacctctatctaataatcaagcttctgcttagctccctactttaacaatctctctcattcttctcaattcaattcaattctactactgcatctagtctcatgctttcactcaactgcttgccaccaatcttttatgcaggtaaataataatccacctaagaccaaccgattatgagctctctatgcccgtttgccaaactcgcctctgctggcgccacatgccccgtaaaatcagacaacaaaaccacctcatgtcctgtcacagccaacaatcacaccgacgacgacgataatgaaaaaactggcaatgctaacaccgatcctcgtgtggtgccagcaaagtgcccctttggctatgactccaacaacaccttcaagcttggcccactcagctgcgtggtctgccacgctctgctacatcaaagcagcaaatgcaccccgtgctcgcacaagttctgcaagtgcgtatcatatttcaatagctttctaattcgttctgtcaatatatgtaccttctcacttgatctccttgtctttctccaaaacactggatttccttctcagggcatgcatattgcgctttaaggactgtccattgtgtggtgctgacatccaagggatcgagcctgatgatgagcttcaaggccttgtcgaccgcttcattgatggccatgcccgaatcaagagatcacatgctgcaggcgatggtgaagccgcaagtgacaagaccaaggtcatttacgagcatgtctccatggagagaggagcttttctggtccagcaagcgatgagggtcagttaccaaatcaactcccataagcttcttactctgagcttcttttacctttgaaatttgcatatatccttcatcctctggtctgtattaatttattaatgctctatatattttaacaatacctctgacttttacatatccaggcttttcgcgcacagaacattgaaagtgcaaagtcaaggctcagtatgtgtgcagaagacatcagggaagagttgaaatctaaagaagacaaccaagaactgtgttctcaacttggagctgtgttaggaatgcttggggactgctggtacggcaattttctcttggggacttgaggatatgtgaacctgctattgatacgtttattgcctactccctccgtgtctaaataattgacacgtttgactttcccatttaaactttgaccattatttgctcttaagttgttagacctaatggaacaaaagtttgattcttaatatttaggacataacacactttaataacatggcatcatttcttgtgtttgtaaatatataacaaaaagacgagtggtcaaagttcaaaagtgaatcgtgcctgctatcagtcatttaaaaacgaagggagtattgagctaaattcttgcatgttttttttccttctaattgagagaacagttcttaactttgaaatgtctgtagctttcctcaaaagaagagagatgctcaatgctcaatgatttgtatctgttgtgcacaagggcccattctagccttggcccgttcatctttctgctcattcagaacctagttatctttcatgtgttctaatacctgaattttctatgtttcgaccaggcatagaacttgccttccaaacaagggaaaggagaatcttgttgtaataacgtttgttatccattaaaatattaaactgttatgtgcctcagtgtgttctacaatactgatgcacagaccacagaggttgtctagcaggttgtgggctgatagtgatgccaattatgactggtcgcaatttgtctgaatagtatattcacagctcggaaaacgtgggaaacctttaaccatgccctacaccagccagcatactgatgccaatagcaagctgatagcttgtgtaatagccaactaccagctaccaagagcctagttctagtcaggatgtctggtaccttctcatataaaagccttagggtctgtcataagttgttgctgaactcattgtgtttccatgtcactggagggtgttttgttttcatccctctgttataatatctggctgaactttttccatgaatttcattgtgctctattatttttcattatatttgtgacacataatcatggcagtatttaacttattttttctttgtttgttcataattgacctcattccatgccacagtcggaccttgggagatgctccttcagcaatcacttactatgaagaaagtgctgaattcctctcgaaattgcccaaaaaggatctggaggttgtgttttgttgttaatatgatcataatagcatgatagtaagttctcatgttaatttaacttttgcattcatctacagttggtccatactctctcagtttcactaaataaaattggagatctttgctattatgatggggacctccactcagcaagaagctattatgcgcgttcgttggacgttcgcagaagtgcagtaaaagaacactcagctgtggcttcccaggtgattactgtattactgattaagattagctataaatacaaaatgggctgctgttatcatcttagaaacagaaggaaccttattcatcactctcttttgtccctgctcttttgtgctagctcttctatatcattacactagtagagtaccatatgtccatgaaaatgatatcaacagatattgatcaaaagttcttccttatcttagatttttattatccagacataattagaaatgttaagtgtttaaatgtgtattagataccatatcaatgagtgctccaattacacatggaccagtagctattttatcccataattcatggtcctggtactgatggacattgcacataatacatagtaggcagaaaaaaatggatgtaaaaaaaggggttcctacacagaatttttgtattcctttctctgaagcaaattgttgtctgaagtctggtagcaagtgccagaccatactaggaagtttggcaatttgccataaatgatggctaacagatcttttaacctatatttatgcttgttcccaattcaaccatgccaataaaattgtcaataccattgagatgatggctttatttcattacttggtctgtggccaaaaaattggcactgacaaaattttggtaacgaaaaccaattaaagcgcgtacacaaaaaaaatattggcaacaaatcaaatgagcaactttacagaaatttgtacagcacaaattggttgcagaccaaacaagccctttatcttatctaaatttaatgtcaggagatgaaccaacagaagatcacaaatcattttgtaagattgtggtaggatttagctgctacatggaacagacatattcttgagtgtttttcctttagctgccgctatttcatgatctgtctacttttggatataggtcattgatgtagcaacttctcttgccaaagttgcggatgtcgatagaaatcttgggaacgaaagcatggcagttgagggttttgaggaagcaattaaatgccttgagaatttgaagctggaatctggagaggccagtcttgagcagcgggtagctactacttatccttgtgtactgcctttcatccatgcgctcctatttgtggtgctcttgactgacttttatcatgtactgtgctacttttgcagcgtctctcggttctcgactttctacaaaaacaactggatgacaagtgatatgcacggttctttgaagagcacactcacaggatatatgtactatccataacgaggatcagctccagtagtctctgtgatgcatatggaagggagttgctccagaatgaatggtaactggtgtgtatttgaggtttgctgcgacacagaataaatactttcaagttgtatatgtttcttgtgtctgccacgggcggagacctctttgagtcaagatggccacctcttaagccctgaggcaccacggagacgaaacttctcggaagtactggttccttgttgcctctgccgtgttatgtgaatgttatcccactgtatatttattgatgatataatataagaaaagaacagcacagatgttttgtatcgccctatcaaattaagttgttttgcatattctagcggcaattgagataatctggatgaggaatctcaaaagtcaaaaagaaatcaggtttctttgctcttaccttgtgagagacggatctttgacaagaaggcaagcaagtcttgcttggcaaagtccgcaactgatgcaaatttgacttgtgcagaatacagctagtttattatgtttctacaggaatttagccacataattttggaaacgttgcatggtctgcaggttttgcatagccgatggtggtgtagttcaattcattttattttattttattgaattttgtgatatgatatatcaaagtgatgagccaagagaggcctgatttgctggcccaggtagagtaggaataattcgatttacgcgcggcgatggtgattgaaccgaaccgaaccgaacagtataaattagtaagagattgtgcgtcattccatgcatcttaatttagtcacgtttggaggtcgaatgaaaggccgaaacacaatcatcttggaatcaatccgtagactagataggtaaaaaacaccttaccatctgctccaaatgttgataggctgcagcaaccgaatcctgtgaatctgtgatcccagttagtttatgcaatcaatgttttctggttggaatttgttcttctagtctagttgcagcatgatcaccagagtacaaaacggatcactgcgaggcgagatgatcgatcttgatcttgttcttgtttgatctcatctcatggcggattaattcttgctatctgaggcgggagtcgtccttgtggcgggtgacgagcttggcggtgttgcgccaccagcaaacctcgcgctccttctcctgcagcctcttcctggcgcgctccagcgccgtctccagctccgcgatccgctcctcgtgccgccactggagcagctcgtgcagcctcctctccagctccctcgccgacacgccgccctgcgccgccgccccgctctcctcctcctcctcctcctcgtcgtcagcaccgtccgtgtcatcgtcggcgtcggcgaaggtggccgcgtgggtgtccgtggactcctcctcgtcgtcgccgatctgcgaagatggattggaggaaataaatgttagaaaatggcggcgaaattgatccgaatcggtgggcttctagctgttcgacctcgagttgacgatcccgacgaggagtcgcgcattgcaggagcgtcagctccgcctcgagctccgcttccatctggtccattggaacggcggcgtggtgccctgcgtttcccggggcggcggccgtgcgtgagcagcgggataatgcgccgccggagaaggcggtgggctcctccttggtgatgtcggcgtgatcgtcggacgcgttggggtggttgctgctccgcgcctcctcctcccccttggtgtcgagcaccagccgctccatctgggcgcggagctccgccatcctgttcagctccgccgcgctcttggagagcagcagcatgaggctcgcgcccagccccaggctcgccggcgacacctcctccgccgccttcttccctgcacacgacggacaaccaaatcaatcgaaccagaccacgccatccgatcactcgctctcgccatggacacgtaccgagcgagctccgaggcgactcgcgatcaaccgcttggcggcccaccaccttcggcgccgcagcctccgcctcaacctcaacctccacgtactcggcggcggcgtcctccttggcggccgcgccgctggagcagtatcgggggaggcgaaggcgacacccgaagccgccgccgccgccactcctatggaggatgcgcgacagcagcgaccgcggcgaggggatctcgcgtgcgggagcggcagccaccgaggccttcgagaggagcgcaccgacggtggagggcgacgccgccgccgacgacgaggccgagacgcgcggcgccgcgtttctctccatcgccatgggcgtcgcgagctcgatcgcgagggggaattacgatttacgaggaatattgcaaaggttttggaggtttttgcgcctgaattcgatgggggcgtatcgtgtcggcgtgcgtaatttataaggcggggatttcgagccggactggtcgcctctggaattcaaaatttggagaaattttgtggcccagtttcgtgattcgtttcatttgggtttggatggtaggtttccattaactcgttaagcgcgtgcacggtgcacctcgtctcatttacaacccccagctaacctcctcgtcatcgtgaatgaagttctcgtcgaatttccaattccgttggctcgatcagttcatatgaatatcactgctttatgtgctgcattttggtttaggctgtgtttagattaggggtgtaaagttttgacgtgtcacatcggatatacggatacacatttaaagtattaaacgtagtctaataacaaaacaaattacagaatccgcatataaaccgcgagacaaatttattaagcctaattaatccgtcattagcaaatgtttactgtagcaccacattatcaaatcatagcgcaattaggtttaaaagattcgtctcacaatttacacgcaatctgtataattagttatttttttcgtttatatttaatactatatattcgatgtgacggggtataaaattttagcaggggatctaaatagacccttaatttgcagctagcataggttaacaatagatgcatgcggcattcagatatttggagtatgtatatctggaattctgaatgtcaagcttattttaactttgctggtttgatatgcattgaatcagacttgtacatctttctgaagatcgatgaccaaactgatgcggtagatgcagcctcgcatggataatggattgcctgcaagagatcgccggcgtttggtagttgggtgcgcgcgttgggtccggtccggtcggtcgcgccagtaaaaccgtcatcacagcgaacgcgtgagccaccttaactcggtgcgcctcaccctcttcaccgcaataaattggatcgcaaattattcttccaatcattttcgggctaactattacacgtacgtaatattgggcattttgggtgcgagtcccgcgttttcaggggaagtccggaaattggcaatcaacaccgttcgctcacgatctgacggtcgtgatggcgtgcttactgagcctcacaatggctacacagaccggtttggcaaagtttgcagtttttactgaattttgttgatgcagaatacaagtcacagatcagaaatcacgacttttaattgctcggttattgtgcgaatggaccgggatgaataacacgtgtgaatgcattgacgtaaaaaaaaattggcatgataagctcgacagaaatgggacaacaaacaagagtccgcttcgttcctcggctaatcaatcagacaaatgactgagccatgaggcctaaatcttactctctgatgacactacacataactgaaaaaaaaaacatggggaggataatagttctactagagaagtagttactgttccaaaactgaaggatacaacaacaggttgctgctccagtatatcaattatatcctgagaggctggttcccagatttggtctggtcagactgtagtctcatcctctgccgtgatctgatgttggccgtctcctggaaagggttcggcccactgaagccatgctttggtttcctgatcttctttctcttgccgcgatcatactcctcgtccctgacacaacgattaggtgcatcttgttaaggatcatgtttatcttccgaataagacagtttcaaggataacaaacaggcaagaggaaaaccgagatatatacaaaaaaagaagagggctttatattcatctcagatcttagtcacagcaaagaagaatctgctgctggttgcatattctagtaggattctaaaattagttcaagtcggacctaggaaccagtgttatgttcctgccagttgttcgtatattactcagaagtttagcaaagatttggtatgggtggaggattttccgaatttcagcatcaagagaattgagacatccaacatcaccatcagaaagaaatttaactgcagttaacaggcttaccattcatctagcacatagccgatgcttctagtccttggatgtagtatctctgtttccttcgtatttttaatctcagtgtcatcccaacgtggcactgcaaaaacaaaacaatgagttataaatttctagtgttgacagcaggatggaaaatgagaaatttcttgcgaagagatgttaaccagtaatttctcttaaaccccttgtgaggagattaaaatgccaggggcctctctcatttgcatttacattgtttcttgaatcagtctggttcaccagagagtttgtacatgagcttggtagctcggcgctagcaagttttgcatcgttgctgtcagcgctagcaagttttgtatcgttgttgtccatgggaacactgttggtggttccttcgatatgctgtttcttgttgaacagctgagtgccatcctcagaacttgcactggcacaagaacgtttctgtccacgggatttatgtgatatgatctttgagaaaacagtttctgatgttgatgtctgctgatcagtgatgatgctttcaatgtgcacagaaagtgcatggtgttttttggatctcttgtgtttccttt

SEQ ID NO: 46529 - DNA, 10056 bp, Oryza sativa
  unsure (1)..(10056): unsure at all n locations
aaagatccctcaccataacttgttcgccgtaattctttacaaactctgatgactcgttagcttcagtattgccagttaaatcatcactactagatactgttccattagaaacagcagcatgctgccatattgtgatgtgagcagcagaattaacattaataatgtgtttaaaaattaaaaagagagagagatcaataggaaacatcatacagttacctcagttgggatgatttgtgcaatagacactgtatcacttatggtaggagttggcttgcaaaatggatctgctggcccagaaacctgaccatatttctccaatattacaccagtgccattccatacaggaaaggcagcagggattggacctgttcgatgttcagaatcctggccatttgcccccaacaatccttcaccggcactgtgtataggaaaggcagcagggcaaggatctgtgtgaggttcagaagcctgaccatttgcccccaacaatccttcaccgccactgtgtataggaaaggcagcagggcaaggatctgtgtgaagttcagaagcctgaccatttgcccccaacagtccttcaccgccactgtgtataggaaaggcagcagggcaagaatctgtgtgaggttcagaagcctggccatttggccccaataatccttgaccaccatcgtgtataggaagagcagcagggcatggacctgtgtgaggttcagaagactggccacttgcccccaacaatccttcgccaccattatgtataggaaaggcagaagagcaaggacctgagtgagcttcagatgcctggccatttgcccccagcaatccttcaccaccattgtgtataggaagagcagcagggcatggacctatgtgaggttcagaagactggccatttctccccaacaaaccatccccaacaccatatgtgcacaaggcagcaggggcatctttcctggaatcagtaagtgcatcatcagtttctagttgatgctcctgtagctgcttctcatacaacttctgattgaaacttgcattgtgaagaacagaaacatcagcttgtgctggagatgttatttcccttcgattgtctggagctgtttgctctgttttcatgggcaagttaacagcagctgtatctggacgtatgcaagaagctttctgtgttgaagctgggtcattgtttggggatgctgcagcttcaagcacttcagtgttgctatgactttttgaacactggtcctgtggagcattgctaatattgctagattgaccattttctgagttctgtttcttcaagttcacatcttctttgacaagtgagggaactctcagtgttttcgtttccactgtatcttttttaattgaaccattcatacatgtgatcttctcggagatcattttatttactgataaattaacagtacaattatcactgtacatcactgagctccttgttctgtcgcgcacataaaatagcatgtatgctttctgcctcagcacatctgcctcacgaacttggtaaacctgggtgtattaatgtatatcaacaaaacaaacttcaaaataaaaaaaaagagaggaagaaactgaataaagaatgccaggagtgcagatgagaaagtactgaattaacataagatcagctcaactacaacttggtgtaccaatcccaccaacagaaaatgaacacataaacaggccaaagaaaaggattaccctccatccctcaaagtgaacacattccccatatcctcccttaagttgactgtagaccactacataatatagtgcacgaagaaggtgcctgacaaaacaagttctctagcattcataaagtactagtactattttaagaagacatattacaaggtgaactcttgtgagcagagagtgagggacataagtatagactatagagttggtcgacttcaccattgaatgtttttggatataacatggtgtattttggctggtatttgttattacacaggacaagacatggttgatggaggcaaaagaaaaaaaagagtaactttaaaaaagcaatatggcacaatacaaggatgtgacttgcattaatgtaaaaaagggttgtgtcaatgataaacagtaagaataaattcatcacaacataaaaaagaataaccttgttatcatcaagattgtgccatatgccactagaagtccgaacaaagcaataatagtgacctgactgtgtattccaaccagcatgaaccaaaacaccataaaggctgtatttgaactccataccctacacacataaactaaggactatgagcatgaaagagaatcttattaaaaacatgtccaaacttatgttaaaaaaaaaagaacaccattaaaaattacatacctcaggattgctgacatatggctttaaatttaaagttggttgaaactgcacttttttgtcgatcttgtgacgagggttgaaaggactaaagcgctttagatgaattgtcaacacagagggagccttctcaatcataaacctcttcttggctactactttctgcctgcagtgctcgcagttgtactgcttttccccaccatccagtagctcttccgcagtaaagtgttgaagtgcttttaccagagtagcagcattggcaatttcaaggctgagatccaggaaaggatcaaatttgttggaacagtgtgagcaagttgtgcatctcacctgtcatgcatatagatatagtcagccagtggccatatgggtaaagttttacttgctattatactagtaataagttaattaagcatttggcaatttacctgacttcttaagagaccaccaaatattctgtgaactaggctcttctcataagcacttggcgacccacttggtacaccagaaggtaaacaacatttgtgcatggactcaagcaagctaaccattagctcatgtgcgtcttcctgccttgagatgcggaaactacgagaaatgcctaccttgcagttaaagattgcacaagggttgaataaaattatagatagatacggtatttcaaaataaagtggatcaattattttgcaatagcatatgaaaggatacatcttaaatttctgacaatgtgcacaggtctcaatatcttcccagttgactgtagagcagaatttacatgtctttgaagagcacataaagcacagaatccgatagtccgaccttaaaaaataataaagtgatattataagtaactacagaaacagggcttgccaagaaaacagaaaatgttattatattgttctctggagaaatgatacagccgcaaaaaacagaggttgctccagaacaggtgatgagacatagtacattggtcaaggcatgtaaactaaaatttatatctgtttcgttcaatccaaatagataagaagcagctctagctctagatgcctcgagactgattatagagagaggaaatatatttgataaccaccaccatagaacatccgataagaaaatgcagagtgctcacagacagcaacaaaggatggttcactactctcgactttcattgacaacatcatcatatcatgcagagtatctgaattgctgatcgcgaccagacgcaatgaacttacatgaggacatgtgctccccactctgcaagtaggccacgaacggctcggtatacgtcaagcattgcagaaccgagttgaggtagcaggtattgccaaaattttgcaagccagctccctgttttacatagatagggcaatagggcatctttagtgaagtattcacttgcaaagcctcgtgtttcaggtgaatgagcagattactccagtaaaaaggaccttcaatacgcggatgcaaatttttgcgcataactattccaaaatgtattctaaacaaaacataatacagttaaacgtgaatatatttttttcattacagaacaacaaaccagcatttctgaaggaaaattcataaaatgtatcttataattactgattctattcgtaaaccaaaacccctctaataatctgaactgcaacaactaaaaccacctaccctacatgtatatactatgctacctagattcaacaaaatgtgaaacgaaaaattgcaggcttacacactcacaattctccgcaagtacatcctcgcgacgcgaagctccgggtcgatcccacccccgctaccctcccccttctccaaccccctgaccagcccctcgctcctcgccgccgccaccaccgccgccttatcggcatccgggctcaggatctccacccaaaacctccctcccgccccctccaccgcacgcggcggcctcctcgccgcgtggaactcaatcctcctgtgcatcagcccctcctccgcctcccccatcatagggttttcgcgctcgcacggatcggaggatcaccggattttcggggcaatttctcggattaaaacctgcggcttcgatcgattttgggattggatagtgtgatttttcgcctcggcatttggtgggcgagagagagagagagaggcgaagaggtgagagtgggaggtggtggggtttataaccgacgtggcttgtacggatggacggctgggattgaacggattgggttatggactgatatgggccgttggattggtttcggttttggaagctctccccccacgatggcggccggagctcaaccgcagcgccgccgcggcggcggccggagtgtcgccggagaaagcgacggttgagagggagacaaaatagtctagtgtccagatgggttggggttggggattcgtccaacctgacgcatcaacccatgttggcaacgctggattggagcgcgaccttgtcgttctcggtggagacagagatagtcaggcaatcagctccgattttgtacgcgctgcccatgaagaagaagaagaagaaggtgagcgattctgcagtcgtaatcgtctcctcgcatcagctaatgccaaaaattaatttttaaaatctaattttaaagttgattttttaatcgaagtttattttccaacaatgacatttgaatcgctaacaacacatatataaaaaatttacttataaattactattattgtgtattattagtatttggcgaaacgatgcagttcttgaagagtttttcatccgctctcgttagccaaaatttaaatttaaaggtgattttgaagatttttattattttctatttttttcatataggcttttaaaccacaaatgatacatacgtaaaatattacctacagaattattcttgcttgctctgtagtcacggtttaatcggtcatactagctgggagcaatagtaaaccgtaggtgactagtctgaagaaaagaaacaatctgatcctgaatttctgaatcttcgatgcattcttgcatcactgcatgcatgtcccttttgatggtggacgccggcgactcgccgtcgacttgtcggtgactgctggccacgggaaaccaaacaactctgatgcaggtagcaatcagcaaccacaaagaaacaaattacatatatgcttttttcctgtgctagtacggagtagtagtaggaagcttgagaagatgccaaaggaaaaaagaaatccattgcagattgcagacaggtgacgtgcttccaacccctttgggcgcagcacaagcttactgaagcaggctacaattagttaatactaataactactctcaagtctcatgatcattgttgctgtcatacaccggccaccggccatcttaagctccagctcccagctgccttgataaagattactgtcaaagtgtcaatgcttcctaatatgagtcaagatcaagatccagcacatgaaaactatctcactgcagagtttaggatcagagattttcttttttcttttgctaggagatacaaagattctgtaaagctctctctttttttaaatctaatctcttgcagctcggttgaaaccttcaggtgaatttggtttttacaggattactagtacaagctcagggtgaaggactgaagagcatgtggcttgttctgaaattggcggcagatgctaactaccaaccgccgcccccacccggatcccccaaatcaccgtgactcactctctaatcatcttccttttctgttaacaaaatcatcctagtcacgttaattggcgtagaaattagagaacccttaaaaaagaaattagagaacccagcagccagcacaaaaaagccaaaaacgaaatctgaaagggaacaattgcgaaagcaacggatgcttagcttgctctccccaggaggatgaaactgactttttttttctaataactaatgttacaattaaaacaaacagtaagcagatttatcatgcaaaaccttcctaaaatgtaatttactgcaccattatatttgctttttttttaaaaaaaaagttcaagattttttggacaagcacattgaccatcagtaaagattgtcaggttgggtaggttttccatgaagttgacctaaaatacttattttgaaaccaagcacaatttttttcattgacaagccaaataaaaaaatgggagaaataataataataaattcttagaagaaaggggtagagtaaagagcagattaacagctgcgcctaaaaataattaaatttagtcaaacgcccaatgcttcgtcttcctgcttccttgagtttcttctcctcttcctcctcctcctgtcgccatttcccatatcgccacctagaatcaacaaaagcgaccaccttttctccgtgcgcttcgattccaaggccctaatctaattaggagctcaccgcaacaagattgctcggagctttcgagcgtttcttttttttttttgtttccttccgcgatatttatattctaatgctgcaactagctgcccgaatcctcaaaggcggagcattttctaaagtggagttctcaaaaaaagcgtcttcttggggtggattgcaagttggtgacccaaatccgtcgctacgggtcgggagttcttggatttcccgctgattggttcgcagattggagctcttgatttggttgcgccatggcgctgttccggaagttcttcttcaagaaaccgcccgatgggttgcttctaatcacggacaacatatacggtaatggaagtatttccttttgcactgccatgacttatgttgcttgccaagtttaccatggacagattcatccaacctagcttctcttttgaaaaggtttcagcttgattgatatggataggctgctaatttaagcatagttgaattaagatttggcacttctgaagtgttggtagtatagtgtatcacaatatggattagagacttttagggccatgagagttatacgtaatgtagtggtggaagatttgtgtttttgtctgtttattgcaatttgaatggttaatcgtttcagttatgttatattctccctaaaaagttgtgttatattccaaaaggactgtttaatactttcgtaatctgttcattagttcactgtgtgaagataaaagaactcaaaatagagccgaggtcctgaggatgcttgacacatgtagcttttatctatttcagtttttgatcattgcttctccatgaaagagatggaagaagaccattttgaagcccacataagaggtgttgcagcacatcttctagataattttggtgatcattcattcatgatctcgaatttcggcattcgagatgaagaaagccccatatatcacattttatctgagtatggtatgaccgtcctggactaccctggccactatgaggggtgtccacttctcaccatggaaatggtccactgcatcttgaagtcgagcgaaagctggctctctttgggtcagcgtaactttctgataatgcactgtgaacaaggatgctggcctattctggctttcatgttagctgctctcctgatatacctgggacagtattctgatgagcagaaaacactggatatgctttacaagcaatcgccagtagagctcttggagatgttttcacctctgaatcccatgccgtcgcaattgagatacttgcgctatgtttcgatgaggaatgtcgtgcctgagtggcctccagctgatagagccctgacgttagattctgtgattttgaggatggttccagattttcatggtcaaggtggtttccgtccaatattcaggatatatggcccagatccgcttatgcctactgatcagactcctaaagttcttttttcgactccaaagagaagcaacgttgtccgtttctattcacaggtaattgccttgtcttttccctggtcttgcattgtggttgttttgaagtggacgcgttgtgacgtacgttgcagcattcgtatagctaaaactacttcgctgtatcattaatagggttctatgttgattatatttgaagtttgtacaatttctggtctaaccttcatgaaattgaactaaccatttatgatcttaggcagatgaactggtgaaaataaaccttcaatgtcatgtccaaggggatgttgtcctagaatgtatcaatctgtatgaggatctggatcgtgaggacatggtattccggatcatgttcaatacaggtttcatcaggtcaaacatattgatgcttaatcgtgaccaaatagacattttatggaacacacaagaccaattccctaaagattttcgagctgaggcaagtgttttataccaagtggcaaactagcatatttctgtttatacatggatttttaaatacaccttctattatgttaggttattttctctgatatggatgcaactacttcacacatcacaacagagccggttagtcatcaagagaaacaaggacttggtattgaagagtttgctaaggtgcttgatatattcaaccatttagactggttggatgggaagaaggatacttcgcttcacatacctcaacgaaaagcatcatccacttctcaaggaaatatagatgaatctcctgctgatgggtccgagactttcttcgatactaaagaagaacttgactttgatagtctctctggtgaaagctcgtcttcgcttgttttgaagttaacagatgactatgttatggttggttgcactgaacttcaacaagatcccctacattcaacctcagctgaagttccatccaaaatacaaacaatagaagtagctccttcacgaacaaggcctccatcggtgctgttgtcacctactaaggttaagatgccaaagaccagtgcttcatcaatggcactaccttcaagcacggtaataccccaagcaccgtcctcaccagttcagccacagggactgatagattctgcagtgcaaattgcaccagcacagtcagcgtcaaaatcagctgagaactctggttcacaaactccagtaaaccaagaaccttcacctcttaccgtaaataattcagcatcgaccgcatccttgatagctttgtgaacacntccgcttcttcttcctccgccgcccactgtttcattagcccctgtttcccccattttacccataaatactagtacaagtataatcagcgtttcccttagatcgatcatgccctccccttcacaacctccagaatcatcagcctctccactagctcttgcaagaaatgaagagctagttaaatctcaagaaccttcctgtgaaaaccttgagaagtttccacctgaattttatagagcttccagtgtcactgcattgtcatcagattctctattgtccatagaaaaggaatctagcagtacaagaacatatgtcccagaagctttgcctgcaatgcctctgacttcagacactcggacctcattaatttcaatttcaactgcagcatccccacccctgccgccgccactgccaccccctctaaaaccatctactgtgatgtttcctttgtcatatggtaaagaggtagcaagcactaaagaaaaggctgcaccaactcagcctccactcccaccacctccaccgccaatacaaccaacattgatttcaaactcgatatattcatctacttcatctgtggtttctgcaccactaa

SEQ ID NO: 46530 - DNA, 26128 bp, Oryza sativa
  unsure (1)..(26128): unsure at all n locations
tgtcaagagctacacagggaagcttatgggctgaaacacagaagtctgatgaagcatcaaggtattccaaacattttatgccattattttccaggtaaatgctaatggtagcactataacatgttagtccatttatgtcttcaccagaaccccagagatagatatttcggaacttgaaagtcttttctcggtagccatgccaaacatggaggagaaacgggcacgccaacgtccttctgttgcagcgaaacaagaaaaagttcttttggtacttatacttcacattccttactgcaaatattcacaagcagtgagaaaattccgtgaaaagtaaacaagattaaccttttcttctgcagattgaccttcagcgctcaaagaattgtgaaattatgctgagaaacattaagatgccattaccagatctgatggtaacgaactaaacaattttgttgaagggatatggctcttgaaaagtaaaagtaatctggcatagttgatgcatacccttgctgatagactagaatagctaatcttactaatgccacttcctaaacctggtttgggttatattagttacctattgttgcaactgttactgagcataaagtatttggcagctgtactgaactagtggtttctgttgataatagtggttccttttttttcagaactcagtgctggcacttgacgattccattgttgatggtgatcaagtagattatctaataaagttctgtccaactaaggaagaaatggaactactcaaagtatatatctactcagcagattgctctttgaaatatcattggactcttgaaattcttactgcgtctgttccagtggaattttttctgtattctgctaattgattaaggtttttcctcctactttttcaggggtttacaggcaacaaagagaacctacggaaatgtgaacaggtcactaataatcttttctacttgatcttttgttggtgatgagctttgttttttcggtaactatgtaaataataatgaatttcatagttcatcccaagatatacacaatcttagtgggagatcatacaaccaactatctcacccagtcatgtttggatgtttcttggaagttatgtagtggagtagctaataagatgatcatttttttcagcattttcccggtgccatgttatgtatatatagcttgtttattgcttagcctgtaccagcagttatactattaattttttgcttaatctcatgcatgaacacaaaggcttgatctgacttgcttctgtaattgtagttcttcttggaaatgatgaaagtcccaagagtggagtcaaaactgagaatcttatcctttaagattaagtttcttacacaggtcagcagaatatttgcatcattttttccccagtgaacttgtgtaactgttctgatagataagtagagtttaatttttttgccgagtaattctgtgcattctttcaggttgcagatctgaaaaacagcttgaatactatcaattctgttgctgaagaggtacactgttatataatatgacctcaagtcctcaaccttttcccgtttgacgagtttaaacatgctgttatataatgttatttggacaggttaggaactctgttaagcttaagcgagtgatgcaaacaattctttcgttgggaaatgcattaaaccaaggaactgcaaggggtgagtaattaagtatgttctaagattgatatgtttacgatatgatttttgcaaattgatcttccaacatgaagaaatacagtgcacatggtttctcttttttttaaaaaaaaaaatcttgttctattttttccaataaatcatttttttcatatcatagaaaatgttggttaaaacaaaattcgagcatttaacaattgtcacgggtgaagatgtagctaggatttatggacaggaagaagaccttacaactgcaattcctgcgctcttatttcaaaacagcatgttcaatttcaccatagctattatgtcctgaaccatcatctctcttaaccacatgaaattgatagcgaactgttgattatatccttcatatttttctcacaaacacctgtttttcagggtcggctgttggatttagattggatagccttcttaaactcattgatattcgggcacgtaataataggatgactctcatgcattatttatgcaaggtatggcatttaatttcagtaatcccatcgttttttgtgttttgaagtgtcactgaaccacatagttatgaaagcattgctcgttttgcgggaatttactggtgcatagcaatagaagttccacatactaaatttcttatgagttagacctagagaagggatctatcaagggtatgtctaaatagtatcattgtgattgtattattgatggttgttcattacagtaggaagagaaagattatctaaaactaaaagctccctttttccatttagaaacagtacattgaccaactgcatacagtggtttctcattaaaaatttgcattcagctgtgagcaggacagcagtgactgtattgcccttttttttcatcttccctttattcccatgtttcaaatatcatatcagtctttctcaaaaaaagggaacaagagcatatgacgaaagtagatatgaatctgcgtctgtaagtttggactggttgcttttataaccagtatatttgcattgatattttgtcatgaagttgatacttttgtggcaagctcagataagtatgcactttcatgaactctttctcaaagtttattgcgctcgcaggttctttctgacaagcttcctgaagttcttgattttaacaaggacctcacatatttagaacctgcatcaaaggtaacttagatatattaattaacgctagatccacgttggctttgttttgcttgcttatagtgtggtggtgaatcacagattcaattgaaagagttggcggaagaaatgcaagcgataacaaagggactggaaaaggttgagcaggaattgacaacatctgaaaaggatggtccagggtctgagatattttacaaggtcggttgcctgagattttattgttagtcatatgagcagaaatttctcatttattttcgctgattacaatcgagaaaatggtgcatggtatttggttctccaacttcccccattgattctctgttgcctccttgtggatgtagttgttggaactggaaattataaatataatttcatgtttctcaaagtattcttcttatgtaaaactcatcatcaaagattccgagttacactacaatagggatagtgacaaaatgtgaaaagtaaaaggtgatcagagacctttgccatactaaagggaatgaacatgaatcaacaatttagtccttactgctccatttgtattattagattatggaaaccataacacttgattgcagttttgcagttttgtacttcatcagtacataggctttatagatactccctccgttccaaaatataagtatttctagggttcaaaatgtgtgcctcaatataagcattttatgggacactgattccatggaaatccatacatttttagccaatcaggtgcttaggagacgaatctaagcgattcaaaaatcaaaatttgaccactgaggtgactgaaagggaatcttttcccttaaccttggtatttgctaaaaaaacctagaaatgcttatattttggaattgagggagtatattctattaatagtttgcaaattgtcataaaaggatggataagaacaaacatgacgacacccataactgaaacagttagtcatttagttgactatcattgcacaatgttttgctgttagtatattattaactgtaatactaatactcaaaagagctttcgtttcagaaattgaaggaatttcttgctgatgctcaagctgaaggaagatcgttagcttttctttacagtactgcggtatgcaaagactataaatagtttcattaccttgctgcatacgtcttctaacatgtatttgtactaagtttttgttattttattttcaggggaaaagtgcagattctctagcacattattttggtgaagatccagtgcggtgtccatttgaacaaggtattttatttttatatataaggcttaattaatattcctaactactctacaaaatgtacaaatcaaagataagtgggtctgatacaaaagggaatgggaaacgtgtatttatatgcaaggcatgtgacgaaaggtgctatgataattgagttagtcatcatgtttcagacagagggcactgcattcctctttccatggtatgacctgtcacaattggataacttaggagtaattgagtattgccatttttggggttgtacaatcaaactaagaaggggcatacaattctgggggtccctggtggttttaccagaatcatccaaattgctgctgttctttgtgtgctttgttccttagtgaacttgtattgccatgatagatactagaattgttgcatccaccaaatcttcagattaataccagttagcttttggatatctgcagcagctatatgatttcctgacctttttatgtggacagttgtctctactttgctaagcttcgtgaaaacgttcgagcgtgcccatgccgagaacctcagacagatggagctggagaagaaaagggcccagatggaagcagaaaaggagaaagtgaaagcagcagctcacaaggaggatttgctggagccatgaattttggtctgatgagttggcaaagtatgcattgtcgttgatttcttgccgtttcatattgcggccttagcttcatgaccaaggacagtacggcagaaaattttgtagcggtttattcgaagcttctaaccatgtgaaattggaggtgaagaaaattagcacatatgacaggtacatcaatggaagttactccctatatgcttggactactattggttcttacagttttgccctgcagacagagggagaaagacaaatataagctcactatgtagtgctaatatgacagtttacttagcagatagactatacagcaatacagatacagcttcactggttcagtggttcttactgtacataggaaagtgcagctatgcaactcaccggttccctggtgctgaacaaattttgcaatgtttgtgcccgcaaaatatgtacatttgtagagatgcttttgtgcattacgatgtataacactgtaagtagaacaaataaaacaatatttttccaaatggaatgtgtggccatttgatcattcattcatctggctggagctgtggaacaggcagcttgtatcttgttttttcctccttgtctggaaggatagacaaatgctctgaaccttatcagttatgttgtcaggtgctatgaatcgatcataatccatcaaactgtgaatcacatgcttggtcggtactccctcctatttttaatgttcgacactgttaacttttgaattttaatcattcatcttatttattttttatgcaactataaaataaaaatataagtcatgcttaaaacatatttaataatagttatatatcattttaagagtaaattgtactttgtaccaggtagagtatatacaccttgtttgacttttcacccggtagagtaaaccttgttttatttcgcactaggtttaacacatattttcactttgtatcagagaatatcgaaatatgagtaaaacatatgaaacttcttaaatttaaactatgtttgacaacattgcttttagatattataaaatttcattattttttatggtttgatgatagtgtcaagtgaaatttatttcaagacaatgtagtgcaaagtgaaggtatatgttaaacctggtataaagtgaaacatggtgcgttttacctggtgcaaatacaatttactattttttaatagggaaaattgtaaaaccaccacagaagtctgaagtttgacattccacaccataagtcattttgttgcaaatgcccgcccactactcggttttgttgcaaaccacatcataagtcattttgttgcaaatgcccaccctctactcagttttgttgcaaaccaccacagtgcacacatgcataaccgaatcaatatgttttcataaattgtgagccgtcaatatgttttttttacataaaattaatacttataagagtatagttttaacactctttatgagattcgatatatagaatagctaatgggagctttaaaattgttgcactgagttttgctatatgccaaaaaaaagaaagaaatcaatgaaatatataagaataaatctaatgtaaatactatgacaagattgacctccgtaacctatggtggttctacatcagcgttaactgacttatttggttaagcatgtgtgcaatggggtggttttaccaataaaactaagtaggatgggtatttacaataaaatgtcttatggagtggaatatcaaacttcaagagatttttggggtgatttttgtaatttcccctttttagtaagacaaatagttaaacataactgtgtatatgcataaaactcatgagcactaggatttaaaccctgctagatgaagccatgcgcccactactctatcaccgtgatgctactaacatacgaatctcaaaggaaaaaaaaagaacaactactccatgtaaccttagaaacacatgttatttttccataaattcttatgttatgtgcaacttgcaaggagttataagctctcgtagctaacaaaatcaatgtgcgacttctaggggcaaagctagagtatatgaaggcgtgccaaggaaccagtaaagaaaatttttagttataactcatctattttcaatgtaaacttagacgttttcattagcttaaactcgatccaaagtaaaaaaaaaattaacggaaatgctaaacttctgttgacagaaaatagaacctcaaatcttgtaaattttggatcactggatgtgcttcatgattcatgctcttcttctccaactctggcgtccacctcttcttctcctgcgccagcgaacccaaaatccggcagagggccgacgaattagggtcctgcggtggggtgggggtgggagggagggaggggagggggaagagggggagttcaccggctttagagggatggctgtgggaggcagcagcccgacggtgggcggcggatcgagcgggcggcgaggcagcggcggcggcgccgtagctgctgggtcgggagcgggcggcgggggcaaaacggaaagagtggtaggaggaggcggctggtggtggcgccccgccggcgacagggaagacaacagacagctcgccgctgccggcttgaggcaaaggagaggagagggagggggagggtgaaggggccggcccggaggcctcgccgacgccgttgacacctttcggccagccggcgaggccgggcggtggcgtgctcaggcggcggtggcggtggcggtggcggaggcggggcggaagcgctgaggagcggcggcgtgaggaatcgggagaggagagaggatttttatggtttggttgcctgcacgaatcttaaagcaatcgggtggtctaaaatttgcaagatttgtaagggggtttcctgtcaaatgatctatagacaatcccataaattaaacaagagatattttcattcattttgttctaattatgtccttagtgactttcaagagggattaagctcatctaacttacttttctctaacttgtgtcactgacatgtggaccatatatctattggactcacatattagtgcatcaaagtcaggggaacctcttccctctcgagagtcccctttcttctcgcggctcagttcttcagtttgttctttgagcttggtccctccccgaatcgatcaccggatttccacactttcccgtaaaaccgaaccccaatcgataaattcaaacaaactctcatcatcctagagctctactctagttttcctttttttttaaaaaaaaaatactacggagtagagctctacgccaccgtacactacggtctcctcctcatccccgaaacccaagctactatcctcttatcgccaactgacaatgacaagagggcccctagccccctactcctccgggcaccacatgtcagtgggcgtaacagaaaacaagtgttgacctcggggtgcgtggagtttttcccggagtcgtatcctttcgggtgacgcatacaagggcggttcggatcggacggctagtatatatccacctccgcctccgcgtccatggccaccgccgcatccacctccgccgccgccgtcgccgccgcatcgcgcctcctcgtccgccgcgcgccgccgcgcctgctgcgccggttaccccgcgcggcgctcgccgcctctcgcccgtcgccgccgtcgtcgtcgtcgtacggtgcagcagccgtcgccctcggccggcagccgctcggccaccgcgctaggatgggacacaccgccgccgccgccgccgccgcgggccccgcgctcgggctcaccaagcccaacgccgtcgagccgccgcaggtgcgtgttcgggatggggttcgggttcaatttcaggttcagtcgcttgcttggtgcttaggattgttgcagattcctgaactccccatctgtgtggtaaaatgaagctgctatatttggttgacttgatcacgactcgttatcgaatctctcgagctgctagatcgagatcgaactagtgatctcctacgcaaactacgtttgcatctttgtttagatttgccgatgttgcaagtgagctcagtctcaatctgtgcactactgtttttttttcaggtttcatttgctgctaaagacgtcgaattctccgaatggaagggagacatcctcgcaatcgcagtgacagagaatgatctggtcaaaggatcagactccaaattcgagaatgcggtgttgaagaagctcgacggccagctcggcggcctcctgtcggaggcatcggcggaggaggatttcaccggcaaagccgggcaatcagtggtgctccgcctcccggggcagggtttcaagagggtgggtctgatcggccttgggcagaacgccccctccaccacaacggcttgcaagggcatcggcgaatccgtcgcgtcagttgccaagtctgctcaagctagcagcgcggctattgtttttgcttcagtgggtgggatccaggaagattttaagctgactgctgcggcagcaattgcttcaggtagtgtgatcttgatgctcctttcatggaattgttgtgatcttgtgggatgcattggcttgatgctgaattttatctgtatctggattgcaggaactgtgcttgggctgcacgaggacagcagatacaagtcggagtcgaagaaggtgcatcttaaacaagtagatcttatcggatttggttctggtccagaggttgaccagaaacttaagtatgccaatgatctctcctcgggtgtgatattcgggaaagaacttgtgaactcacctgcaaatgttcttactcctggtatatttcttttgttaaacgccaaacagtggatctcctccatagatgccattctgatgttttcttatttcactactcactcatctcctttatccagctgtgcttgccgaggaggcatcaaacattgcttctacatacagtgatgtattcactgcgacaatattagatgtggagaaatgtaaagagttaaagatgggctcctacttgggagttgctgcagcttctgcgaatcctccccacttcatccacttgtgctacaaaccacctggtgggaatgccaagagaaagctggccattgttgggaagggtctaacttttgacaggtttgtgaaacatatgcatattttgtgaactattgcagtaacatacatcattgtgtaacataaatatgccatcttttatatggataattgttggttcttacaattgattaaccgatttttttgcagtggtggctacaacattaagactggaccaggctgcagtattgagctgatgaagtttgacatgggaggctctgcagcagtttttggtgcagcaaaagctttgggccaaatcaagccccctggagtagaggttcattttattgttgctgcttgtgaaaacatgattagtggcacaggcatgagacctggtgacattgtgactgcttctaacgggaagactattgaggtatgtttgttgtgatacaatgcgtatgattgtagaagactaggaatcatgattcattaacataaatcagtgatagtgtgaaaaaatgcgtttgcttatgtattcatctgtatttatttttcttcaggtaaataacactgatgcggagggaaggcttacacttgctgatgctttggtgtacgcttgtaatcaaggtgttgacaaggtaatgacttttatggtgtcatgttctgtccatatgattaccaatctgattttttttaatgctttgatgatttctctataaattaaaccttagtgcaagatattttattggcattgttggttttagttataatgctgatactcagctcatcaccctagcatagttgtatgctatttatttctaggccctttttatggaaatgtgatttatcttatggcctgatgtccctcacgaatctagtttgaggtactgacttatctttaaatgtcaaatgtagattattgatctggcaacacttactggtgcatgtgtcgttgcacttgggcctagcattgctggtaagattaaccaatcacatatcacttgcaatcttctccattaagtgaatagattagtgtgttcctttgattgctgcttgcttaaatgaatattttgtgcaggaattttcacgccaagtgatgaactagctaaggaagttgctgcggcatctgagatatcaggagagaagttctggagaatgccactcgaggaaagctactgggagtcgatgaagtctggtgttgctgacatggttaacaccggtggccggcagggtggttctattactgctgcactcttcctgaaacaggtaaatttaccactttattatgaatgaaattcaagcaaaacacacagccacatgctctaggtaggcacatttgaataaagttgtaagcagtgacatgctaatggagcctcatgcttgtatttgcagtttgtggatgagaaggtgcagtggatgcacattgacatggccgggccagtgtggaacgacaagaagcgggcggccaccggattcggcgtctccaccctggttgagtgggttctcaagaactcatcttaaatcatttattcccttgcattctcatccccctgaggatgagatgacacgaggatttcggaggagtttggtggtggcaaagcggccagctagggccaatgatatacaaaagtttagtgggcaatttagaataagaaaactggtcatcgtcgtttccttttcagttggggtgtcgaattgtttggtgaaatcatcatcatcatcatcatcacattcacaagatgttttggccaggacaagtctgttcgtgccgtgtagctctctcccttttctcttttgtcaaatgtggaataacgctcttccttttgatttgtgccccgggataatctgagtcataaatatttcgacaatagcctgaatcgtaacgtttccgctgtgctagtgactgaacaggggaactttctgactgagaaatcgcgatgcttctgtcgagagcacagccatttctgtgtgtgtattgctatgatgtgtctacgtcaggagtgtaaggtgaacacgtatctgatgcctacttgttcatgttggccactgcggatgccaccacacaagtgtgtgtatacaaatgcagaggcgaacgactgcacgtcactggaggataggatactttcccagcgaggcccaaattcatagaaattttcgaaagattttattcctatagaatatttttttaaagccctttctatcgaagaaatgaatcctatcaaatcttatgaaattcctatgaaaagttttggagaaaatttggcatgaggtagaatctcatgggaagttttctttgaatctttatctttctttttttttcctgcggtccaatcaaataatcatttatgtgtttttacgttttttttctatttctctgtttttcctataccccgttctcttaattgacaattttaacggtgcccgtaaaactaaactgtcattatatttgtagtatactatttacaatattatatattactaaaaaaatatccatgtgttgcaacgggtaattgctattttaattttatcattgttatacggtttagctagggtaaaattcactgtgggaactcgcttggatatttttttagaaaatcatgagcttcaattaagagtatgtatttcatctcaagttagcatgcaagtttttcaaaagatctcttatacaactccttttatacttccaaaaggaaacaagcttaaaattccaactcaaatacagatatgtatttaaaaaatgaaagaacttaattaaaaaccgactctaatatggatgacgtaccaaaataccataaaaacatcttcaatttttataatagtagagatatgatgcggtgtgtagtcatttgatggacaaagaagcttctagaatatactaaaataatttatttcaattaatcaaatcaattttctatatatctcaatcaaccacaaccttccaccatccggagccattgtttctcttattcgcggaataaacgaaacggcatatttggaaactaaaattaatttgtgaataaaacttttatatacatattcttagcaatctagaagcaaaggctgaaaactaaacttcgatgaaaaaacctcaaaaccagctccaaatttatggttgaaaattcaaaatttggctgataagcataagtataagcgaaaagatgaggctagaggatttcactattttttttttattttctgaagaatatctagacatgattacattttagaaggggggaagtatatggttactattgcagggtaagataaactttgactcccatgcaatgtcaaagtcctatctcctaaaatataataacttaatactggataggatcgaaagaaagacgtctactatgaatctggatatgacacaaagaaaaaaatcttgaaaatactagtatagaaaaattggagggagtacctttttttttctctttttcacgcggcctcatttgtatggagcccaatatactagtattcgtcggcggaaaattagttgggccgggccgggccggaatctttccttcctttcttgagctgcaagaagaagaggaggaggaggccggccattagaagcggaggacacgcgcacggcggtcgccccgcaaacaaaaactcgccgcggttttacagccaacgaaggcgcagcaaagcaaacgcggcggcgcagcgctcgccgtcgccggacttcctccccccccccgctccgattccgtccaggcaagtgcttccctctccctccctcctctctctctctctctcttcggtggaagcggcgcggctcggtgtacgctcgcgtcgcgcctcctcctttcccctcctcctagtcgcgccgtggatcgcgccgccgggatgggggttttgatctctatgcggtaagaccattcggtggccgattaggatccaaccatgcctaactgtgatgattccggtggttgtttcggttacctgtgcagatgcgaagattttgttacctttaggattcagtgaaggtgcttgtaatgttaaatccgtaaatgtagtagcattatggactatctatgatgaagggattaagaattttcttgctattagttttcatgaaaataatggatttttcccccacacattatgtggtttgattgtgctatttatcttaagcaaacagcaaaattagaccttttgttgattattactacgcatgtcatagtgcaatcttattagtacttgagttcagcaatactgttccggaacatcctttttttttaaaaaaaatgcagagcatctaaaagtggagtgtaaaataaggacaaactgatcttttttttaataaaaacacatgtgccgagagaagcacatctcttactagctctacaactagtgctcagattgttctgcacatcagtagcatagcaggcattaattagtgctgaaattttactcttgggatgtttaggctttccttgatcttctgtttcatagctttgaaatgtttcttaccgcagtgtttagttcagatagatagctatattttcttattccgaaaagaaaaataaagataggtagctagctatacttttggaccgggggagtaatagatttacaagactatcagttgattcatagagagattgattatttgatatgttccctttgcccttttgcctcctcatttcattgtgcagatactgagtgaaaacctgctgctaagatgggtagcacagaacacccaattcctgcgcagtcacctgcttgcccaactgtgagcgaaggggggtcggctgctccagctcctgctactgattcaaagccaaagaagaagatatgctgtgcgtgccctgatacgaagaggctgagagacgagtgcatcgtcgagcatggggaatctgcgtgcaccaagtggatcgaagctcacaagcggtgcctccgagctgagggttttaatgtctgaattttctctagtcatctaaaggtattacatttacttttatagaagaagtgatagaatatccggtttgagacttgagatgcaaattggatccaagagattagctgccctgtttttgcatgttatcgaagtgatagaatatccggtttgtgaattgagatgcaaattgaatccagagattagctgccctgtttttgcatgttatccctgtatgtcagggaacttattttcatgataaataaaggtacttccgttactggtgacactatacatggctatattcagcaaattacttcatggctcccttttgcgttgaattgcgtacatgatatattctttttcgatgagataattgctcagggttccttcagagcacaggaattttataggattttcacaggaaatagttcagttcctctaaaattccagcgaaattcctccaatccaaatggaaccttagtggtaaacagagcggaaggcttcaagtttattagctccttgttgcgatgcccatggtttccatggcacaaccatccttattctcttattatccttttcccaacaccaatcaatcacactcctcacctatcaactacactgcacctctaccaagcatcttttacagatttctagactttgtagctagacatcagttgttggcaggaaaccatcaggattttggcaatggctcccctgccaagaacgactgaaacatcctgaatgctctccttggctgaaacagtggcacctcatgcccagcacctctcactgacgcaaatgtgagcccttcatacacctcagaccatcctccaacctgcacacacagatgcaccatttgcagatgaagttacagactttaaagtgacaagatttctgcttaaactgcatctgacaaacagcaatggagattgttcactacctgtccagctgagtaccaagggtaccagcggatcttcgtcttcagtccaagatggctaagcgcaaacctcgttgcagtaaccggaacgactgaatccgtgtcgccactgcattttcatcaagtgacaaatagctcatgatctctgaagaactagttccatgctgaaccaaaaggataaattcaccaattccaggtcctccagctcacctgaacacccatatcctcagcccggccttcatcagcaacttgtaagtcggcagcatggagaactctgaatctcgccacgtcttgatgagcacatcactgtcaaatccaacccaaatgcattgttaaactctcccaattccaacctcagtgatgccaagaaatatcaagaaaaaaaaatgtcagctgatgcatcaacctgcaggctgtccatctgtaaggaatcccagtgatgttggcatgcatggccttctgaacatccggccggttgtagtacttctcggcgtatgtctccgtgcaggggtcgtagccgaacgaccggcgccgtaggaaggtgtccttgaacctcagcacggcggccttgccgcggcggcggccggtggcgttggcggcggcggcggcggcgcaggacggcgtgtagatgctgtactggtcgatgtcgccgaactcgtggttcatggcgtagctcatggcgcggttgcagagcctggagacgttggcgctggtgaagttgcacgacgacatgatggccttgtaggtggtgtccgagatcatggcgtgcgtccaccagtaggtcaccgtgccgatgttgtcgtagtagttgtcagtcaccccattgcccacctggtaaaatcaggatcaccatcactcacacggttaatttcagtctgaaactcgtgttctgatatactagaacatatggattggttttgtttgagttcacttggttattttcagcctgaaactctgtgtgagagatcatagaacatatgggttaagttttgagttcagggtctgcttgtgtttgatggtacttacaaggatcatcgcatggttgtttttagtctgaaactcttgccagaggtgcaatctatggttacagttttcagttgagaatttgttcgtgcttgatttaaaggactgtctactttagtttaataatactcacaaggatccccttgaggttgatgaaaggatatggtgaggccttgttgaactcaacgatcttccttgccaactggggaacgtaatgtcctagaatttgtgcaaattttgttgatggacagtagtcagatgatgcagagataatagtttcagagatggtgatgcaaacatcgccagtttacacattaccagcatagctttctccagcaatgtagaaatcccggtgccgatactgtgggaagcgggacatccaactgatcaagaactgcaacgcatcttgagctgcatcacatcacatcacattcagaagaacatcaagggaacattcagcagtttgccattttatgatgcagtgttaagacagatttggtcagtaaatttcagattacatacctgtcctctcatcaccagatgtcttgagatcagaggtggtgttggagtatgaaaagccaactccggcaggtgattccaggaacaggaggtttgcctctgcagtaacaaagtgttcatcagtcagtgacaggcattgcatcattaggcatgatgagtttctgagcttagtcttagtacctctgttccatgagtacttgttcagatagagccctgtcccgtttgtcttaatcctaaatgggccaatctcttcagatgctccatacgcaatcgatgagcatccaggacctgggaaattatcagcaaatattactggagttaaataaggatgtttctacagctacagtaactttaaaagataattagcaatccaatccaaagtgattagaacatcagactatcagagagatactagtagtaaaacagtaagcactactgctatcttcatgttacagttgctatttacatgacatgcagctccaatgagcatggatatacttgagaagctccaaatctcccaaaacaagcaagtcctaaggaaaaagaggagatagatctgataatccaatcaagaggtccatccttctcgcagaggcgtgctctgcaactccagaaccccattcccaatgaataactagtcaaagagaacaagccatggtgccagaggaacccactgcccttgcatctctctctctctctctctctctctctctctctctctcatctgaacttttattttatcttctctactccaaatcctttgtttatgtacaagaatgaagtccaaaggcaagaaaaggcatctgcaattctgcacgcaagcacaacttcacaagcaattcaagcagctgtggttgtttcgatctcgcaatgacaaatcgacaatgcagaggtcgtcggccattcagccacgctgcagcaaatgtgagttgttgtggggtaaaaggttactgtttggtttgtaccttgtggctttatccagagggaaggaagcagtggtctctgcatgtgtgtgatgatgaccagagagatgaggagcaaatggaataataataattgatcataataaggccgagtgagttgcaaacagggagaaaataacaaaatcaaagatgactagtagtagcctttgtagtttttcttagcttcagctttttatttggctttttctcccttctcttggcataagccgatctagctgattgcattgtgtaactataactcttttcttctaatatactgacgtgcaatctttttgcgcgtttggaaaaaaaactagtatagtagccttaaattggtgctgcagcttttgtgccactcattcactagcaaacatggtgtggtagtatggatccgcagagtgcagagtactactacagtgcagacagaggcttcatcatttcttggcccctcttggcttggcttggctacacattttacagtgcttggctacagattttattacagtgtttggcttggctacagatttactactaatacttcacatgagatgatgtgggatgtggctaagattgcgccgatctccaaggacgacgggatcattcatcagagcgcgccattccagctgcagctgcagcagatgctcgcggccggccggccggccttcagaagaattctgaatcagcagcagatgagctctgcatcatcgcggcgcggggcgaggtgtgagagctgtcgccttgccgctgtacgctgctcgattcacaggctcacagtctcaggtgtgtgtgtgtgcagcggcagctagcgctgattgcagatgttcagagactgttctttcctcctaggaatgagagatggagagagataacaggagtactcctatgctgtaaagcttggaatcgatttttgaattagagtggattaatgcaggctaagcaaggctggattagtggttagcaatgaagtgattagaagggcctaagctgaacagttttctagtatctccttagactccttacactgaataatcatgccatggcaacatggctggctgtaaagattaaagaatgaccagaactacacagctcagtgtaaaagggaaaaaaaaacagtacaccgtgcaggacaagagaagagatttggtggccaaggaataaatgtcaaaagtccaaaagccaggattacaattcgtcagcttgaacaaggaacaaacacacatgacaacatatgcctctctcacacagttgtagtcaactagtggctggctgatgataatatcccacagatcaagctcataaccacacttaccaggaataaactgcaaatgatccggcataagactcgacagttttgggcaagtatacaggttcagagtttcagtcagtgtgtttacttatgcttaattgcccctatgtaggagtactagcgagggcttgtttatccttacctatggagaaaagaaccatgcatgagtttcgaagcattgttcttgtctggctctctctctctcacacacactcaagtctcacacataaatacatgtaattctatttatgctgtgtttaaattcagggtaaaattttttgccgtatcacatcgcatatacgaacacacatttaaaatattaaacgtagtctaataacaaaataaattatagaatcggtcagtaaaccacgagacgattttattaagcctaattaatctgttattagtaaatatttactgtagcatcacattgtctaatcatggagcaattaggcttaaaagattcgtctcacaaattagtcgcgatttatacaattaattatttttttgcctatatttaatacttcgtgtgcaggtgttcgaacgctaaatgtgatagggtgaaaaattttgatatgggatctaaacagtaccttacacaatgtgacaaggaaaaacgcaaagggtttagaggttgcatgtcgtgttgcccggaccagtgcacggctgctgctgccgcctgcacggcgccggctgcccgcggtctcccctgcatttactctctacttcctcgtgatgctaatgtttgttcagccaggcattggtcatgtcttttgcacacacacatttactctcctgtattctctgcatttactatcactgtgccatcgctgtgctctgccttcaaaacagctagctatagtaacactaccaattgctcgatcaaaacactcgtgtgtccattagaggatcgaacacacacacacacacacacgcacaatgtcctttacaaagacaacaagatcatctatcagagctactagctaagctagcaggaagaaagaacacaaatgtatgtacagtaacttgcattttggtttggagcgaagctttgagaggaactcagaaaaagagaatgtggctttccgttagagaggcgtgtgatgacaagaagtttgaacctaggagtgcgtgtcaaaagctctggaaagttgcttgtagctctcgatccttttaaactccagaaaagctagtgcttagatagctaaatgctcatgaaaagactccaggaatggatgtgttgtgttctcggtttggtcaaacacgagtacacgaccaccgatccatctacttctgtacctttggacttaattgagcacagtagttaggaccaatcaagaaccccattattgccagcgtgtgcaaaattaacgaacacgaatgcaaaatgtactatactaaatacaactactcgtacatggatcgaatcaatttaaggacgttgtgaaatttattcatgcagaaagaggtcgaagagaattcagaaatgtgcagtgtagaacagtatacttaacttaccgccgttgagccagaggacgaggggcttggtggcggcggcggcggcggcggcggcctcggtgagccagtagaagagcgcccgcccgctcgcctcgctcaccgccacgtacccggcgtactgcgcgaacgccaccggtggctgccccggcagcgcctccacccggtcccgctccgcctcgcacccgccgccgttcacgccgacggcgaccgccagccacgccaccacaacgctcgccaccgccgctacaatccgccctcgcgtcgccattcgcgacgacgaaagctaagctaagctccgatcggaatgtcgcaatgcagcagcacaaacacaacgcagcgacgaggtagctagctagctagctatgcggcgttggatcgggcgagagcgagatgagctcgctctggggaagcatttaagctggcatgcagctcgggctgagccgaggagggagaagagagcaaactaccaccaccattgcctggggcgatggatgctgcagtgagctgcctacggcgccattaatacagcagctgctactgctactgcagggcttggaggtctggatgggggaggagaggaggaagaggaggagggcatgcagtggctgcgggctcggggtggagagatggccaaggccataaatgcaaagtagctcaagctctacggcatgcggcagtgcccagtgcagcagccactgcactgtgctaacctctcctctcctcatcggattgagatcctcttcatcacttattaaattcactctcttcctcacgccaccgtatgatgtggattttttttattttttagaccttttgttttttaaattttaaaaataaatcttttaaaaaacggaaccttttggccacgccaaccacggtggcttggtagagcgcgtgtcgtgacagagttatttggcaacgccagctacatctggcgtgacagaattatttggtcaaacaggctagcgtggctaaaagattcagatttaaaaatattttttcaaaaggtctactttaaaatttttaaaaaaacgtgtaaaacaccaagtacttcacaaaagttatggtaacggttattaattaatatactctgtattataatataacaatatagtgtcaatttaacaccatcaaatattatgaatctgaaattagataggttgtgttaaatcgatagtattttgggtggatataacacatggatgtttcttgggctttttaccaaaagctgggtcattattaatataatgatctttgctctaaaagggaaaaatggattgcagcataagttataaatttttcaaagaaaataaataagaagttatgcaacttatttgtaaaatggttttttaagggaaaacagtatgagaccgtgcattttcattaaatatagcgggataaaaatgtagcctttagggggcaagaaaagggaaaagaactctataaactatatattgtgaggcaaaaggtcacgtaagctctaaaatgttctttttgactcatggggtaagttgatactacatgtatcaagattaacaagatgcagtagcatttctttctagccatgccttagtggttctgaaaacggctgccccacatacaccacctttgcttgttgtttcgtcaagtggccaaaaaagaccattttgcctaaatgggttacagccaaaagaatcatttcgccccacaggttataggagtgtctagctagtactgttaaaaaatatttttgggaatatcaaaggctataaaaaagtttaggtattcaccagatatgtgcaagataacaaacaaaaactactgtagctaagtaggtgattggcatggggacagcagacgcacgtaaatctagtcaaaacaagatcgcaagcaacgacgttgacaaaggcaaatttttctaagctagaaaatgctgcaggatgagatgagctagatcgatcgccttggtaatgagcaagaaatggagtcaagattcagctagctaagccataagatacctgtaacaactggctatacatacatggatcggagcattcttttttctctcatcatgcaattaaatcatgtcgtcatctagcagtggacaagaattttctacacctagatatcatggcacccatcatttacatgtgactcaaagtctatacacaagcatgtaagtttatttttatctacaactagaaaaacaataatagtaaaatcaaatagtggatagtatcgtacatcgcagataaaatttgttttttttaattttttttcttcatgtgtatatcaaatttaaagttgcatgtttgtaaatgtttgtatagtgtcttatatatattatcacagtctatcttattaaattttataaaaattttatgtaactatttaaattacatgcatacacctctataatagtgtagaaaatacttccccatctagcggtgtgatgatctgatgaaacccatatacgtggaggtcgcaatgagcaagaaccaattgatcgcatgcatgccatcccgtctcagctatcgtcgcgctcaaacaacctagctagcttttgttcgtcgtccttgcagctggacactgcctggacatcaacaagcagctatatatagcttaggttcacatgcaagatagcgtaaccggatggcaatgagtcaatgacaaccagactgatcaactcgaatcttcctattctgttgccgcaaattaaatccttaatttgtctccattcattcccaggtaaaaacagtgtcattagcctagttaccttggtcctaattaaatactgccccctccattctaaaatataagggatttataatagtactaaaatatactacatctatccaaactactttatattttgatacggagggagtatctcgctttttcacggagtccgatcagttttggttggctttacgaaccttgaacatatgtattaaggtggtgtttgaatctcctgaagataaagattaagtatttcacacaaaattagatgataataacgtgtgattaattgagttttaattattgtaaacttgaaaaatgaattaatctaatattttagaacagctttcatatagaaagttttcacacgaaacacaccgtttagcagtttaaaaaacgtgacatgaatattcaaaacttaatccacttttttaagtggaaacaaacggagcctaaatgaagaaacattatgattggataaaaagttatataagtagagaaattaaatgagataagattatgattagtctgagaaaaaaatattactaatagtggataagttattatatattttaggataaatcttaagtactacttatattttggacggagggaatagtgggtaatttcttttttttttctaactctacatatctagatttctataaagaaataaaattgtatcactgcattattctgaattctgaatgagaccttacctagtcagagacagactctgcacacaaattcttcacttgacaagctacagggagcatgcatgcagatggatgggcaaattaataatcgcgccacgatggctgaaaacaactgatatattttgcgtcacagctcaaatcgatctgatgacgtttttgacaatttgacccggttaaattaaagaaatctctgcaggctggctgccgcgatgagggcccaaactgtacccataattttacctgtactcgtgatcaactccctcgtatactctgtctccttgagagaagcagcagataagaatgatgctgcttctgccgcccgtcttgtctcttacagcagagtactaatgtggtgatgattcctcctgagaaaagcttgataattggatctatgcatgcatttgcactgtcattaacggactaacagtttcttgcatggaactactcactcacctactgctctgattagagctgagctttgtcagatggtgtactggtaggagtattgtgtttgattgattaagggcgcctagaaagagagggtctccccttccaagaaccaagacgccacactgcacacttttatttacattgaactgtactacacggctgtagttaactgaccaccacccctaggtagatcctgcttgctcagtcactcacactgtgccaagaattgcctatgtttgttctgttccctgatgaacaatgccattgcactgtagtatgtatgtgtgcctactgcctcactgtttttctgtagaattcagagagagaaagaacagcaaaacagtgacattaatttttctccatggccttgttgtcttgaccatttggctgattcgttcttggatacctgcgttcttggacgcattgtgcaatttgcttagtgccaagctaagctaccaaagagtagtacattagtacaaagctcaagttggattagcacttccagtaggctcatacacaaattaagacaagcaagccagcatctcaggtatagtagaaccctagctagtacataaaatgagaagctttgtgctaaggcgatattaggtgtcgaatgcttcgaagtagctagcactccaatgcgagctgttgcatggaattgatggcgatcgagtactactactgactagtgaagtgaaggcgacctgtgatgagttgaggaaaggagtagggacctgcaggtaggttatctctgaactttttggatagctgaagctttgaggctttttgcttgtacagggccaaggtcagtgatgaagaggcttccatttctagtagtaggagtagtgtaggagtatagtactagaattgcagatttgatccgtcgatatggcaatgtttggcacgggaattcaatgccaattcattgctctgttttcttctgaaaaaaatcaatgcaagaatttcagtagtagttcacttctcaccgacatatgcatgcatggaccatcaaattcaatatctgtgcatgcattgtgtgcacagagagaaccatctgcttgttgatcttatcactaacaaggggccccgggagatttgtgctggttgatggggcccatgtagcagtgaaaacactgaaacagtgtacaattctgtagagtaaacagcactagccactagagactgttctactttgatctgaagctgnnnnnnnnnnnnnnnnnnnnnnnnnnnnnnnnnnnnnnnnnnnnnnnnnnnnnnnnnnnnnnnnnnnnnnnnnnn

SEQ ID NO: 46531 - DNA, 5503 bp, Oryza sativa
tgatatgtttgtgtaatcaaactaaaaaactgtaattaattcgtcttgatttgaactagtttggactagttttattatgtggtcattgtaatcatactaatttcaaaaggaaattaatatagtttagattgttcttactcgacttattattgatatatcaagtctacatatatagtcaaacctgagtttccatgttgatcgagcacaaatatcgtacaattctcaatctgggcatgcattatgttacaattctcaatctgggtatgcaattatgtaatttatcttattttaatgaaactataacatcaaagttcctttttaataaattaattttctttacatgcactaagataaaatatttggctaggagatgatagggaagggaattgctataaaaactatgagttgcttagtttttaataaattaattttctttacatgcactaagataaaatatttggctaggagatgatagggaaggggattgctataaaaactatgagttgcttagtttttgaaaaacaaaaaaaatagcaataataaattacataaattgcacgattagacatagaacctatataaccaatcatacaaaatttaagaatataataacaccttaaaaataagaacatttattacatattgtggtccattatagatagagatgggatggattcttcctccaagaccaacattgcgactaacttacacgaaaccaggacaattgtgatcaacgcagccttttttcagttcttcattatcctgtcataaatatttattccagggtcaataaggaatcaaaacgaattatatttataatatctgagttggctaatttacatggtccatcatagattctttctggcccatcatatgccttacccagaatatatggaacctagcaaagttatcaccactaaggcttggagacacacaagacccaacacctatcccaactccaaccgcagcttttggcaagttactaatttgtatccatgatgcagtaaggtcctgactatctttcttcacctttgggtcgtagacatatattgatccccgtattccgtatacctcatcccagtattcaattccggccccctacaagcaaaaataatcatttattcttgcaaataaaaataacaataattgcaaagaccaaatgatcaagttgaatgttccatcggcatatccagtgcaagtaagacaatgtggggcctgggtttgtagtcattcccgtgttggatattatcttccaatttatgcatgtttcaatgctactagacagatttcacacatcataaatacatatatataattctaatgagttattacatagaaatttcattcacttagtgctatcgactagcaccaacgtggataaaccttcccaagaagtattagtaattgggtacaataaactgatttcaaatccctttagtattattgaaatattattcatttgatcgaatatcttgttaaaaaaccatcaaagtttcaaatttaaaactagttacttatttcttaaaattgagagagttttttttggggggggggatctctctgaatgtcttgttttatttataattgttcttacagtgggaacattgcgcatatcttgtcttactatatctctcgccgagaattttgatgtcagcactgaaagattgatttgaaaatgatcatacgttgtaattaggttatgaacagggacactagttgtgctgttaaatgccatatgcaattcatgggacagttccatacaaaagtctatattgtcacagtcagcctttcgttagtatatagttcaagcatttaactaaaaaaacttaccagcattcgtgactcattgctagccaactcgccaattcgttgtagaattgtgttgtccatgttgttgttgtgcagtatcggaattgttcctataggacagtcgaaggtagacagatgtgcttgcaagactgcaccttctaatggcgatttaatatccaaccctactggaaaagagcttggttccatctatttgacatgtaaaactttatcaccatataataaatgattcgcaacgcacgactacttaaatagatatctacctaacaaagtgctccaatgattccaaagtgcagtttctgcgtgtatatattatgggccatatatacaaaaaagaagtcataattttccttttttatgttaaggcaaaaagtgtagggagtgcataaaggttgattcttagaacaatctagaagcaagctatggcctaccatgaatacaaaccaatagaaagaattttgctatgatgagtttgcctacagttttcagcctacgcagtatgtatcatataatcatgaatatgaaagaacctaaaaatattgttttttgcatttaaacttaaaaaaaataaattgacccaccatatgaaagcaaatctcatgtttatgaaagtggcttacctgaattttatggtctttgaacaccggatgtttaaatgttgtctgtagattcacatcaacacaatcatatatgtctccatcttgtgcctactttgatttttgagtaaatcgtattagctgtatatgaatttgttaggtgggtgtaatctagtgcatgaactcgtaaaacattcattttggtaaatgaactaggtgcgtgcgaacgaaggccaaaagaacataacaagactattcttgctaatttaagtattgattagaatgctacataaatatgtacttgagaagaatgctacataaacatgcatattttcactaaaatggtttaataaggcctataacgattgcacggagaatgatataaaaaaaccgagaaatgatacaaggggtagaacaaagaataataaagtataaaccaagtttacaaatatagtatgtttcatgctcacctcacgtgtgcacgtcctatcctaaccagcatctaacttgatagaattggccatgacatgtccttttggtcttagtttgcacccatccaacaagttcatacaccaaaacaagtattttacaagttcatgtagtaaattgcacatacctgataagtttgtatatcaccaatataatttactcttgatatttcctcttgtttgtcatcaaggatgccaaatatacaacccctcccccccccccccaaactcagaaagaaagaaagaaagaaaaagaattatttctcatacctgaatagtgatattaacttgtggacttgtgaggctttcattagctttttctctactgtttatagatttgagctcttttcctccaatagttagaagaagatatgacaagaggagagtcacttgaaaaacattgtttgctttcattttggtaatcttgagtggtctatttcatagcattagaccattgtatatataggtttagaggttccgctagttttcacttaagagatactatattggaattaatggcagatataaaatgcatttaattacacaagaaaaatcatagtattaactacacaagatatatagagtaaagaccatctcataattgcacaggtatcactgcatccctctctttgttataaatgtttaagtgaccttgttgttgtacacacattaaaaccaatacctcatttattgataagatcaatatcattaagtgaacaaagagacaaatgtcttgaattctatgaataccttctccatctgtccaaaagtttaacgactactatgttccttttagagattaagaataaagaaaaaaactatgatatctcttattaaatgagtggtggttggggagaagataataagagatggtgtttggaggtaagattgagtaaaaataaaataagggatggttggtgaagggagtattgctccataagtaggacaaaatttaaatactaaaggttcttatattttagggcaaatagagcatatctgaataagagtaagaaatttaaaataaataagtgatttcttagaatcgaatggagtagataatgtggtggacatcaccagcggctatcaggagaatgctggcggaaggcctggatgaacaccggcggcaactggtgaggttgcgagcgtgaaccaccgtgagtgtgatgacggcagcggcggcaatgggcttgaggtcatcgtcgatggctccctaaataacgacgtcatgtcataagcatgtaggcatgtactccatataaatgcaatacgtgttagctgaaatgggcaagagaaaaaaaaaagaaaaacacccgaaccatctaacatgacccatagcggaaggcactactatgcgctcgctcctcattgtgaacggattggtgctgtaggggtggcaatttccttgattgggggcacccctaatgaaaacggagcggatagtttccgtccgctccgaataaaaacggatacggatatcttttggatcggataattctcggatagtttagatgcggatacgaatacgaataattcggatacggatacgaattaaatttagccaccatatgtaagaaagccatctctttaagaaagtggcttacatcggatgtttacatgctggttgtagattcacatcaatacaatcacatatgtctccatcttctgcctacttttataattcatatatatgttagccatcaaacaataaagccaaatatagcccaaagaaaagtattcttgctcatacctgaatagccctattaacttgttggcctacgaggatttgactagagttttctccattgtttatgtatttgagctcttttcctcttatagttagaacaaaatatgacaagagggtaacttggaaaacgttatttcttttcattgcataaatcttgaatggtcaattttatagtgtagaccactgtatttatatatgtttgtaggaatccgatgttggtatttaataggtaatattttgcaattaatgcaaaatatataatatatttaattacatagaaaactatcctattaattgcacaagtaggatcgatacttcctttaggtattagactgatagcactcatttattgagagcaggtacaatagcaggctataagccagctataaacatattttaaagagataaaagaagagagaagagcagcaggctacagagctgtagccagctgcagcatggactccaagacataatgtgtgtatgaaaggtaggaccaggtataatagtatagtaaacaactattgtatgaattggctattacattgacaacattcagagcaagtttgatagtatagcccactactagctccaaattatctatagccaatgtaatagccaataagaaggacataaagggaaaaagcagaagacaagtgtcaagtaagcactctaaagtgacatgcgttatttggaatgattttttttaaaaaaaaatgaaccttttaaatataagagtaaagtccatcaccagtccctaaacttgtaccgttgtgtcatttcggtccctaaacttgcaaatcgatcgttcaaatcctcaaacttgttcgactgtgtcatccggtccttaa

SEQ ID NO: 46532 - DNA, 11519 bp, Oryza sativa
acaaagttgtagatcgcgtcgagggctacaaatttgatataaagtttgtcttcattagagttcacatgagtaagtttagggacgggggtgacacaacttaacaagttggaggacctaaatgagtgatctacaagtttagggaccgggatgatacagtcgaacaagtttgaagacctgaacggtcgatttgcgagtttatggaccgggatgacacaacgatacaattttagtgaccggtgatggactttactctcaatataaattctttgagaacttattttcagatttgtatccttttggctacgctattttcactagcaaggtataacaattttaccacggtggtgtaatatcatggtgtgattttgctacaccagtaccaccactcgtagtggcatggcaggtcagtggtactatagtaccgcccacaccattgtttgtatccttgtcctaccatgctaccacggattgatttttcttaatttaaattcttcggaattggaagtagtagttattaatgtcaagagagcaaaggcaatttaaactatgcaaaataatttttggaatgattcaaaatatcgcttagaaaaaggttgatgcatgggcttgaattctcgttttgcccgatgcaagtcctatatactccacatgtttcatatggtaagactttctagttttgctcatatacatataaaagttaaagagtaaattgcattcacggtacatcaacttagtaagttggtgtaatttagtataggaacttgagaaatgagcatgctaggacaacaacttaccaagtgggtgcaacctagtacaaaaacttaataaatgagcttatgggtacaactacttgaaatgtgggtatgattttggtacaataacttgagaagtggtgtaaaaacttaattattttgagtatttttggctatatgtactcagcttttacgtactctgttgataatacttgcctgaatcttctctctcggttactcagtggagtgatctctctcttaaattcccataaggataaggaaaagtagacggttcgaaacccgtgcttaaatcctactcaaggttatacttatgtagatttgtacaagcattttttttttgtcattctagtaattcaaggtcaaacaaattttaccatgcagaaattttctagttggtaattgagatggtgaaaaaaatatctaaatcgatggtgcaaattaggtgagcaatatattcttacatattatataagattatatctacgggaatgctatgtgatgacatattaacatcgtgaactttcatagcactcattaaccaaaatagcatatctagccaagttattgcaccaaaatactaaattatcaaattcttgtattaaagcgcacccacctaccaagttattgcacttagacgtcacattctcaagttcttgtactaaatcgcacccacctgtcaacttgttgtaccatgagtgcaatttactcaaagttaatggatctagagacatatatatgtctagattcattaacatctatatgaatgtagacaatgctgaaatgtcttacattgtgaaacggagaaagtattatttagtgcgtttgagagaagggaaaaatgagaagaaatgttgagaagatatgtagagcgaggtgggtcattatcgcataattaattgagtataaattatttcaaaacttgaaaaggaaagattggtgttaaaacacctttctcataattttttttaaaggtactgtctaacagttcgagaagcatatgtgtctggaaaaacaaccgacttttctctacttgtgcttgtgtcaaacacctaatcttggtccaaattcagttacgcctagcaaagctttgggaaattggcagtgggtggaagacgcgtcggatgagggttaaacaaggttgactagttgagtacttcaggggctaatccaagcgtacatgggccggctgaactcttaacttgggttgggcccgccgttaaactcagaaaggaaatgccatcccgcgttttccctgggaagaggactcttcctcctaaggaaaaggaagagctaagaacccgacatgtcatctagctacccacattcccttccattttaaggtcggattaggtgttgttgtaatccaacaaggtttatagcaagattgctgatgatcaccttcttctcttccgatcctcttaataatttaatgttacttatctcacatgatgtcttaaatattgtgtagaaaccatgtctcatgcaaaacatggtttcattctcttttctcatttattcacatgtcacatcatttttcatactaggtgacagcttatttaagggcaacaacaatgtatatagcaaaagtagtccatatagatgggacccacacatatggactataactattgttatcttcacaatgtatatagatagcaactagtattaagaggggagaggaaatagagagaaataacatgttttattttatatgggcaacccatatgcttatagttggcttttactattttcttgctatggactggttccataatgttgttaggtggctgaatggaatattttattgcttatggactagttttagactacattgtggatgccctactgatatagacactattctagtcattgagttgaaaattgccttaggccattcccaacccaagacactagacatagttttcataaactccacatcataaaaaaataatagtactagacactactattccaatgcaaacaccactattccatacttaaatttaatgccacctatctcacataatgtcttggatgttgtgtagaaactatgtctcatacaaaacatggtttccttctctttcctcatttaatcacttgacacatcattttttatactaggtggcaacttatttaatgctattgacacaatcctagtcattgagttaggaatggtcttagtacctattaattaataagaagatgatatggtttaaattagatgtggcattcaaatcgactataaaacttcccctgagtagatagatagatgagacttgtaaagtgagatttataaaagcccacaccactacaaagctttcttccttcctttttaaacccaacctcccaacacctttcctcactctcctccctccctccctccctctccaacacgctcacccatgcaacccaacgcccgccaaatgcgcggcggcggcggcggcggcggcggcgggcaggacgacttcttcgaccagatgctgtccacgctgccggcggtgtggtccgagctcggctccggcaagcccgcctgggacctcacggccggcgccgtaggaggaggaggaggagcctccgatgaccactccgccgcggcgttcgacgactccgcgctcctcgcctcccgcctccgccagcaccagatcgacggtggaggcgacaagcccatcatgctccaactcagcgacctccaccgtcatcacggcctcgccgccggcgatgacagcggcggcgctgccgggttccttcccctgtcgctgttcgctgaccggtcgcaggacgacatcgacgccgccttcaagtcccccaatggcgctgtacgattctatatttctatcgcttgctatatagctcaacgattacaacttgaagggtgaattgaagcttcggtttacttgagctatatatggtgtttctttgggttctcttcttcgcagagaggtgaccatgcgctgtacaatgggttcggggccgccggaatgcatggcgccgccgccatgcagccgccgccgttcgggcaggtacgcggccaagaagcggttcaacttctccccccaattcattctgcttctttaccaaggttggaaacaactcaggaatctggattgtttccttgatttttgctcaacggagtttggtttgctccctgttcgatcaattgctccactcgtaagaatgcacctcttgttttcctcatgtcaaagggaggatcaatgccggcgcagagcttcggtggcggagcggccgcgagcggcggcggcggcggcgggtcggcgtcggcggcagcggcggctggggcatcgtcgggcggaggggcggcggcgccgccgcggcagcggcagcgggcgaggagagggcaagccactgacccacacagcatcgccgaacgtgtataccactctcccaccacctttcccttctcgcccccattttttattgcctccatgccatgttgtgtgagtgtgttcttcttgctcctggagctccacaaattttggaccaacctaacaagtcaatttgacctgttgcacacttcaaatttcggctagaaatggtggtttcggtagtaagaagagcttgaaatgagatggaacttgttgtgttcttgtgatttcctgagactttgcatgtgtttgatttgcagctccggagggagaggatagctgagaggatgaaggcgttgcaggagctggtcccaaatgccaacaaggtagctgaaaattttcctcacttttgctcctcttcttttgctttgttttacttctttgcgccatctttgaacaaagtaggaagctttccttgaaatgcgatgaagatgcacccatgctttctgcttttttttttgtgtgtgtaaatatcttatcttaaaacttagtgaccagctaagtgtgttgatttattgcagtattaacacatatgttctgtttctcttacaattaacatgatgtgatatcttcattcttcactgtatgattggaaaatagtaagtgcatcatagggtaggaaagaggggacatgaggcatatgatgcattgctgatttgatgttctgatgcttacactgacacatgttggcctttcattggagtatttgggttggtgattagctgctaacggtggtgaatgacacgtgtcgggctttcgttggatgatttgggttggtgattagatgctaattgatggtgaaggcagtagtggggaaagggaggtcagacatgatgccgaaatgaatgagaaatgtttctacccgttaggccaccaacagtaacagatgaatagccacagctcaaatttaggggaatgcagattaaactatggacttgatcattgcattagccaccaggttcctagagaactgaacatcaagaaaggaatggattagtactaggtgttatataatatatgcacatgtcttaacttcgagacatgcatttatacttggactatgtgacggctgcaaaacacaagaacaggagacacgggcacttgtctaatgttccagcctcgtctgttctccatgaactggatagagagcactacaagtcccacagctacatgccatggttggcacttctggagcttccagcgtcacgtctgatatcttgttttgcacaaactgtaatctgttttgtagtatctgaagcgataatgggtgctgatctgatgggatttggaataaaaactgacatccatcttcatatcttagctgatagggttgctccagcacaaagtagagtgacacggatcactgtcactgaaatgacgatgtggaatttcgttttgcagaccgacaaggcatcgatgctcgacgagatcattgattatgtgaagttcctccagctccaagtcaaggtaatctaaccctgcttttctacagatagatgaattcctgcctgttgctaataagttagtcccttgaatgtctcaaatcgcgcaggttctcagcatgagcagattggggggagcttctgcagtcgcgcctctagtggctaacatgtcatcagaggtacttatattatatgatgctttattttgaaaatctagagcactaccaatgacgcaatcaatggttaatggtactaggcgaggacttgctgatatgtgtaggacaaacatgtttagcccaaaatgctataatgatgtttattacagcacaaagtgactagggaaagtgttatcttttttaccatcaggttggtgataataggtagtcattatctgtcctctttaaagttagtgtattgattctgatgcatttaactttctttatttttataaacgagcaaatggttatctcttgtctaaagtagatctgtcaagaagttcatataatggaatataagcatgttaaatcttatcagtgattctaactttggcatttggaggactagaagtcagacgagttactaaaaacaaatgcatgcttgcaaaatagcataaatcaaaaggagatgtgccataaatttgcttaagaaactgatcaaaccttagtgggtaccaacgcaacaaaaagataaggtcggaaggaatcttggtagttcaagaattggatccaaaaaggacaaacacgcctgaaaagtgacaaggtagtactactgaaaaaaaaaatcaagcataatagtattagcctgtagaagctactaacccactaaggacaattcaaaccccttaagtctgaacacacactagcagccgagctaccataaggtcaactacctcaaatgtgacaaaaacgcccatcaattccacatcacctctctgttgaagaaatggcacagagattttacaatctcgagtcatttgctcaaattttaggtgtgtttttttgcagagtaatgggaatggcaatgccaccagcagcagcgggaacggcgaggcggccaatggcagcagcaacggcgacaacaatggtggcggcacactgcgggtgacggagcagcaggtggcgaagctgatggaggaggacatgggctccgccatgcagtacctgcaggggaaggggctatgcctgatgccgatctctctcgcaacggccatctcctccgccacctcctcgtcgctcctcccccgcactgggggaggcgctggagggtccctacatgaaggtggtaatggtacatcaccaccattggtgaatggcaccgccaccggatgtgacgacgccggaggtaaacagtgaggttggacagtgtccatgggaaagttgagtgatcaggatatgtcttctaattctaggggtggaattgtgaaatggcgatgctcttttctttgcctctctctctctctcttttgttttgtttataagaaaaatgatgttaagcatgcgagctttagttccagcttttcttgttgatatggtatagtagcttttctgatatctttcctcctctccttttgagcaattgagctttgagctgctctctaatataatctctagcagtattcttttctgttaaatttgtcgtggagctgtcgtttctcctgctgaatgaagactgtagaggtaaggaggaatcgaaattattggtccagaagggaccctgatcatattctgattcaaaaaaaatatcagagtacttcgtagcctggaacaggcatcaagtgcaaaggtttgtcgttggagttgaagtttgtgcgtgaatcagggataggatatgctctgctctctaacagcagcttaagctgtaaagtctccttcacgctgatgcaatccaggcgctttccggaccatcagacatatagaagattagatgcagaaacaacaggctgtacctgttcctgaaaattacctacagaatgtgtataagaaattatatatctaacacttgagctggaacagttaggtttccccttacgacgaagcaccaatgattgcgatgcaggaggcaacaaagttgaatgatatgaagagggcaaggtgatatgttcatacatgctagctatgctactactccaaactgcaatattccttcgttgctttcaactcgcacgtcgcgatgggctggcttcaagtaaacaaatccagaaggaatgatatgatgaatagattcaaggattcggacgggagatgcacccacgttggtgaagtaaatgaagggcatctttggtcgtgctctaaacaaaaatatcgcagtgacaactctgatggatgagttaatacaatgaaaaatagtctagaattgctctagagaaaaccaaaatacaagactggacacaagatgatgaaaaaattttaatgcgagacagatgaagccgcacaactgttgcaaaaaggaaaatgaaccgaaacaaaggccaagggattctcaaccttctgcctgaaatttggaatctcaaaggcactagaaaatggagtaacaaaccgcattactaacagagactgtaatagtaatagatatttcaagtgtaaagcctaacaaaaaggttaacagcgacgatacattgatgtgaacgtacccaactttactttggggtagattccttcctagccatgaaaagcagtggatgtattataactacagaaggaaagaagaattccttccctggtgtaaaagcagaagagaactactgtaccgtgcaccaaaaataagcagcaggttgcagggatggggaaagctgcttggggattgcacggcaaatggattacatgacacatcaaaccatccctcttgttttggacatccatgattaaatgctgagcctgttgcagaattatcataggcgagaatcacctaaaggagacagcattggaatcactggaaaggcagcattataaatcaaacaagggataaatcatgatcaagtgggtgtttcgccctccatactttaaacgataaatggatagacccaacccgctttgaaccacatggtttaatgttcatcacttatcatgttcaaatctagcatatctccatattataagaactcaatgagctctggtgatatgtcatgtttaactccaaactctactctagcccatttttactggtactcaatgaacaccagagtcctgacagttttaccccttcctttctaactgatgttggatgatgttatcaaattaatagggctggtggatgaagctatagcagacaaaacagtaaataaaaagaagaaacttcatgccatctgagaaagtagaactcaccaaatctatgtagcagatgcagatacatcatacaaagaataaattagaacttcaactaatctatactgcttcacgtattgatggttctctttcttttagaagcattaggcgctttatctcccgacttagatttctttgttgcttctgattcaagagactcttccaatttctttagagctttgatcacccagtcagaaaaaaaaagattaaatttaacacaaatcatatgagtaataatgcattagtgcatcttaaacaaaacagactgcaaccttaccagaggaaaaaactgggcgaagggtttctaccgattcctctggtagtgaatgaagactgcagctagaattatctgccttcttgagcattttgtcaaaagccttaacctgcaaagacagcccaaataaaaagaaaagagttagaatgagattttagacttatggcacctgctctcagtattcaattaggcattcttttagtgaaataaagtagaaaggttacacagaccatagttatccacacatctggacatatgttgcaataaaaaataagcatcaggtgttttatgcattggtaagtcctaaaccaaaacagaaagtcccagtgctaggtaatcggtggtgccccttctgttttctacaccatatcaattagcgtcaatctaacatataccaagtcaataaatactcaacttcttttctatgtttttaaacatcacaaatacaggcatgcgattaatctttcatgtgcaagcttcctacacatatagtcatatcatgtaattaccatgtcatattaataaaatcaactcactgtatattattgtactagaagaacggaaaactacttataattgttcagcaatgtattacctcatgtttccttaaaaatgtgaagcaagaaccagactctcccgcccgagcagtacgacctgctcggtggatgtatgtttttacatacggtggcatgtcataattgataacatatcttaagccatcaatatgaattcctcgagccattctatctgtaccaatcagaacatctatcttcccttccttgaaggcatccagtgtcttcctgcaaaaaatatgtgttgctaatcccgtaacttatcatggtgtgaataagttcaacataccaaaaattacatcctatcatcaacagaagttacataggtcttgcagttcaaacttcaaatccacatgatccagaaaatattatgatccatagaacttgaacaaggaatggtcagctagatatgatatttgcatactatttttatgttgtctatttgctaacagctccatgaaactgaacttacctccgagtcgattcacgttgcaaacgtgaatattcactaaatttgaagggcaagtcttcgaaaaattccagcaaggtgctcagtctgtgactggattccacagatgaagtaaaaactaaacatttttccccacgcagctcttggagaagaacaatcagagatagtggttttaaatttgatttacagacctgcaggtgcaacgcatcatcaagatgaacaagaaaatacagaatttccaaatagacttttacacattggatgcaccagcactaaagatgtaacggctaaaaatgtgctacatagagatgaggacaaaccagcttgtaggactgaagctttgttggaattctgtagcgcttctttccactattcaacagcaagggatgttgcaactcaagttgagaaagcttgctaggatcttgagtcagtgtggcagacaaaactatcttcgccaatcttggaaaggatttacctttaaaaccacgctcaacacccctatatgccatagcatagattaatcaagttttgaattgaagtacagatcaacaaacaatcctcagagctacaatagcaggaagggctgaatcataacgcataagtattacaagtaatatgtgaactttactaaaaggggagtgtaaaatactaaaatatgacaatgtaattaggtagtgtgggactaacgatcgtctaatggtagtcaatggatgcagtagagtttctccgttcatgtctgaccaggaatggttttgatcactcgagcgagtaagctggataactgttggcaaccaagactgataagcttctctcaacatcctgtccgtctcatcaacaacctgaaatgtcaatatattaagtagaaattaaaggcactaaaaagatggaaaagaagactcttagtgctaaaatcaaagtgcatatccaagcataaactgctggtctggtcaatccaataattatgtgaaaccaacataaggtaaaatatattaataaactattttccttattccaagctgtcctggaataatcatgttcttgctattgctgattgaacaaaagaacaaacaagtaatcttaggaaaagtaagcaagcggggaagattaagggggtggaatataactcaagaggacacatagattgttcccatcaacctaccaggtattgaagatgctccaggctgaaaccttttgtcatgctgatatgatccatcagtcttccaggagttgccaccaatatatcaactttagtctgtggttccatttggatatattcttcatcaaga

SEQ ID NO: 46533 - DNA, 3548 bp, Oryza sativa
ctgttctggttagactagcatgtagaaggtaaaaggaacagcacaaacctgcaatgctaaatcccttgtaggtagcacaaccaaagcacgcaagcaccttacttttcgagtagcgagcatttgaacgataggcaaagcataagcaagagtcttgccagatccagttggggagttaatacagatatccctctcaaaagcaccaggaccaatagtttccagccatgctgctacttgaactggaaaaaatgattctatccccattctctgcaatggcttcaccaacctaaagcagtaaaacatagccaacacaggagtaaacatgttagtatttcttaacagcatgaagtattaaaagcatcctttctaagtacctcaacaaaattaactgcactgaaaacgcattcaagaatagcgagggaataaaggagattcgcaagcaaaacaactgaaattacaaactctcttagaaccaaacaagatgggtcatgggtgcatatgtgtgttttagagctaaccgaacttgtacaaattccaactctgaatactcggacaccagctgaacactattagcttagtgaaattacacaacgccattgatgtccagttggagtaacatcttatggtcacacacaaatcgcctaatcccagaattacaaatcaaccgtgaccaaaaaaaaaaaaaggaaaaacctacttgatagttcataccccacgaggatgcaaactaattagcatcctcaccgcatagttatcgacagctaagttcattccatgcataaaactttcacagtgccacgacgcctaggagctcgcgtccaagctagcgaatcgcttattcaagtgatcgaaagtatacaaaaagaggggggtgtggaggggggggggagctcacctgggatcgagacggggaaggtgcgcgacggggcagccggagaaggagtcgatgtcgacggggttccgcatccacggaaggtgaggcacgcggctcgacggcccaccctcctcctccttcgtcgccatggccaccaccatcacacgccgaggacgacgattcaaccgccaaccagggtcgtcgccgtcgccggcgccggtgagtagaactcgcaccgagaggcgacaggcgaggaggtgagtaagcggcggcggcgaattagggcgtggagtagtgtgatgaattcgcggaggccgccgcagcgcggggaagacaacgggccatcttctcgtgggccgcaagcaaaccaagcaggccacgttttcgtgggcctcaggcaaagtagacaggccgagaataaataggccgcgtctgcccgtgcggtggcccattccatttcccccggggtccacccgcacccttcccttccaccgcaagctttcccgttgcggtgcggatcccccacctcttctccgccgcctcgctctccgggatggacccctccgccgccgccgccgccgccgacgacgacgacgactaccacgccaccacgggtgggatggagccgcgtggagaggaggacaacggcgccagtacaaggggcgtcaccggtcggctactcgcttggcgcggggaagaggaagacgacgatgacgcggaggattcgggaggagggagcggagcaggcgccaacgccgacgaagacgacgcggcctccgctgtttcccttgacaccatcagcaacgactcgatcctgcttccgccggagccgacgagcgccaacctggcgagcctcctccgcgcgaggaagctgatcctcgtcgtggacttggaccacacgctcatcaactccaccagattcgcccacctctccgacgacgagaaagccaacgggttcacggagcgcaccggagatgatcggagcaggggcctgttccgaatggggctcttccggatgatcaccaagctcaggccgttcgtccatgaattcctgcgagaagcgagcgccatgttcgagatgcacgtgtacaccctcgggaacaggaactacgccacggcggtcgccaagctgctcgaccccgacggcgcctacttcggcgaacggatcatatcgagcggcgagtcgtcgcagccggacaggaagagcctcggcgacgtcttcgggtgggcgccggagatggagcgagccgcggtggtcatcctcgacgacacggcggaggtctggaaggggtacagggacaacctgatcgagatggagaggtacctctacttcgcgtcgagccgcggcaagttcgggatcgcggtgaggtccctggcggagcggaaccgggacgagagcgagcgcgagggcgcgctcgccgtggcgctgcgcgtcctgcggcgagtccatggggaattcttctccggctcggtgtgcagcggcagcttcgcggacgtcagggaggtgatcaggcaggcgcggcgcgaggtgctgcgcgggtgcacggtggcgttcaccggggtcatcccaagcggcgacggcggccgcgccagcgaccaccccgtgtggaggagagccgagcagctcggcgccacctgcgccgacgacgtcggcgagggggtcacccacttcgtcgccgggaaaccggtcacccgcaaggcgctgtgggcgcagacccacggcaagtttctcgttgacacggagtggatcaacgccgcgcatttccggtggagcaagccggaggagagaatgtaccccgtgaaaggcgagcattgaggacattggaatggcggcggcggcgacgggcggcggtgcactggaatggcgttcatgatgccgtcgagatcgatatgcttcggatcgaagttgaggctgccaatcttggtctggcaatggtcgtgcagcgatgttgattttgattcgttgggtgcactgtattctgtaggaaatcgatctggaaatgaaccaatacagtactactgaccaaagatgatagcgaacgaggtaaaggttagaactctagatcagcgtaaaccatctcttgtattcttcgatatacgcagattctgatcatatatagcgacgccatatgtttctttgcccgcatttttcggttgggcgtcgatcgactcgatcgccgatctctttttagcagaaagtcttgcgttctctctcttcaatgcaaccatctttgtcttgggaagtgtctggttatcgtgcgcttaccgtggagtacagaaaggattaccggtttgctaaatgtgttcgaatttaaattttgggaaaaaaaacaaaaatcttttaaaagttgctagaagtagtgcaacacctaagagcacacatccaagccattgaatcggttgttcaagtgaagtgatcaggatcgaagggaaaggaaaaagtacaccgaaggtccctcaacttgtcatcgagttacagaatcgtccctcaaccgcaaaaccagatatatgacatccctcaacttacaaaaccggtcacaataggtcattcggtggttttcacaccagtttaatcctatgtggcggctgagtcagcgtgggacccatatgccaatatgccatgtctctctccgttccttctctctctcacccttctcttctcttcttcggcaagccg

SEQ ID NO: 46534 - DNA, 32411 bp, Oryza sativa
  unsure (1)..(32411): unsure at all n locations
ggaacagcgacaacctgatcgagatggagagataccactacttcgcgtcgagctgccgggacttcgggtcgccgtgggagtgcacgcactccctgtcggagcggggcgtggacgagagcgagcgcgccgcggcactgcgcgtcctgcggcgagtccacgcgggcttcttcgccggcggcggcggcagcttcgtcgcggacgtcagggaggtgatcaggcggacgcggcgcgaggtgctgctcgggtgcacggtggcgttcacccgggcgatcgccagcgacgaccaccactccgtgtggaggagaaccgagcagctcggcgccacctgcgcagacgacgtcggcccggaggtcacccatgtcgtcgccacgaacccgacgacgttcaaggcggtgtgggcgcaggtgttcggcaagttgctcgtcaacccagagtggatcaacgccgcgcatttccggtggagcaagcccaaggaggaacacttccccgtccgttggtaaaccggatcgaagttgagattgtcagttacctcgccaccagcattttccagtgttgcacgtactggtatgccaatttcattgcatcgagcagtatcgtttgacagaaaaccccccttacaaatcttgcaaattttgaaccatccgattgctttaagattcatgcaggcaaccaaactctaaaaatcctctcgcctctctctctcccgattcatcacgcgccgccgctcctccgccctagcgcgccgccgcccggcctcgccggctggccgaatggtgtcaacggcgctcgcgaggcccccccgaccggccccctccctctccctctcctctcctttgcctcaagccggtggcgacgagctgtccgtcgtcttccccgtcgccggcggcggggcgccaccaccggccgcctcctccccactctttccgctttgcccccgccgccgtcctccagccccgcggcttcagcggcgccgccgccgcccgcctgatccgccgggctgccgcctcccacggccatccctctaaagccggcgaactcccccttcttccccctccccctcccccccacccccaccccaccctgggaccctaattcgtcagccctctaccggagtttgggtttgccggcgccggagaagaagaggtggtcgccggagttggagaagaaaagcacgaatcgtgaagcacatctagtgatccaaaatttgcaagatttgaggtaggattttctgtcgacagagctttagcaattccgtaaaactaaactttgtggaagtatctatatattgtcattctttgagactcttatcttagcgacatgcatgcatgcatctagaaaaagtggttgtgccttatattatggaatggagggagtatatactttggtggaacaggaaactatagctaatgatgtattttgtaaggtgcaataacctaagttttgtattggaaataacgggatttatgtctacatatatacatatggcacacaacaccatacatctcatctagtttctttaattatcagcactgagctcctttattagtgggcttgctggaggctagagcccaagcagttaggctgaggaagtgaggatggtgctcgctggctagtctgatatgtatacgggggctaaggacatgatatgtgctccctccgttttacaatataacactttttagcattgcctatgtacatatagatgttaataaatttaaacacatacatatgtctaaatttattaacatctaaatgaatgtggacaatgctacaaaatcttacattgtgaaacggaggaagtatatgcgatgcgtcggctacatcagagtttcatctcgttgagtctgggttttgatcttgcaccttatctaacgttttaaaactttgaccttttggtttctgcaaacaaattaaagacttatgggccttagcctataggtttagacaatgtaggccaagttattgaattgcctacaagtatgaaagtaccaaattacctataagtgcaaaaggctcgttctgtctacaatctaaccttgtcggtggtgtaattatgggcaattagtgtcacccatcgaactgctattggtcggtcaagtgggccatgaatgtgtcatttttttctttccagctaaactcacataatcgtatatatcatgcctctagataggggccacgtaatcatggtaactcaccgtaccatggtaccgaggaggtaccaatgataattttaggtatcacaaatattttattgttgcattatagagatagtgatatagtaagagtatgatgatatatccatggcacccactacttagaatgtattctctatacctatctatacctatctagttcatccccacttagtgtaattgctaccatttaccatttatatgtattctcatgcttccatatcacataaattgatttggacctgcgttagcgaaaaaaaaaagattcaaaccattaattagatcagagcagtgtggtcagatcgatactaaacatcatggtcatgactagacatagctaaaattagaggtagtaaccacttccactataaaacttgctcttagcaagctgtctgtaaggcttttcgggccatatcgtaagaggtttgtagagtatgaagtcaattaaaatggtttggctaaattttggtggagtaaggaatatgttcatgtccttatatattttcacactagacaatgtatgaaacatgggaatttcgctatcgtcacgtcatgatacaataacatctcttgtaaatatatgtccttttattttttggggaaacatgttggcattgcctcagatgttcaggtttggttggcaagagaagagacaagagggtgaagaagccgacatgtgggttccacgctgactcagtcaggttgaccactatcaagttgtcatgtgagccaaaaccggaaactatactgccctagaaccagtggcggagctaggtttggaggaggagggggctcagccttcttcttcctcctccagccccctctctccccccattttcttcttcctctccctcttttccctcctctcctccctcacatttccatggagtccagcagggtaggggggctcgagccccctccaccgctgcctaggatctcaggtacaccaatacacaattcaaacacgtcaaagacgaagggcttaaagtgaacttattccctcaacgcacgcacaacactgaattaagtgtggcgaaaacaacgggaaatcggcccatttcctatatcctggcccaatatcaatccatttttctagggaaaaagtgcgccgaaggtccctcaacttgtcatcgggatacaaaaacgtcctcgaaccgcaaaaccggatatacagggtcccttaactatataaaaccgatcacctgagatcctttggtggttttgaccccggtttttgtctacacggcggctgagtcggtgtgggacccacgtggaccccacatgtcagcgtgccacatcaccacccattacttcccctttcttttttctcttccttttgatacttctctttgccgtgagggagtagcacacggaacaggcagcagcgagccgggttgaccggcggtcgacgcaggtggcctacgagcgcgcggcggccggcgaagcggagaagagcggaggcgcggagtggcggtggcggcaggcgggcgagcgtggtggccggcgtcctcctcctcctccaccgccgcatcgacggtgtgtgccctgtttctctcggtggtcgtcggcgtcgccatggtagtcgtcggagtctgttagcaacccgatgcaccaagcaaatagcaacaatatctaaaccaatttgaggtgaaattgagcaagtagctgagtattacaagcttctagaaggttctatagagggagacaggaagggtgtagtggctggtaggaaggagtagtgagggagagagatcgacaaggttcctgcccaaacctggtcgccgctgccgccgtggccgaagccgccgattgccagttctgttctatttcccctcctctcctgtaagctgctgttgcccttgtattgtttcagcttgggcttgcttgggcttcttggcaacgggttgcctagcggcccatgtgtagcccagccgagaccctgacaatcccttcttcttgaaattcggcttgtccccaagtcgatgaagaaaacctcctggatcgaatgatgtttgaagttcctcttgtaaaacttgatgctcaagtacagcaaccataccaatctgtgtaggagcatcagataaccaggcgttgcatagcatgatcaaccatgcatatatcccagtcattaccaccatatgattgtcccttcttggattgaattcaagtaaaccggccatggagaatctggatagtactgcactaaatgtattccactccaccaccagtataacctcatgtatctcctctgatgcatgtactaatcttagcccactagaaagaaactgaggattgatagacaattcggtgagcacttgccatgcaactgtagctatcagttttgtatactgtagagagtatgtgtgtcgctcaataatctgatccactaaatgtgtttcagccacctgattaagcaagaaaggcaattgatttccatactttattccatagttatcggtgttctgttggctatacatgcattcttcaccttggatgacatttgcattagttggcaacaagcaatctaaagtattagccaagatgagcccttgagcaccactactgtgtaaagccagatctgggattttcttgagtgcatcactgtagatatcatccaagttttcttcaccttggaacttccatgcataaggtttcagataatcatttagctttgccggctggaacgaggccttcatcacctcccgcaccgccaccggctgcgcgcggtcgacgagcatggagaggagcagtgacaggttctgcttcagcgtgcggagcgccgggcggatgcgggcgtcagcgacaccgccgacatagagcccatcgtagaacgagtggtgcgagtcgaggaagatgaggcggtacgcggcgacctcggcgacgtgtccgaccgcggattgcgccgcggcgcgcgcgcggtcgaagtgggagcacggcgcgaggaggcgggcggtggcggcggacgacgacgacgagcacctgccgcgggagaagaaggagagcgacttgtcgagcgcgtggacgtggctgaggatgaagtggagcgtgttgagccggacgtagaggcgctacgtgccgcggctggtcgacgggcgcgggttctggccgccggacgccatgccgccctggccttggtggtgcccgtgggcgcgcgggctcgacacgggcacctggcacggcgtcgccaccttcttccacagcctgatgattatcgagtcctggttgcacctcgtcagcggcggcagcgacgggcacgcaccgtgtccttccattatcccagctacccgcgttctcacaatggaggcaccgtggagttcatgtctctcggccggagcaagaacgccatcgtcggcatcgaagaatggctacactacttattcatccaatcacagaatctccaatatgatatagtactactatttactagtataggaatgaatattcagggttagtcgtacactcataccataaactactacttgcatgctccatggctatcacaattgtatgacaaaatgaagatccactttcttgtctctcatgctcgtcctcaactgaaacaagacctccaaaaagcttcaggatcaaccaaaccattacatacacaacatacagactataaaccttcacaatcatcgatcacaggctataaacaatgacgaatcaagcaataaaaaggagatttttttaaaaaaatatcatattttcacggtgtctggtgtcgctagcggcgaagaacggcggcctgtacgtcatggagatgtatccccggggagacggccatgtcaccttcgaggtgctcgcctacggccgccacagccagccgccgcccgcctacgtcggcagcagcggctgggccagatgcagcatccaactcgaggactggcactggcgcgccctcccgcagcctccctacgtgcagtacccgggctacgaacgcgacgaggcgccgccgtgaaacacccttattacaatatcacggcgaccgcggtggtcggcgactcacgtctctggatatcgacggagggcgtccgcacgtccgcctttgacacggtgcgagatacctagagcaagcagggcgagtgggcgctgctgttcaggggcaacgccgagcacgtcgcggagcacgacctctggttcggcctctcgcgccacggcgacaagctgtgcgccctgcggcagcacccaccaccctttgaccgcttgacgcggagctccccgccggcctcctcccctccccacccgccggtggtctgcagagagagagagagagagagagaggaggaagggagagaagatgggaaataaagggtggtgacatggcacactgacatgtggggtcccacgctgattcagccgtcacgtagaccaaaatcgggatcaaaaccaccgaatgatctcgggtgaccggttttatataattaagagataccgtatatctgtttttacggttcgaggacgtttttatatccgatgacaagttgagggaccttcagtgtactttttcctttttctagtgcacatgaaaaggacaatttcaaaattgagattttgcgagcaggggcgatctgtggccgtccattcgttgtggacgttaaatcgaccccgtcgatttgtgatagaggttacgccgcatctgcgcgacccgctaccacccacacatcttcccgtctcaaaacaaaaagaaacaaaagaaaaaaaaaatccccatttctctaaaaatctagaggcttcttctcttctcctctctctcgttccccttcgtttcgattcgtctcgcccaaatcttcaaatccaaatccgcagcggaggcggccggggcgcggcggccagatcctggaagagaatccattccgggaggggaatccgcgcatgccaatgtcggatcccacggcggcggtcatccccaagccggggggcatcggcgtcggcggcggaggcggcgacgacgaggagccggtggagatccgggaggtgtgggcggacaacctcgaggaggagttcgcgctgatccgcgacgtcgtcgacgagttccccttcgtcgccatggacacggagttccctggcatcgtgtgccgccccgtcggcgccttccgctccccggccgactacaactacgccacgctcaaggccaacgtcgacatgctccacctcatccagctcggcctcaccttctccagcccgcgcggcgagctccccgcgctcggcccaggccgccgccgatgcgtatggcagtttaatttccgcgagttcgacgacgcccgcgacatcttcgcctctgactccattgagctcctgcgccgtagcggcatcgacttccgccgcaactccgagcgcggcgttgacgctcgccggttcgcggagctgctcatgtcctctggcgtcgtgcttaacgattctgtatattgggtcaccttccacgcgggctacgacttcgggtacctgcttaagatcctcacatgcagcagcctaccggacacgcaagccggcttctttaagctcatgaagatatatttccccaccgtgtatgacatcaagcacctcatgaagttctgcaatagcctgcacggtgggctgaacaagctcgccgagctccttgacgtggagcgcgtcggagagtcccaccaggccggttcagatagcttggtcacttcatgcgcgttctggaagctcaaggattcgttcttcgctggctctaccgagaaatatgctggagtgctgtatgggctcaatgcggagaatgttgtcagtgcgcattgatggatggtactcctctttgaattttagctttgtgaatggattgatttaggacagaaaatgtgacaaatgatcaagatgatgttatgtaggtcaagtttgtctcactccatttgggtttaatgtgatcctagtgttcttcagttattcgcgatgaaatagtgaactgtatttatgttaagttgttctgtccgctttcattttctcctacctggtttagttagataggaaagaaaaatcacctttaaggattaggagatggtaaaatgaatatattttgttgctgttttgtcattgatatgtatagcatggaagctggttgtttccaaagagtggggtgcgggtacatcaaagtgctcaaacatgtaacttgataacattacaatacaatacacagagcgcgacctctcttcacatgggtattttagatgctgttattttaatttcccagaataattagttactctaatatgtatccttctagagaataacacaatgcaatattgagaataagggcatctctctatttcgactttgtgctgcagtttttggtaatctgaggtaatgctatctggtctacattggaagcctggaaacatttacggttttcagccaaagttttctactatttgttcatcaattcaattatccagtaagcctactgcctagcgaatagttctgggcttctggccaatgttcactaggcaaaacctctgtactccatggagtaaaactacagtgaaatcctgcaaatatgcaaattctgcagatttgctaacaaaatattagatacgcatctagctatatgtgtctcttgatccagcaattaagtcacaatgatgcacagagcatgaatactagcagtttactttttccataataggttgtgggttacagtaacaaatatgcatgtcttgagacagtgatgctgatactatttcccttgccttcctgcaacacttggattgaatttctacttatccaacttatattctagatacaacattgatccatttacattctttgtgaaaaacttatcataactagatgagctttgaccacaagttacatcattccctgcaatttaatagcatcagattatttcattgctggatgtaccggaccactcttttttgctttgcaactagaatattagttcctttggcactaacatgtcctcaaatgttgcatgtggagatgaaatctagggcatttaattaagttactaacgagtttatttacaggttctgttggaacccaatttagagaagaatctagttagctacatcttctcgttttattaagactcaacttggacactaccttaatcccggttgattgccattgtccagtttatttaaattcatgtatataatcggtccttcttaagttcggacattgttggagagctattctgaataaaggtaatggtggctaacaagaaacaaggtaaggattgttagaaactggagaagtttgggtgccaaaaagcttcaaaagtattgaaattgtctaatgtttcatattttgcaggtaaacctgataatactttcctagtgtatcattttttaacgggatgcatttctggtgttaaaatgtggtactcgtcatgccaacttgtgcatgggttcaatttgaagactgagaagccttgtgcacgcatgaactttcttcatcacagattgatggcagcagcagcctatctcaattccccaaatctccagggatgagatcaaaccatctgcattgcacaagcttcctcccatggataatgcaaatgtgtaatgcttatgcaattgtaatgtgtagtgttaaacagttgtggtcatttttgtgagatctgaatactgattccataaatcggggctggccagaaacaagtgcttattgcatccagagaacatgttttcagtttgcctcacaatttcactaaaaatatcagtacagatttgttaacctccaaaaagggaacacagaaggcgagctaatatgcaagtttacatcatgcaaagaaatggcctgaagtttacattagaaagaattaacatttttcctgtcaagtctctattgacaatgaaaatcttaagcaggcaggagtcgttctatcatccctggcttaccgtcaagatctttttctcaaaacaccgtaattggatcaaaagttcaaaacagttgccatcttaagtaatgcagcgcagtgcactgttcaccctctaatctgcaggttcttagtgtaattctgcgttttttggctgcaaccacaaagacagtcgggtgagttatatttgccgtgtgtgctcataagcagcaactgttcatagcctacccatttacttttcacgtgatgtctatcttgctggcacgtatgatcaattggtccatttcttcgtccatatctatttgatctcctgctatcatctgaggaatattttgtggcacaatgtcagcattaatatatgccccaagcaatgacttgtacaggggcaagcttgtcaagttgaacttttgaagaacctttatgaatctatctgcatcctccacactgccttgctcctcgaaatactttgcaatggcctccaacagctcaagtggaggtctccagtggcaagtcttcaacagagataagcccttcttcatggcattgacagctttatccatctgcttactctgaacaaatccctccatcagtatctcccaagtcttgtaattcggatgcgcacctttctctagcatgtggagatgaagcctctcagccttttcgatccatccattcctcacataagcaccaaggagaacatttgaaacccgcacatcgtgcttcttgctttctgcttcccagcttccaaaggtccactcggcccgaccaatgtcgccaacttttatcaagcataccatagcagacatgtagtttgcagcagggattctacctggaacaattttactagcctcccacagcctaataaccccatctctgtcattcagggctgcataacatgtcataatgaaagagtaccctaaacgccctgttgatgacaactttgtttcagccgttctaaggcaagcaagagctttactgctctgtccatacttcttgaagatgttagctaatgtacagtatgtgctccaaccaacctcaaccatgtcatcattcagcatctccttgaatgctgattgtactgaggctaagccagagacctcagcacatgcattcatccaaatgttgtaggacagaacatttcttggaatgttgttccgtttcatcagataaattacactaaggaccttctcatactggcacgttgcaacatatagtttcataatttcattgaaagaatgaggatcgacaggcagtccatatctctgcagctcagccatgaaggtttcagctttctgcacatttctttctgtaacatagcaatggagaagcgggaatgacgcggccttcttggaagcagcagtacttagttttctgtagtactcctcagcttgagaagtaccatgaacttttgcaatcaaatccagtctaaccatatgatctgagggcgatagtctaaaatcattgtgcgagtccatccatgataaaatctgcagcataataaaattccgtttaggtagtgccccttgcatcgccactgcgcgatatagattggaacagcaataaacattcagctgagctgtgcaagtgtgtcaataaatcatataacaaagagtgaaacaatgttcactttgcagcataacattataaggaattattaagaagtttgaatcaaattgttgcaaaggtgaaaaagactcctatgtcctatctgtatcagatttttctcggttcaaattcgttcatcaggtagagctgtttggagtgtgctcacctccagggcttgctcgtagcggcgcgcgcggcgaagccggacgacgtcacggcggagctccggcggcgagacgcggccgcgctcccgagcccatctctcgacggcggcggccgcggcggcgcgcccgctcttcctcgggatccggaggaggcaccgcgacagtaggtcgccgccgtcgccgtcctcgcgagcagtcgccggaggagcggaggaggaggaggaggagcagcagaagggtctagggtttgggcgggaggcgccgacgaggagggcgagaaggcgcgagcggcgcacgacggcggccatgggcccaaacaatccatgggcttgcttgctttaagaaagtttaccttcttctcaatccctttttttaaaaaaaaaattagtaaatttcagaaaactgcaactatagtcataaaactgtagtgtgctgcaacattagtgatctatttcagtttgctgtaataataacgtggaaaattatcacaaaattacaacttttacgtgatatgcgtagaagttacagtttcgtgataatttatcacgctattgttctagcaaactggtagttttgtgactataattgcagttttttaaaatttactcaaaaagaaatgaagtgatagcataaatttgtatctcaattatagtggatgaaaatttagacatgtttttaaaaggctaactcatacgtgagacctaaccggattctacaacttcagtttcgctcccaattattttagataatagattaaaccggcctctgcatccaaacatatatgcacagccaagaagctccccaaatatatgtcctaaaatgtaaatccagccgcgccacggctgtctgtgccaaaccaggacgaggaagaagaaactgacagtaagctcaggtttatacaagccatcaatgtctctctttctaggtcgagttggcaacccatctcgtcctccagattactactacaatacatatattgacatagatacacaggcctagactagattacatcacaaactaacactgctagctagtacacagcatacaatggggggacatgtacacagatgcagacgagagatctgtcatatgcaagctccaagggagtagaaatcgccgcaccccaggtcgtcgctgaaggtaacatcatccttctcctgcatggaaatcgagtgtcagatagcgaaacagcgccgtcaacaagatgactattgcttctgatggtcttatcatcagcgaaaatggttcaataagtttgctggtatgtgtcacttttgtgtaatcttaatatggatgtcatggtaaaaaaaattaggtgaaggaaaaaatccttaccactttgactatggaattgagaaggccgtcgaagctgcagctgctagagctaagttcgctctgaagtttcgggatgctcaaatcggaggcgttcttcggcatcgccatatctcccgaaacgaggaaatctgtcttcatttgtgggataactgttgaaccacttgaggttgcttgcccaatcattctggcaccaatattgctactgttactactgctattgttccatctttggctcatagcatgatgagccccaatgttgcttgccaattgagagctcggtacagaactccatacgaacttgagatcaaacagactgtctgcagtcctatcatcgaacttctgtttcaaaccgtttccacctccaaaattcaagtacttttgctctgtatctggaggtaaaagcatcgcgccaccaaaagagctagctccaccttttgtgtctcttgctaccataaggtcatttgaagagcgagcaggtgcacacgatgaagatgtaccacccaatttgtttgcacaggtattgttaaacgaaccatggattagcaacccgttggcggaaaatcctgataaaggaatagtactctgctgggatacacgagattcaagcagaccagatgaaactccaacggcgccttcaatatgttctgaacttacagaggaagttcgaattgatggctgactgacaattttggcttgtgtgcactcggctagttcttgaggcagcaaaggactgcttgtgacactttggagtgtgccagacataccattagataggccattcccagaaaggatggtggacagatcatcggtttcttcatggatccacttctgttgcatttgggtctgcccaagcgatgttgccaaaccttgtcccaagtttcctttctggtttcctggtaagctaaggtggtacttatttgcatcattaatggaatggctcaatgtatggcttccgctcatagtctgaatcgattttgaagcaggtaccccctgagttccaagagctgctggattgtttctaggactgtttaacaatccatgtggagtaaaagatgatagagctgcggaagaggtaaaagcttgataaccctgtagtccttcaaatccacccatgtgcagaaaggggtctctacctcccaaagcagcaacgatgctaacttgttgcgacgccacagcgcttagccgtttgagatagagcctgtacttctgcgtggtacacaaagcttgagattagactctgcaaacaagttgtagtgtttatctgtgaacaatttgcttttagtgtctcagcatgagtcacagaatagcaccggaacttgtttttggttcaccatatatgtggttgctaaatctgctagaaggtttagagaagtgctgaaaaatgtacggccttttcctcaacttaaaggccactcatttaattgttacagaatctgctcttggaagcagaggggcaaagtacacaagactcaagttagaataggccttaaatgtgtaatagctctgtgttgataaaggatgccacagtgactttctatcagccatatttaatacagtattgtaaaacagtcagcgcacaattcattggtattgaagaacttctgaattcggttaatatttcttcagggccttagtaaagttgaaagatggtctatcttaagctatagtttcctctgaacagtaaaaacttgtagtgcaattaattacaatagctgctagctgtggtacagatttgttctattcaaattacatcattaccagtacatgctaataaatagaagatagtgaaatgagttccttgcctgtaggtgacttgcaacattttcccttgtgagtttctcaacattcatgagctcaagtatcctttttggcacagcctctgcataaatagaaaaaaattataatctcatcttttcacttatgcttatgcttattagccaaaaattgaattttcaaccttaaatttggagttgattttggggtttttttcatcgtagtttattttttagcctttgcttttagatcgttaagaacacgtatataaaagttttattcacaaattatttttcatttgcaaatatgtcgtttagttttttcctccaatatgccaaacgatggggccgtttctctctctctctctccaaaaaggaaaagattagggtgtaacatgagtcaccataaaaaaattgtgaacagcaaaatggaggcagtggtgagaacatactgtcaattccaagctggttgacagcagcgacaaatttccggtgtagttcaactgaccaaacaactctcggcttctttggagccgagggatcatcaatatcttgagtattgacctcaccctcatcctcctcttcactacagtactccttcctcttcttgctgggcctcccactttgatcaggtgatccacatgtaacatggccatgcacatggtctgaatccgcatttggtggcttgttgcactcttcatagaaatcgagattagcacggtcgcgagtactgaatttcctcctgataacatgctgccagatattcctgagctcttcgattcgaacaggttttaggagatagtcgcaggcaccatgggttatccccttcaatacagttttggtctctccattcacagataacactgcaaggaaattactaattggttaacatcaacatttccccctacccgtcatagaaggaaataagtacagtacagtgctcaggatttgctgaataaactgaaattgaattgatgctctgcagatacaagaaaaatcttcactcacagtggctattactatcaagaacagttgaactggattattggatagctctgagaagggataagattcatgacttactgatgacagggaggtccatttcaagccccacaagctcaagaagcttaaagccgtccatgtctggcatatggacgtcgctgataactagatcaaacatgtccctgttttcccgcagcattttcagcgcgatagcagcctgatttgttgtcgtcactggaaaaacaaaacaaaaattactctttcaagtgaatagctgttgaagatacaggaaggcatctgcgacaacaacaattcaccctaaacccccccccccaaaaaaaaaaaaaattgcagcatgcatttcttttatcaacaatgacaccataaatccagatcatgtaaacaatttacaactagacatctctgtagctgcatgcagcatatatagtatacgataacttcatgaaatattttattgaataaacataaagcattaggcaaaattctgaagaacatacatatagacatctaacaataaaatttgtaagaattgatattgctgttccaagacaaaaaaaaaaaccaagactgaactgcaaaaagaaaagaagaagtatttaccatgatactggcagcgcagcagcagggtctcgagcaccttgagacacaccgggtcgtcgtcgacggcgaggacacgcataccgacggggaactggtccctcctcctcgccgccggcaccacacccttcctctcctccgccgccctcatggcaacaaaaaacctcccaatccaattcacagcacaaaacccaagaacagcaagaaacctcccaatcgatgaagcaaatcaagaacaaaaaccaaccaccttataaccaaagttgcaggatgctgggaagcagatgtgggcaggggaagattgggattcagcttcaaggcaggcctcccaatccccagcaagaaagcaaaggcaaagagcccaaaggtacaaaaccaacaacctactactactgctcctgctgctgctgctgctccccaactagaacaggaaaagagaaagggagaagcaaaatggaaagaaagaagctggtggtggatttggacagggagaggagagagctggagagagtgggcatggagcttcaggaccaaacccaccaccatctccaccaccccatcattattgaggcaaagaggtgggaaagcaaaagggagggagttggagaagaaagcagagttctctctctctctctctctctctctgcagccaaaaaaataaactaaaaaaatgggaggaaaaaagcagagacactgactgttccagatggccaagcaagcaagcaaccaacctcagcttcagctcacacacatgtgaactactcctagctcagcagcagcagccaccacaactcccagcaagaaaacaagaggagattggagcaagaacagcaagaacatctcaagggagaagaagatgagggagagaatgtaagtagactgtccatctgtctgaattttaaggggtcaaaaatggtggagggcaacagaaattggggcccatttcatccacaagctccaaccgatcgctacagacgaaacgccatccctctgtagtctgtagtatgtactaccccgcaccggcgaaattcttgcgtctgtaaattttgtattgtatctcatgtatcaattggacggggcaaaaaataattttccatgaacatgttaaattggtactagtagtaatgtttttttttctgaggccttaaattagtagaaaatgggcattccatatgacaattccgtatctcatttttaactttttttaaaaaaaatatcattatttttttgagaatttttttggaacaaattttctgattaaaatgatccaaacttttaagagttgtggaaacggatgagacacatctcgatcacacaagtgaatatagcattgcaagctagtagtatcaacttgccacgcacaaatgaatagtatcgcacagtgactgtactcctacattgagggccttttgatttggagaaaaaaaaatataagagtaggagtttaggatgattccaaccctataagaaaatttcctaggaaaccctttaaaataaaggattgaatcatattgtatgctttaaaattcctatagaatgaataatcctagaaagattttgtgaagaaaatttagcaagagtttcaacctcttagaaattttcctttgaatctatccctttataagattattgtgtttttcctgtgattcaatgaaatggttattcttgtgtttctcctatattttataatcctctgttttgtacatgcaattgttattagaattatacgttttttttctatttcttcccttttttttcattggcccctacggagtaccaccaaacagtataataccatatacatatttactgcttgtataaaaatactgtagtaattatagagaagcgtacacgaacagaagacatatgcttgccttaacaactttagattcttcacacggtataccactactgcagctgggccccaaattataatcatccaatggagcaaacaaagacgacctgatctctggatctacaagtagttaatggtaaaacaccattaaccccaaagtaaaactccccttaaatgcgtgcctttaattgacgccatttactaacgcttttaataaccatccattaaagctttggatgattgattggaagggggcaccactccctcgcacacgaacgagattacgagatgaagattgtcacgaaaatgcccgaccgaccgagcgtgcttttttgtacggtctcattttctaaaacatgatataaacgaagacgctcataaacacacatcatatccttattagcatctttaaaatcctaatttaattactccctctatccaaaaatataatgtacaatcatgttttttcatgcctcataatataaaacatatgcgtatatatattaactagcacctcgatcctctaaatttggtttgttttaaaccatcgagctcttcaattatattgcttgtatgcatgaatgcgatccaaccaatgagaatgattaagggccagtttgttttgaggcctaaattaggcttgccaatttttttggcaaccttaacaataattgtgtatgtttggattgaagccaaattttgacatgcctatataacataggccattttaatagccaaattagtttaatttggcttcaatccaaacacatgttggccttaccaaaaattggcatgccaaaacttgtcaaaattgccaaattttggtaaggccaacattggtcacaaaccaaactggccctaattttttttcttaatctttatgttacgagtggtgagcatttttttttatagatggagtagcatctttgaaagactggactaatataacttaggattgataaagtaacacgtgtatattgtcacacattgaaaaataataattagacgtaaatacaagcatctatatcaagtccaggacttgaactcatgtgaatcggtttctaatcaattgagttatgctcacttcaccatacgatattattctaaccctatataaaataataattctaaatcatttcaatcttgtattaccatctccactaaataattagaatgacaaaaacaatcgatcatcggttaaagtgatagtagttttagatattgtttccgaccgttttcacccctagcggcgcacacacaaatcacctctatttcccgtgctcgcgcgcgcgcgcgcgcacggtgggggcggccacacggggggtcgtgggggtgtcgatgcggtggtttttcgcgcgcagccagccccctttgtcgtctcgtctgccacccacgtccccatggcgctgctgctgctgctgctccttgctgcaacctgcaactctgcaaggccaacaagacaagcggaggcagcagtagcaggagggcatatgcctcgtttcccggactctccttccatctcatcccttggttgacccatgggtttgaccatctcaaccgttgattgatcccacatttttttaagcaaaaggtatagtcaatgagtactccctccatcctaaaatatattccatatctcaaaatatgaagaattttaaatagataggacattttctagtactatgaatctggacagactctctgtacaaatttatttaactatcaaatgttccatctgtttaaaatctcttatattttaggatggagaaaaagtaaatagtattgaataagaagaagagagtataaataaacaataattatgtgcgttaaaaaggaggttgtatacaataaacaatagttaattagtatttaataattgaacggttaaacatttaaagacactaaggcaaagatggtactacactaagcttagtatttgcaaatggattaattatgtggactaataagtgtttacactcatatactgccaggacatgagagaggagactgtaatttgtaaatagctgcatgtgtgggtttcttgtcattttgttcatctttctcgtgaagttttttgcgtgaaaaggggaaaactggacgtgccggtataaagtgagccagtactacaattcactgcctatatatgccacgtactcgatccaacctgctacgttgaaaacttttgcgtccatgactcactgcacgttgcttccggcgatgaactatcaagcgtcatatgcattcacgtaagctatatatatatatattattcccttctcctaaaatataaaatattttatataaatgtaatatatttaggatcataaatctgatttgactttctgttaagatttatagtcacacacccacctatttttttttcatattttagtacggatggagtatatgtattggcccacatcaatttaagtcagataatgcatcaggtgtttgcatgcttaattacgaccgttaattgtgacagcggggcatacatggctaccttcaatacgggtcaacatttactgttcacttctttttaaagcccgtttgaatgcgagaaattgtatgtgttcacttcacgtggaagtatgaaataaaatatactaggatacctcctctccggaacgcaaaacgatatttgcattaacatgtgattaattgaatattagctattttttaaaaaaaattgattaatatgattttttaagcaactttcgtatagaaacttttttttaaaaaacgtaccgtttaatagtttgaaaaacgtgcgcacggaaaaccatgatagggagttgggaactcccaacaaagaacgcaccctaattaagtactcttttatattcatcaccatataaagtactttcataaactatacacgaatttctattagtcaatgataaaaaaaattaactggcttaacaccaagtaatttaaacggaagtaatatatatgttttaacttttattaaaggtgactttttatactaatttaagaacgtgttcaacctataacctatacatatatgtatcgttagcaaactcctttttttatgccatacatgacttgtgtgtcgcataaacatccgcgagcacccaatagtacgatgataacactaaattaatattctccccgcttcaaaatttagcaatctatgaactaaattcatagtgttaggttggatctaatctcatacataaattgttatattttgagacgagtaataattaacatatttaaagtactcatctcacacttttcccccgcatgatgcaacgtttaccgacagtttatagcttccaacaaacaaatgagaagatggttgcatttaatttaattagcttgtgtgattggtgagtggtgaccaaacattatgtcatcgatcgatcccatgcatgcatccacgcccaattttttcatatacaccctccgtccctaaatatttaacgtcgttgacttttttatgatatgtttggccgttcgtcttattcaaaagatttaagtaattattaattctttttctatcatttgattaactgttaaattcacttttatgtatatatatatttcacaaaagtttttgaataagacgaatggtcaaatatacttaaaaaaaatcaacggtgtcaaatatttaaggatgaatggagtatatttttctccgatccatggagcacgcgtatagaagttcacaaaacatatggtaactaaaaaaatattcacagcatttttttctgcagggaaatattcacatcattttcacaggccacgtaagaaaagaataatattcgtcgtatgaagtcattataatcttcctttatggatatctagaaggcatatgcatgcatgcattctgcgatattaatatatatatgtaaccggcgctgccggccacgtggttaattagacagttaattagttgatgatgccaggtggtgtttaattactgtggaaaacttctactagacgtctgaatatcttgttgccctgatgataattagtatactgataaatggttttaattaactaggcatcttagtcagcttcacttaagtgcagatcttaaggtagctaggcccagtcatagttccaaactttttttttcaaacttacaacttttccataacataaaaacttttctatacacacataaacttctaacttttccattacatcgttacaatttcaatcaaactttcaattttaaccaaacttttaattttgacgtgaactaaacacagctctagtggggttttttttcttccaaatagctaaatgattgaataatgtatgtgatcactattcgagagcacaaacgaatggattaaacattatgaagttaaagaatagatctaaactagttttgtcgaaattcacatataaaagttttttttctcaaaaatcgtatagtttgggtgcacgtaaaacatgtggcatatattaatcgatcgattaatccttccttagaaaaatgttcaagggtcttccgactagttccacaaggtggtggctagactatctgggttcggagcctcaccccttttaattatttgatattaggttatttcctaatatttgccttttttttattaattcttcctttaaaaaaaagagtaggttgatttaatgctaattgcattgccatgtctatttttttttctttttgtgtggatgacgtcgcacgcgaacacgattcgaaccgaagtccatttttcctgcgcgtgtacatagtatatacgtacgcgtgtagtggacggttgcttttcatctgctttcttcagagaagctctatgtttattatgatacgcatgcacgtcgctcttatatatgtttctataatattatgcgatgattctcaatcatgcatgtttcaatattacctaaccatttcaaaattgaacgcgatctcaattatttaactacatatacgcatgcatgtgtgtatatatatacagtacgtacaccaccggctgcatgccggccaatgatcgatatgatctggacctgcttttgctagcttaatttactcgtatttataattttttttgactgaattatttataattgtttgtaaacactgctccctccattccaaattgatggtacaccaagaccaagaaaagctaataactctctcatattatatttactctagcaacaaacttgatgcatgcatcatccacactattttctagccaatagaaaatcaagatattgcatgtgggttataaatacttgtgtggatgcatgcatcaatgcccatttactccaatgcaccaataacgaatagacttaatgaataaacacaaatatatagatcatttaagaataaccttaaaaaaattatatgcagatcaattttgaatgaagggagtagtatacatgcctcttactacatatttttggatcgatcacttgagaatttatggatggagggcacaagctgcattcacgtacgacaaatgcgatctacacccaatctttgcgcgtaaatttctgatcgatctgcatttaattcactctccatcgaaagttcatttaagagctagctaggggccgaccatcgatccatcccagaagtaattactactctagttattgatctgggcccttcatgcaaggtcgaacccatcaacatgcacgtaatataagctgtgtttagttccacgctaaaattaaaagtttaaagaaattagaacaatacgatggaaaatttgtaaatttgtgtgtaggaaagtttgatatgacggaaaagttgaaagtttgaagaaaaaagttaaaatctaaacatggccatactctacatctaaaaataacacataagattaagtggtgagatgaaaaagagaaatgaggaaaaatatatgtatcacctttaatcatgtaaggggcaatcttcacacaactaaaaaaaagaaaaaaaagtgaattggacaaacaaataaaataaaattattggggttagtgtgctacagtacagaggtaatataaagatgatgtattgtatataccacctttatagataaaattgaaggtgtcaactacctttgctataaaacttgttcctatattactcgtttaattataattagcatttaactgcgacgctaaaacgcacgcttgcatgcatggtacaatattggtactgcaggagtatatatatgtacgacgcgcatgctacctgcagtatgtacatgtccctcgtctgtgcgttgcacgcaccgttttagaacgcaaggtaatattggtttaactttgatcgatcatatataaacataattaaaaatataaatttcaggtatctgaagaaaaatggatgtatatatagtctaccataacgagagatttcttcatagtattacacttatgtaatttctaaaatttatatcgaagggctagatagtcaaatttttatccccgcaaaaaaaaaggatagtcaaatttatagagtataatgttaacttagaaaagtcacacacggcttgtttatgctaccagaggaaatagctgtataattaattaattaattaattaagcccgacttacgtacgtactctttctataaaagaaacttaattgcaagctattggtcaacaaattagtggtaagggtaggggccgggtgagcagaaaaaaaactgaaccgaaaagaccgagaccgagaaattcgatcctagacagtcaaagaccgatttttttcgatcaatttggttagtctcctcgggtaactgaataaactgaaaagactgaattaaaaaaatgtttaaatgcaacataaaatccactaagttcaataggactagactctaattttttcacatccctacttcttctaagcatgcaacctaacaagagtctttattcatatgtgcttacaatttctttttttgatttttgtgttggcatttttcactatttttttgcatatataaaaatgttgttgaatttcggtcaggaccgagaccgagaccgaatttgtcagtcctgacatttttgcgttgaaattcggtcttcacattccaaagaccgaaatgaccaaaagaccaagactgaaattttcggtcaggttgtatgcccacccctacgtaagggtaagtgcgcccctcacaaatacacataaacacatataccctacatcttaaattatatggtgcaattaacaccaatataaagaccaagaaagaattattatcacctttcgtttggataactccaataaatacaatgcatacacccaatgggattagagattttgagagggtggatgattttgaaaaagaaataattaaagaggagagagatgtgctagtttattgcatcatgcgtgctttatattatgaaacattgaaaaatatggttgtgtcttatattttgggatggagaaagtaagaaaagtaatattgcaaattggtagttaagggatactgagagcaagtactataaggatatatgtgttggtctaaaagtgtcgcataagataagtacttgatgagatctactccagaagaaaagtgatgagagagactatgagctagtcactagttatacaagaggcaatctacatatataatctccaaagaagagcacacaacgaatgtgagatagtgtgaaagtgaacataaggctgtcatgggttggcctaataatgttgattattttcatacagcttattaataaaaacttatttatgagcatcacttttatatatgtcatagcgactttaaaggcaatgcataaaaataaacttttcttttgagatggaaataataaatctcaatagcatcaaaatcaatttcaaaattaaattttacaattcaattttggtaacgatttataagctgtatgataaaagataggtatagtatatgacatggctaaaattaaggtagcacattcactataaaacttgctctcttaatttaggaacacaacttcttccattcccagatcgatcaaggatcaatatataagttgggacaaagttgcaaggctaattaaagtctttttagggtggaatagtaattttgaattttgatttggtggttgttttagttccaccaccagcttgtcataaactatatattccatgctgctagctagctagatttggcctagatcgatagctagcacttgcaaatttattaggtttggagctttgggatcctacgctgatcatagagagatcgatcacttatatataggcactcgctgtcgtgatagatcacatagtcctaacacatgagatcctgtaagattatggagtatcacacaggtcatgccaagttgtagaatcaattaattaacggcggccgtggcgtctgaagaaagaacagctagcagtggtaaaaaaaaaaaagaaatcaaagatatgtgcctgccatgtcatttatcacatgctacgtacaacgtgttggcacatacagtaactgatgagcaattcaagctatgcattagggtgcatttctttttagctaacgattacatgttatcacggacatgtttttttaaaaaagtttataataaacacggtactttttcaatggaatatgagcaatgctagcgcaataaatgaccacacatcaatctagccggaaaaaaaaataaagggtaaatagctaaagtggtcctccaagttttaattatctgaggctcagtttagtccttgacattttaatctatccatattagtccttcaagttttcgttttagttcaaaattatccttgaacttacttagaagccacatggctaaacataaccaacaactctcttgataaatgacacttatactcccctcattcacatatataagagaaaaaattgcatgcaatgatttttttatagataatgcatagtaatttatgtaaaacgaaaataaattatgtacttgcaggtgtatacgatagccattgtttaagtttcatgtgcatatgttgaaataatgggaaatacatctgcaatattgtttatttattttgattttcccttttctaatgtatagttgcatacaaattaagggcaaaacggacattttgcaatggaaatattgactacaaatatccatatggcatattaagtgggcccaaggatgattttaagccaaaacaaatacttagaggacctatgtggataaaataaaacctgaaggaccaaattgtgccttcggtgaaatttgcgggactaaattagctattcacccaaaaataaatgacaaagttacttctagtcaatgtattagtaaattactaatttacccttaataacaaacggatcatatcatttctatcgatagtataatactactagtagaaagcaccggagcatcactcaatattgaattcattcattcatgccatcaaataattgttatgaacaacgcaatttcacaaatcatccatagacactttagagtttagaacgcatcatatccttaggccagattaaccaaaagaacatcaataagcaggactatatatagcaagtactttctgagacgaatattattggtgatcccgggtacccgggtacgtacaaatcagggtgcatgaacgacatagcaaaggcaggactaacaaaaacggaaggcaaatatatatatatatatatatatatatatatatatatatatatatatatatatatatatatatatatatatatatatatatatatatatatatatgcatgcatcagtgtgcattcagatcggaagtggtatatagtgtgtgtgtgctgttggtaagaataaagcgtgcgtggcaataacattatatctgtgtgggcgattgtgcgtctctttttctcacatggaaattttgagagcagagatcgaatcgatcgtcgaagaacgtacggtcctcaaccaattaataagcacatatatatcgtcttgagatatcgatcgagctggcgactgactagctagtaaaattgtttgaatttttctagacaaactgtattaagtttgatcaagtttataataaaatttagcaacatctaaaatattaaataagtctcattaaatctaacattgaatatattttgacaatatatttattttgtgttgaaaatactactgtaattttattaaatcaaatattttttattagaaaaaagaaaaggtctaacgactttaaaggaaaggaagtactgtatattgttgtacgcatgctagcaagcaaatgcaaggggcagtctggcagtgcatatatgatagcgtaatgatgatttgttcctgcggctccctccgagcactggtgaccagtttaggttatgtttagttcacataaaaattagaaattcgattgaaattgaaacgatgtgacagaaaagttggaagtttgtgtgtatagaaaagtttcgatgggatgaaaaagttagaagttttaaaaaaaagttagaaactaaacaggccttaggagtacatgttggtcaggaggacgcattctgcatttctgcggcaaaatcaatcgtattttccgtcgtggtgacacgtcgcggctcgccggggccgggctacgagcgtgaggtccccgcccgttgcagactcagcccagcccggcacgtacttccaacttgcctcgccgtgcgcggagaagaatagtgggccggcccaacttgtcggtgcaccactgcacctgcacgttcgtgggtatcgcgttacggcccatactgctctcgggctgcctgtctacaatacatgggccaacatcgtcataccagtccacttctgacggtatgagcttttgccgtttctccttgcttcttgcatttcgatgacgacaacgtactctcttcgtctcctactttaatcatttgtcttgcttaaaatactaggcacaaatatatttaaaataagacggacaatcaaaaacttatggttgcacttaaaataggacggagggagtaaatgctgcttgaaacaatgttaaatctagaaagagtcgctcaaaggcatatggtacctgagtttctgcaatcaattcgaattaatcgattcccttcttttgcatttgcacatctgcagctaatagtacaaactgaataataataagtaagaaaacagaaccccagagggctcgtaaactgaactacagaacattgctactacatatctcctgcttccactaagctcccctcgattcagctcacggctaacactttctcatcgcatctccatttctccatccaagctgctacccacaagtatacatctgttctccaatctgatgaaactcacactgaccattcttgtgcagcatcagaattcagaacacactccttttccttcacataagctgtctcccttccctgtcagattcttcgtcttcttcttcttcctccatacgatcatggagcaacgacagctattgcacggttagtagattgtgacaagtgacaacggctaaaaacgatggaatcagctgctctccagtttcatctcttgccgaatctcaagcacttgttgtgttttacttcggtcatgttattgttcgaggacgacggcgccaactggggcgctttggctgtcttatccttggagagcttctccatcgcgttgatgaacttcctcagatgcctgatgtattcagggtacgtctccaggttgcagtggccgccacctttcacccataagggctcgtacttctccttcgcgagctcccatagccgcttgccgtgggagaaatcgacgatgtcgtctgctgtgccctgccattgtcattcagcaggtaagttctgagttctgatcacaccaaccggggaaaaaaaaaacagttgagagcagcaatgaactatctcagaacttaataaagtcttagcatgttttctgttgaactgtaactagtaattggacatgagatatatactgaaaagtaaatttgaagatgatttcagacttgaatatcaatgaaaagctaaggaggctttgaatcagaaatgaaaagggtacaagctactcacatgtataaccagcactggacagtcaacctgctttattttgtcgatgttctgcagacatgttagcagtaaccagattaggatggtaaatgacagtcgttttagaagcaaactgaaatcatggtccagagttccagacataccttgaagatatcaaaccaaagtgttacttttaccggatatagaacccgaatgcctgaaagtatagcactgtgaaggacaacccctcttaatttttccaagcgcgaggctaaatgcaatgttggtccacttccaactgattgtccatacaagattagatcctctggttcaatcccgtacaccttcgttaaacagtcataaacagcctctatgtcacagtatgtgttgtattctgatggcttttgaagcagaaaacatgataagaaaaggaacaaaattaggtatgtcttccacaaggcgaacaattacctagcttaattacttattgtaagttcgtagaaaggaaaacatttactatcgttcgttctgatcatcagaaagaattcgttaatcaacaaaaccatgtgccacatatgggaacaactgaacaagcacacatgccactttatgagctagtactacttaaccaagttcttcaagtagggatcgataatcaatcacctagaagttggggttgatggtcccttggtataacaactttgacaaaaggatgactaacagaacaaagttgccatcatggtcgagaatagcagaaagcatgtgtgactttttccgatattcataatgaaagtaaaattgaaaaaggctaaacagccatttgccaaagtcctattccagatgaggccaagaaagacagaatggctaataataattgctttgagaaaagctgcccatatacctatagaagaacaggatgttgattatgaaaaaagcaagggaaacaatccaatccaaagattgtcgcttgagtcattgatgaaaatatggcataaacatacaggagacatcatgatcacaaaaaagtttaggtgacaatctattcaaagaagacaagtttactgcaaattaacctaagaatcaagtttgagctcttaaaatcactgaggaattcagaatcttactttgcctgtagaggccccatatcctgaataatcatagctgcagaacgaaaccaagtaaaaagttcagtcacatgtaacacacaatattggtcatgtccatcaaaggaaaattgtcatgatattaatttgacacaattgtccatgttttatatatttattgatggaaataaatttcaaatcccatgaggatcaaatagcaacttttccagtaggggaaattctttcgttcttaaagttaaaaggcaggcatcaactggatccccaaaaggtgaaatagataccatttgaatgtgaagttcgacaggactccatccgaaataatttatagcagaattattcatgatacatttttactctatccacacagcaagactatatgcaaattatcaatccacgatccaaatgccacaaacagttataacagtattataagaataagatgccaagcactattctcttacaaaaatgatgctctgtaatccttgtatattttaagagaactgcaacaaacaatgccgtaaaatttttttaccccagttccccaatctagagaaatgccacaattctaacaaatgactagaatcgctgaaactgaattcgaaagcaatagcagcagatcacacacagcagcatgcatctgcattggagcagaatctgacagtataaagtacaatgaatcatccaaaaaaaagtacagtcttaacctcgtcggatggcaacctggcaagaactaaaatctaaaacggagggaagaaacgatctgtttttcaactcttccataattgtggtcaggccatcaggatatccaagaaactaaatctaaacataaaagcagaagtcaaagcatttattcaggaaaggagtggtcgtcatttaatcaaacgagcagttcgttcctaacattgaaggtgnnnnnnnnnnnnnnnnnnnnnnnnnnnnnnnnnnnnnnnnnnn

SEQ ID NO: 46535 - DNA, 1051 bp, Oryza sativa
tcggggtcgagcagcttggcgaccgccgccgcgtagtccctgtccccgagggtgtacacacgtgcatctcgaacatggcgctcgcttctcgcaggaagccatggacgaacggcctgagcttggtgatgaacgccgagaaccagctggcatgatccaatatgaacaggcccctccccggatcatctgtgacgagctccgccaacccgttgacgtactccgtgccggagatatcgtaatccgcggtggagttgacgagcgtgtggtccaagtccacgacgaggatcagcttcctcgcccgcaggaggctcgccaggtggccgctcgtcggctccggcgggagcacgatcgagtcggtgctggtggcgccatgggaaacggcggcggcggcgtcgtctgctccgctccctcctcccgaatcttccgcgtcgagatctccctcctttcccccggcgattccaccagggttaggagcggcccctgcactggcgtcgtcctccacctctccccccagatccatcccaccagtgggcggcggcggaggggtccattccggcgagcgaggctgccggagaggttggcgatcggcgccgcaacgggaagtgtgcggtggaagggaagggagcgggtggtgcccggaggaaatgaattgaaatggggggaaatgaaattgggcgcggccgtgccaatttgttcccacccgcggggggaaggaggatgggcccgtaaaatgccaccgcatggcccacgcagcccagttattctcggccttcctgctttgcttgctgctcgtgagtcgtgacatttcccttaggaaaaagtacaccgaaggtccctcaacttgtcattgagttataaactcgtcccccaaccgcaaaaccagatattcagcgtcccttaactaatcaaaaccggtcacaataggtccttcggtggttttgacaccggttttatcctacgtggcggctgaatcagcgtgagcccacgtgtcaggatgccacgtcactctccctccctcctctctctctctctcactcttctcttctcttctctt

SEQ ID NO: 46536 - DNA, 8038 bp, Oryza sativa
  unsure (1)..(8038): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaggtttctcttgtcacaatgttgaaatggcaccagagcatcaatctgttctttttaactgtttcaagatcggtcagagttttgacattaatttaagtcttgccaattaaccatgcatcatcatcatagtttcttcacatatttctgtccttgtgattgtctttcttgtctgctctgctctgccctaccctgtatatgactaattcatcaagaaaaaaaaaagggtctcttatctgttcttttctctatgatctgtacgtgctgtattattgtatcagtacaggtataatcgcaatcttgttgtgatcatcgcactagcgtgtatacgtataaacaaataataccacaaatgttcttggcctgtcttaggtgagctgttgttgtatacggtgtgtaaacaaatgaaaaagtccaaagggggagcataatatagataagataattgaggagatgacaagacggtggaaggatctgctcagagatttgcttacctggaagcagattcttcaaaagagaccctgcattgcatgtggcctctcagccctgatgtcgttggaatgtacagtgctaattccagattatgaaaagagatctgaagaaaataaaaatctgagagagagagatgcattcagattggttagcaactgttaggtcaggtacaggaactgttctgatttcttgcgattttctggaacgtcaaagttggagagcctggattggacgtgttggttcgttggaatagtttttggtttgcttgcgaggaaaagtccacgaaaacactgtgcgatatgccatgccatgtttttttgcttgatcgcttcagctgtgtgtgtgagcacgtctgactttgaccttgatttgtttactggttaaaaacgatgtactcaaacatttttatttcttttgtccatctccgtttgattgctacgcatggacgtttcacttgtgtagataaatcaaacattttttttccctggacgacaggtcgtctctcgtctgctcctcgttgcatctctacactcaaaatctaacctgcacgtactccaaatcctgattgatagtgaaatcgcttttctttgggtctaaattcgtgttgaattagtactagcttaaacggcacgaatggaatcagcttgatgagaaactttccttttctcttgacgacattgcattgattgcattgcacggttaagacggtcactaaactcttccggccgggcaccattaatttcaccagtcaccactgctccaactgaacgtcacatgaccaatcggctacagtagcagtatcttaaatgcgttaatggaaaaatgtataagggcaagtataagcctctgcatgttgcccctaaatttaccacataaggcactgtttagattctctaaaatagtaaaagttttgtcattttatagcactttttgccattttggatctaaacactagtagcaaaagttggcaatttggtatttggcatttgctagtacatagtagcaaattgtgccaaaaagtgctttgggaccactccctctctctttctctctctcactttagtgctagaatgacaaaactttaacatgcatctaaacaccaactagtacttttgtaatgccaaaacttttgccaccaagacttttgccatttgccatttgccattccaaatggatctaaacatgccctaagattaggtgatgagttggaggagagaagttaggagagagagaaaatgagccacctctcatgtaaggggcaacctccacacaatctccaagaaaaatataagatgatgtgagagtaaattaatgttggggtttgtgaactataggtggcatgttgtacttgttacctcttaattaatgagaatatgacatggtttaaattagatatggcactcacctccattataaaaatttccctaagggcacccacaatggttatctataagctctctacaagagatacatgtcagcatattttcctacttggaagagattaaatgaagagagagagtaaaactatctactaatctggggatagtctatagagaaaaacgaggcaatggattagagagctatagatacccatgtagacatactattgaggtggtttactattaatctaatctattgctgagatgtacatattttatagagagcaccttattttaccattgcgggtggtctaatactacctccgccccaatataaatgtagttgtcgtttttgtgtccaatgtttaattgttcgtcttatttaagaaatttatgaaaagattagaaaaaataagtcatgcataaagtattatttatattttatcatctaataacaataaaaataccaatcataaaaaatttttaaacaagataaacggtaaaacgttgaatacggaaactcctaactacaattaaaataaaacggagatagtagttcgtcatatctcgtcctagatcagtttttctctagacggagatcgagcgtactggcgattccgattctctacgggaaaaacccaaccaaacgcatcgatcgcgcgtacggggagagttgatggccgaggccgtatgcagatacgagacagcgacgggcgcacgcaacacggcccgggtgggtcgtgtagcgtgcgtgcgagagtgcgtcgcggcgcgtgtggggacccgacgggatcgtatcccgtgtgtggtacgtggtgtacggggggaggtgggggcgttgtacttaaactaagctagtaaaccctgtgtgctttggttcagttgctacttgccagttgccactgccacggccgctgcttctcgtgggatcctctttttaacaactggtccatcccctaagctaggagtacttaattatggtgtacgtggaagcggttcctctgacgtgaactaaccgataacgtggtcattgataggtcggcccataagcggtgggcctaacctgtcagtgaccacgttcctctgatttcatgtcatacgatcccaatcagatgtacgtttaggtctatacattgccacctgaagctacctctctaactatgtgtattgatgtgtatattatatagtactagtagatattgtttcggagagtgaattttaaactctcgagaaacgttcactcgttttttcatgtcactcaagtagttataaaataaattaagaagatgtatagcatataatcactctgcaaatatgcaagttgaaattcaaattttacatgttaaaaaaaattaaactacaactagttaatgtatattcgcaattaaatttatttttcctcgaaaaaaatgttttttcattgtaacatgtagaagttaattttacatttcatgtttgtggaatgatctgtcacatgttaatctatcttgttgattttctaaaaaaaatataaccatttgagtgatatgcaaacaacgaggaaatatctcctcgagagtttaaaatagtttcccaattattttgtcattactttttctaactactttacgcagggtgtgtttgattaccagtcatactttgcagctaaaagtatggcgtggcaaaatgtagctaggaaccaaacacctccacggtattttctcatgtgcagtggtgaatccagaaaacaaactagataaagctacaatcatctctctcatctatgtatggtaaaaaaaatagcggtgagggcttcatcagggctcttagagtcttcacgctaatagtggagactcgagaccccgctaccatatactggatccgctcctgctcgcgtgaagttctaatatttgtatatttaagtttttgaggtttaacggcacgtattttacaacgtcatttatttgtaaacggaagcactcctgtacgaaaaacaggtgcagcacatggtcacattgcatttaccagatgggagtacattagtagatgaaaatgaatgacgacctcgcattcgcgtagaatggacgacacaagcagagctgtcaggttgtgtacagtgtatgcaaattgagaaccccagatgtcgtacatgaagtttaccctgtcgtccacagtaggccatagacgtgtccggtgcaactaggcacgtgctacggttgaggcctccatgactgaacatcgttgcatggccagaccatgggcgttggcgttggcgttggcatggctgtcatcccatggagaagcatccaaatctcggggattacgggaaagggatcacgacgagcgaggcaaaccgcgcatacaatcgagagggcagaggcgacaagcgagaagaaccgagacctggggctacctgccgtcaggtggaaccaaatactccaatcccagccccaggtcatgcaaaacggcaggcagccatccacattccaccaggctacggtggtgttcttttctcttaaaaataaaaataaagatcaatctacttatgtaaaataagttggtattaacgtataattaattaagttttaattattataaacttaaaaagtatattcatatgatattttagaataactttcatataaaaagttttcgcacgaaacacactatttatcagtttaaaaaacgtgtcatgaaaatttttatcttcatccaaaactctatagaaatgaactggacagctctctcgtatttggcatatccacgagggaaacgtgggcgtggaaaccatgagcgctcgcggctcgctcgcgcgggttttgcatggcatggaggcgcggtctggtggttgattggtcggggggatcgcgtcgcctcgcgcctcgcccgcgacacgaacgcgatcgcgggggatttgaccgcaggatcgcgggggagatctcgcgcggtggaccgccacccgaccgcttgatagcggccagcgccgacgcggacgcttggccttcccatgccgctggccgctgccactggctggatcgatcggcacggtcgatcggggttgggctcatccggacccctactagaatagggaacactagtacggtacttaccactgtagtcctgagtgtcacaggagagagatctacccaccagcagtaacagctaatggtttcaaaggaagggactgtttggcacagctttagctccagcttcacctcttctggagctggagctcagccaaaaatagtttcggctcaatcaaaactaggagtggagctgagtggagctctctcacaaaataaactagagttgtggagctgggtttaggcagctccacaactctactccagactcaactcctagagttaaatttaggagttggagctgtaccaaacaagcccgaagcttttagattttagtaagaaacagctaatggtaatttagctgatgagtctataatttgggaatacaatcttatggtttttataggactccgtatatattttttaaaactttaccataagctacttaaaaagaagtataatggcatggttccaatttttcctaaaaagaatatcagccatgcatgtggcgtgcattcacccagtgaagaaggtaaggaactagagagtgaaaacataaaatacgggtccacggtgacatgtacgtttgcccgcagacaccggccatgcatgggaccggtaggtgagcttacgatgtacagcgtctcaggtcgtcaattgcgtccacaggtacatgctatcatgtccccagggcgtaatgataatcaaatgggcacggtacaatcaaggagattgggcaggagctagctcacctcgtcgctttcagaacgacctgcgaacagtgcaagagaccggctgctttgctgctagacttccatccaagtgcgtgccgatcttttccaagatcggcgacttgcgatgcttccattgcaatggagcccactgtacgtacgtaggtgcgatttagtagtcatgttatcaaacatgagatggagctgggtgaaacatggaagtcacgcttgcagatctgcaaagatccggtgattttgccccgtggaatggaatacttaaaattttgatgtgaggccgagagattacgacgggaggatgcatcgatctcacaatcacaatctatccaagacttgacggagccggaaggatcggatgcgatgtcaatacatggaatgccaccatgtcgttttctactgcccccggtttgagctgatgagacaacgtgcatggttgtgtgtcaagtttcagcaaagcatctggactctggatggactaacacgttgcgatgcctgatgcgtacgtacgctgcgattctggagttgtaacgcttacgctgcggttctggagtattacatgtcactctctggctgcacacacggcgactgacgtgccggttttctgcaagctctagaagcatggagtatctgtctaattatttgcaggcaaccacctgctgtacaaaaaatactacagccacggtaggtatcgtgcgagacgtgtaccctttcacctgctcatcacgggctttaaatactcactctgtacgtaggtgcggcactcatcgaattaaaagaggggacatgtctctagcacgggaatttcttaggatctaagggttggtgacaggcctacgagcaaaatctaagaggacaaagggatcccagatgaggaaggacgatctggctttatggtatttaaaaaacttgaaaggccaggacggttgttaagcaattcttcagatctaacaaagcgaccaaaatggcgcccaagcgctacgcaaagtagctgcacatacgacaaccgaaacaatttagatgtttcggtgcggcattagataccatataagaactgcgtaattacattagcattttgatcggccatatataatttaaggtcctacaaaattttggccgaattcgatggtccttgcaacaagtaccttcaaagctgaggtggttgtcaggcagacagaccacatgatgtcttcaaatggtctagagttgccaatcaatggcagatagtcccagcctctccaagatctgattcgttttagaaaagtgcctgtttaagataagcacagcacaacgatcatcaataaaaatttatcctattgcaggctgattcaacgataatcacaagggcaaaagtagcattagaatgatttgaattggccccataaacagtatctgagatgccaatatccaattcacgttctatatgttgtgcctgagctaatgctcatttggatctagccattaacactagtgagtgaaaaggcaaaagtaatatcaagttggcaaaaacaagacaggacaagacggccaaaagcattgagggtttatagcagtatagcaccactcagcatggaccgacagtaccattgtatagtggtgcaggtgagttaaagttgatcttaggataaatcattataacccacccactaaatcatctacagtaacaaagataccagccattggtgggttgtctagcatcaaatagatattatggcgccgcatatagggcaatcctgatatgcaagtgctgaacaatcataataattcagttttatactaagtaacatagtctttattctctctgaagtatgctattcaaatttaacctaagttacagaaatatatcagctctcccttctgtgatgttttactcctatgtagagtctagtcttattttttaactcacagaaacaaatgaagaaagttcattttatctgacaagaaaacaaacctgcatccaaagaaacctctgcttgcagacagccctgatggatgagcggatttcaaaatgtggtgttttgtttcatcaatcaatctgcaaaacagcatgcaggtactcttgtctctcagctgacattataatagccagttttacaaaatattcttttga

SEQ ID NO: 46537 - DNA, 4405 bp, Oryza sativa
tattggtgggaagagagggggtagaagggtacttgcctcatatagtgaatcaattttatcaaaagactggccattagcatggagttctgctcctattcttaccaatcaagcaattatccctcctgaatattcttggggagcatttcgactaaggagtcctcctgccttcacaacagttctgaagcacttgcaggtcaatgtcataacatgcttatatgtttctatcttatgaaaatgttctcttattttcttttctgaaacaaagcagagtgttgggagaggcaatggtgaggacacactggcacactggccaacttcatcaggaataatgacggtggaagatgcctttctacggatcttgcaatacttggataaaatatggggaacaatatcttcttcaggtagtgcaaatgcaccaaaattatgttacctccctgtatatgccctacatttgttgccactgggtaacaatagcttatgttattatcattttctctttccttggttttagttactagcagcgattttttttttcactggaaaacacttgatttacttacgcttcattgcatggccatatttgagtacaatcatgcaaagcatccctgtaggatttaggataagggttgaactgactagattcatatgaagggtcaaatatgtactccctccgtcccagagacatcattttttgcctttatttgtcccacaaaggcttcatcattgagacaatcaatgcattggagtttgagaaagtgggggacaaatgcattgaaatttgaaaagtggaggacattctagtatttgattttgtattgggacggaggtagtactggctaattgtgccaggccggcccaagataggccaaccagtagctggttaattgtgaggagtaccaactttttcttgtgagtttgcatgttttgctcctagtaagaattttgaaatcttgaaccgattcacaatgcactcacttgaagtgaagttcattaaaaaaaattttcatactgttattcgtctcgggatgttaaaagggaaaagggggtaaattgtaagcttgttcaatttaatattttgaacaacagttgtctggcagatcaaagcatttcacattgatcttactttcctgaggttttattttgaaaacccatggagacaacatcatcgtattgaaattgacctgaaatgggcatgcaatcttccaatagaacatccaaatttgatatttgggaacagctttgtagactcttcattttgatatttaagatgaggtatttagagtggcttgcactatgtatacaagctcagtcttgattctttttttttttggcaagaattattatgttgttacttcttcctgaagaaataaagatatatcatgaacaggtattatcttgtcagtgtggtcatgtatattgacgattcctataagtaattatagtaattactatgtcatgccctgtgcatatgcttttttatttgctgtataaataattaaagatagccacacagcggaaaactgtaattagtttttgttgctttggaaagagatatatcaatactctagttaagttgtatttctttctttttcagagaaaaatgagttgcagaccctggcttttataccagttgcaaacgggactcgcttagtcacagtgaaatcactttttgctcgtctgacaatcaacatgtcgccttttgcttttgaacttccaagtctttatcttccatttgtcaccatcctcagagaaattgggatgcaggaaacccttacaaacacttatgcaagggaacttcttttggatatacaaaaagcatgtggttaccaacgcctgaatccaaatgaactccgcgctgtgatggaaattttagacttcatgtgttctggtgtcaaccaagccacagatggatcagaagacatatttgattcagtaataccggacgatggttgcaggctggtatcagctgtatcgtgtgtatatattgacccatatggttctcatttactgagtaacatagatacatccaggataagatttgctcacccagatcttccccagaatatttgcaacacgttgggcataaagaagctttctgatgtcattggagaggtactactattataggatctttctttttttatggctgtaagtttaattaattttgtatttttcaaataaacataagttttttcccttgtcaggaactggatggaaaagaagaactaaagatggtgaatagcatttgctctgttactctggacaaaataaaagagaagctgcttagtaaatcgttgcaagatgcgttaaggattgttatgattggtgtatccaatcattttccttcatttgaagcactcaatctggcgcagatagaaagtgtactaaaggatatatcacagaacctgcagtttgttcagcgtctccatactcgctttctattactccccatgctccaagacgttacaagaagcagccagcgtcctccatttcctgaatggtcaagcaatggaaagcacagaagtgtttgctttgtgaacaaatccacgggtcaaattctagttgcagagcccccaaactttttgacaatacacgatgctattgctattgttgttagttacagattaggggcacccgtgatcttgccgattgcttcagtatttgcatgcccagatggcacagagaaagaggtgcttaaaatactccgtctgggcactgacattggagtttcaaaacgtgaaggaaggtacaatggttccctgggagcagagttgttgtcccaagatgctcgccaggttcaattccttcctttaagaccattctatagtggagaaattgtggcatggaagacggggaaagagggtgaaaagctcagatatggcagggtccctgaagatgtaaggccatcagctggccaagctctttacaggtttccagtagagacttctgctggtgaaacttgcatgctactttccagtcaggtttactcatttaaaagcgtttcaatggctgatctctctcctgcaccattgcaactggatagtggtagagctgcaggtggacagcagggcttctcacccatcaacacaggaactgaagctgcagatgatgtggttagttttatttttgtgcaaattctagttttgctagctgtatgtgttgtcgtaatttttgtcgtacttcgatttacaggctactggccttgaatatgggaaggtatcttcaaccgagctggtacaggcagtccacgatatgctttcagctgcaggggtaaggatggatgctacaaaggaaacgcttctacagactactctttccttgcaagaccagcttaaagaatctcaagtggctctactcgtggagcaggtttgtccacttcgatatcttcttgggttgttttatattcatttttattgtcaacatcaagaatatgttttgatcagttctgtataccataagagagtagttgtgacccgtaatctgtagcggcacctaaagaaaattgatgtggggaggcatttgttgttgaacgtcatactattggatgctgctgcacacgctgtgttcaccatgctttctttgagatggagatgagggtgggttaagaatttttctaggatcttcaggcattcctttttatgttcattatttgcacagagaatgtatactatcaggttataaacaagctaccaattttagggagccccaaacttcataatttgcattgcctatcatattatattgtatcgtatcatataattactttcttagctctttctgcttatgttgtatgttgtgggtattgaaatttgttttaattgtcactacaggagaaagcggaggcagcagttagagaagctgatgttgccaagtcagcatggtcatgtcgtgtctgcctgaatgcggaggtcaacatgactataataccatgcggtcatgttctttgtaatcgatgctcaagttcggtttcacgatgcccattttgtcggacgcaagtatctaggatgatgaaaatattcaggccttaatttctctttctacaactttcgctttctattagtatgtataatattagacacgttagttttttagctgtaaaactatagggctgtaaatcgagggtgtaaatatacattatagtccatgtacagctacggtgcattttactgtgccgattctttggaaaatcgaagtattcggttccagtttgaggcgaaatctatctttttaaaactgggatgtctcaagacatcttaggtcccgctcttttttctaacaagagttggattaagattaagattttcgtggcacgttttttaaactactaaacggtgtatttcgtgtgaaaactttctatatgaaagttgttctaaaatatcatactacctccgttttttaatagatg

SEQ ID NO: 46538 - DNA, 14382 bp, Oryza sativa
  unsure (1)..(14382): unsure at all n locations
taattataatttattttattatgagttgttttagcattcatattactttaagtgagatttatatcttatgcatttgcataaaatttttgaataagacaaatggtcaaacatgtgataaaaagtcaacggcgtcatctattaaaaaacggagggagtattaatatattttttaagtttataataattaaaactaaatcaatcatacgttaatgccaccttgttttgcataaaaaacttaatcttattgatccatatagcggtgttaaatttgaaaataagaaattatgcataagaaaaaataaccaataaaaaaagaaaacaaatccaatttctaatactttcaaattatctatcctctgtaagataatatattactatgttgattttctaatatatagttcagctagttctctagtttttttaaaatacaacgttaacaactcggtatttttttccaaacataactgctcgatcagcgtatgttgcattttttttttagcaaaattactgcagttagggaagctgatgttgccaagtcagcatggtcatgccgtatatgccttaatgcagaggtatcgtgactataataacatgtggtaacgttctttgtaatcgatgctcaagttcggtttcaagatgctcatttagccaccttgattttttttaagggtctgtgtatacaactttcgctgctacttgtatgtagtcacggtagttgcttaactggaaaactataggcccgtaaatcatgggtgtaaatatacattatggtccatgtacagctacgatgcattttactgtgtagattctttaaaaaattgaagtgtttggtttcagtttgaggcgaaatatatatagttataagccgctcagtggaggggcaaaattcaaaacagcaaatttcgaagtacaatcattctcttagcaaattgttgcatggttggtccaggctatagatggccaaacgagctacccgatccggcacggtctaggcacaacccggcttgggtcgaggtcagttgggctgacacaacccgatctacacgccgagctaggctgtgccatgtctacccacgggctacacctacggcccaagcagggctgtgccggtccggtccgaaggcacaacagttcatcgtgtttctccatagaataattctgtttttcttccctcatctctttgggttttgtcttatatggctgaaatttgtattccttgtctttgggctgcgacttgtctggctgaattaagtctattttcgatccttgtagtatttttattgactgtgccatgccgggccaacccaacatgccaaggcatcagcccaggcacagtccaactgttggaccggggccaagccaaatggacgtgccgtgggccgtgccgtcgggtccggccatatggccatcgatagtccaggcgttgccgcaaccggggcaaacagcaaggggaaaatatctgtgccaagcagcaagagcaaaaagcgaaaagcgcaacgccgccgcgaaatatctcacctcacgtagctctcgccccggaagacgccacccagcgatcacttctgctgtactactggccagtgaccagtcacttacttgctcttctcccccattaattgagctccagccgtccgggagacgagataattccgttcaatttcaagttaatcccgcggcagccatggctgcgcttctcatgaacaccggcgctgtctcgatgcccttccccaccacgcgcaccgccgcgcgacggcgaaccagcagaagcagatgccaggcttcatctagcggcggtagcagcaacgaaggaggcggcgagagctaccgcgggaggagcgggcgcggtgggtcgacgacgtgggtgacggagtacgacctgtacgggctgctgggcgtggagcggtcgtcgccgcagtcggagatcaaggccgcgtaccggtcgctgcagaagcggtgccaccccgacgtcgccggcgccaagggccacgacatggccatcgtcctcaacgaggtctactccctcctctccgaccccgccgcccgcctcgcctacgaccaggtacgttgcttcatcgatcgatctctcgcatatacgtacgcacaccaactgttcgtacaattattgatgaggcaatcgatctgcacggaacgcatgcaggagcaagcgaagcagtcggagttcgtcgggtacacggggaagccgctctactcggcgtggttcggcggcgaggccgagcagcgcgcggtgttcgtggacgaggtgaggtgcgtcggctgcctcaagtgcgcgctctacgccaacaagacgttcgccgtcgagtccgtctacggccgcgcccgcgtcgtcgcgcagtgggccgacgccgaggacaagatcctcgacgccatccagacatgccccgtcgactgcatctcgtaatccaacacacctctaaatcccccaattaatccgtgttctgcttgttgatttgtcctgatttgttcatctccatggttgatttggttcggtttgtacggttgattaggatggtcgagaggtcagatctcgcggctctcgagttcttgatgtccaaacagccgcgcggcagagtccgggtctcggaaggcaacaccgtgggcgctcgcgcacccgacatcttcaacgaggtaagcaagtttcagaagaggttccaggagatgaagcagaagtctgccacgagagaatccgaggtagtaaatctgatgatttgatccagtattcaagtagccttgtgatttcataagggactcactaatcaccattaacaagcagagctgaagctgagcacagtaagctcgggttaactaatctcgctcgctcgcgtgcgtgcaggagtcggaggcagcaaggcaatcgaggagctcggcagttcagacgatcaggtcgatctcgaactggtggtactggcagccgttcagagctccggcgaccaccgtactcgcttctctccacctgccggcgccgccgccttctccttccatgcccgccgacccggtgacggacaggctccaagaagcggcagctcgacgcaaagcgggaggcgcgacggcggcgaggacggtggcttcgtacgcccgccgcgacgactactggactccgcagctgaacctgccgtccctagcatcgccgccggagcgacctcaccggaggcagagcgcttctcctccccgcagccagacgcggcgagcaacccccaccggcgatggcggggtgacattgggcagcatcgacctgacggcgccgctgctgatggcgatcatctcggccgggttcgtgggttacaacagggaggaggtggccggagtcggcggcggcggcatccaggagcacgtcggtggcgccgccgctctgggtctcgtgaacagcttcgagctcaagatcgtcctagcctccgtgacatggttcatcatcggcgcggcgattgccggattcattcagtttctcgcgaggagcgaagtgaacttcaggaaatgaagcgaatacatgatttattcacgatgacataaagatacataggatagatgaagtatacatagtagtatagatgcatgtatataaaggttactgcaattaaggaatttattagtggtgaaaaaatgagatataaagtagagcaaaatgaaatgtacgagacgtatagcattcagcttatgtggtttggacgagaaatcagttctcttgtagggtgcaagaactgctgttttttatgaggcagcgagtactgagtactaactaatgagatgatgcaagtttataggcatcatttattaacataaaaacgactactgcgattgccacaagatgatgagagctcacagaggaaaacagagcaaccacagttaagttattcattgttgtcttcaacaccagaaaattgcaagtgtcccgtgtaacccgatctaaagttactacgcaaataagctgttgtgcttacaaaaacatctggagtactgtcataccatgctcagcaatcaaaaagtactcggtcgtcgcaattgctagttctgaatggcacctgattacatctaacaaaatgatataggggaagacggatgatcgttacttcaaactgacctatggtctacttccgtcagtctcaccaaaacaaaagatcgcacttgggggcagctgatgcagattttcaaatcaattgcccgtctcctgtaggaactccaatacgttttgacttgacacaatgtacctcaaggtaatagcaccagatactaaccaagagatgattcctctcctcaagacctattcttcgggggtttgaccttgtatatgcgcactatccagttcgaagttgtgaatgcctcctccaagtactcaagcttaatgtctttgttgccaatctccactcctcgtactcgatcgtatctacatacaaaataaatagcagagctagcatccattaccatatcaaaaacaggcttgttatacaaataggacaatgcaagctacaaccagcaaattatggtgcctggcttattagggaaaccattcataaccaaaantataatacagaagtacaatgtaaatatctatttaaataaatcaatgaagtaaaagcaataacaatggcaaggatgtgccataccctggaggttttccatattctgtggtcagttctccaaaacggtaataacaaagcttgtacctgtcaaacaagagaggaaacaattagaggtgatggaaggatagaagtaacacggataaataacaaaatagtacatgtgttgacaaataagtctcattagtgtgtttcatacttacattaagcaattcaacatttttggtgctgcccccttgtcgacacgatactccccattaacaaggtaatcaggctctttgattacaggaaaaactccaccaccaatgcgcaccatccataagaacctggaaataagcagctaagtaagaatccattttgtagttcagtttttgaaaaaatgttcaatactaattcgaataaaaccaataacatcgatttattaaaatttgctctagattcagtggataaacttacttgttaatgtcatctgaagaataaccagtaacaccaccaaatacgacaagcacataattcacatccagtgactgcattatctcatacgcttcatcttcataggatgacattgcacgcccaactgtagctatatgtgtattattccatgtgttgttatcaacaataacagttctgttccccatagctgtgatttggtatccataatcccaccatgacataatctttgcatcagaaggagtgttctgacgaagccaataatacgcttcacgataatcatcaaatatgaccctgcctccattatgaccccttgcggccagaacaatggaaggagaagagtaagcttcagatgtcacccaagtgcagtgtacagcatatctactaagcaagtagaaagcacccagaagtaaagcaatggccacattctgctggaaaggcaaggattgatcaactgcaccctgtttacacaagaaaccaagtcagcttctgagtgatgtgaaaaccagaaacttaaaataattgatacaagcaaactgaaaaccacaaaattatgtgcaattgaacctactggaattagaattgtcagagaaaaggcgcaaatcctttatattcttatcagccatgcacatggtaaactggaaaattgcaatccagcatttcaaatggcacaatactctggagggtattgattggcggaaacaaaggatttcaattgtaccacttgattttatctaagtatgtttcagatttcaagctccatcaaatttatttatttcaactatccatatacaaaatataaagcatgcaagcaagcatagacaaaaaaaaaaaagggaatacctttgcagctgcctttgagccagatgattttccagagacagtttgtggacttttgctttttgtccgaatcaaggtagtcagattttttattgtagctgatgctgcaatggcactaataaggcaaacagctggcgctgcaacaagaattaaccgaaccatcacaccagcaaagtacatactcgtgaggccatacataactataaatattgtggcatctgacaagcgcttgaaacagaagtagaggcctgctgggaacaggaaaagaaggatgtggaaatcaaacatgaacgaagaccacgctgttggttgatgctcagatactgatgcaatgattggtatatggtcctttgcataggttggatcaagcagggagtaaaaccgccctgtccaaggggagatgtaacctgacgcggtaccaattccaagagctagggtgccaacagttatcacacatgtcagggtgattctcaggaatgacttgaatagtttggcatcattcagcaggtacttcacccagtccaagaaaaagaaaacctgcaaaaagaggaaatggtttatgatagctctcttatacatgtgctatactgctctatctatacaaagtacacaaagtacctcataatagaatagatatttgtcaaagcattcatattaacaaataacaaaggtacgctatgtttgatatatacacacaacaaacacaataacgacattgagttatgttggctgtgggacatattcaagagtaaagagtatagcatctcacattttacagccaggcataaatgggccaccaatcacactgcaaacatacaagaattcacagttccataacatgtctacccagtaaacatgatctatctgaagaggcaaaatgagagtagcagcaatctgacacaaatgccaatgttccatctaatcatctgggttatatgaaactaacaataagtactaacaggtcatttgatcttaactgttctacaaaattacctgtccaatttactccatagtttgcctacaaaccaagatcgggttgccttcaattaagtgtttcgccctttctcagttacaaataatcctaactcatttccaggacaattaagacgggtggtgcaaatttcctaaagtggcgggacttttcatctgaatcatacctttttatgtcaactgttgctaatttactaaactagccatctaataaaccagagctgtaactagctactaatcttagaaggcactttcatcgctacggatgaattgttacatcatttcataacaatatgtgtaagaaatacctgcaaaaggaagaatactcccatagcggccatgtgctccccagactggacgtgttggaacccaacgaaccggatctgcatcgcaagtagcattccaagcacatacgtggaattgtaggccacgtagagcctctgcgagtacctccccgtgacgagcagcacgagcacgtacagcggcaacagattgatgatgaagacatagcctccccacgcggagaccatgtagaagtagccgaacgccgaggcgagcgaccatgcgagagatcccgtgttgacggcgcgcacgaagaggtagaaggtgagcagcagcgcgaagatggcgacgccctcgttgtcgtaggagcccgcgacggagcgggagatgtagccggggcagacggcgatgagcgcggcggcgacgaggcccgcgccggagtcccagatctcgcggccgaaggcgtaggcgacgagcgtggtgttggcggcgaagaagggggcggtgaggacgcagacctcgcggatgtggacggcgagggagagcgcgcggaggaggcggtggagcagcgcggcggtgaccatgaggcccgggaagagggtgccgccgacgacgcggccgagcgggtaccagctctcgaaatcgaaccagttccagaactcgctgaatccatggtcggagaggaagagcgtggtgcggtagttgaagtagggatcgaactcgtggatcatggactcgtagcggagcacggagaagaggcggacgacgaacgcgagcacgtagatgagcgccagcgccgagacccggagcaggagctcctgctgcttcgtcttcagccgcagcgaccggagcggcgccggcagcgagtccagcgcggtggcggcggccatggcggcgatccggatgcgggagatctggcgcctctcgctagggtttcatgcgccccgcgcgtggagcgggagaggttttagagcgccgcggccgcttggttgggttcggtttggatctgggagatcgaggaggaggaagacgagagcagagtcaagcgcacggggatgacgacgcgatggttacactgacatgtgggccatgcaagtgctgacgtgggagcccccacgtaggcgcctctgtgacgctggaaactgggccccacttgaatcgccgcaggccattggctggagagggcgggagacacgtcgctcgcggctcgctgctatcagtagatttttactgtatctaattttttcaagaacaacatcaaatctctccaaaaaacagatcctgaaaaaaaaaagacacttgagatggcaaggtactgaagatacaaacaatgtgagtacacggaattcccagctagttttgatacaaccacaatgcaaattatccattgaggtttcttgcaagttcagttattttctgaattacaatcccccaacgacccgtacttgtctttatctaatcttcagtagattcatcccatgaatcaggctcacattggtgaagtccattaactggaagtacattctgcccacagcttcacggaatacaagtaggaacaacatggctgagaatccaagccctgatggtttgttattacctcgatccagaacctgaaactaaagctggtagatctgctgctaaatttgataaccaaaacgcaaaacacaagataaccaacaaaaagatagaacagatgatgtttaaaaccaaaacactatctttctacatgatgacagataatcagaacttcagaggtccatcaacactgacaactctctatgactatccctctgtcatccatacaaagacgctatcggccttcagtgacacactggtgtctgttgaagtagctccacgctggcctggagatcttccttacagcgaaccagcccaactgttcagttattcacaacagcacacataacacgtaagatctgtacaactgacacccaaaccatataaagtcaacaaggagagcatatataactcttgacagatgatatcccagaagaccagaacactggataaaattcaattcgaaacccatagcctagcagccttatttaattcattagttctatctaaaaggcatcatgttttatttcggccatactaaatggagtagttaattcatcgttattagcagagttaagtttcattgtatattcacttttaaaaagataattgtatattcttataatatacctgaaaaatcaatcattaatacctttgaagcaaaatagtactagagttttagtgtcaatccttgatcaagaaaaagctttccttgtgacttaaagttgatgtagcatttataccaaggaggaagtatcgcctactctgcagtagcaggacaacagaaagaattgagctatataattatgccatgaattaagtaacagccaagtcagtatttcctccatgatgggaaaaaacagataaaagtaagtattagtagaacactacctgatttaattcataaacacggagatctcttgcttttttgttaggactagctctaccaaatcagaccttgcctataaggatcatcaggtggaacatccatgattatccgggattgcatctaactgcaaatgaattagtcttcagcgcttgcagtttgcaaaatcaggtcaagcgagtggtttcttaaaggagcatgtataatgcaagtgctagacaagatggggggaagataatgagaatgcaacaaaccaggactagaagcacgtttcatgactaacacttcctctgataattagtgaaaccagctgttcctaaaaaataaacacaattatcatttttgtgttggatcacaaggattgcatggtcagaacatattcattggagcaccaacaagactacaagagccaatgctttttactggaggtactgacctcctggattaccctatatgaagttctaggagcaagctatttatctgctcccacaactctgaagactgtcaaagtaacaccataagacaagcattggacaggatcacaagcacatgatcccacatttatgaaggaagaaaaagaatgccatgcaagtgggtatttattccagatatgctttatcaaaaaaattataacaccggggcttttacagcaagtactttacaagtgttggctgacagattatatcagcagagtatattaatgaaaatttgcatgacaaaagcaacaggaattttaccttcattggctattcactgatagtacatgtccaaaaacaatgccactaccatgtaaagtagtgaaaaagacttggcagacctatgagcactctcaagttgtcccttttttttccttaactccaatcaagcacttccaagttataaacacattaaacagaaggatcacccaattccaagcatcctatctaatacagaacacagctgcagcatttctgtgcattcccctggaccctttctgcagaatgccttgatgacattagcaaaaatcctactatctaataacaatcctttttctagcatatcatcaaacaacctcaatgcctcacgaacatttccactcctaaccaaccaatacgccaagcgtgcaacaggctcaacaggatagccatcatcaatatgtctgatcaaattgacagcctcggctctcctccctgacctaaagaggcaatcaaccagcgtattgtatgtgatcgtatctggggcaattttacccgcattcacatcagcgaacagaaaaccaagctcatcctccttcccggcctcatagaatgcatgaattagaatgttacaagtcacagtgtctgccatgaaccccttgctgctgaacacaaacttggcaaactgaaactttccagctcggcacaagcatgaaataaaaatgttgcacgtttgcacattgggtgttatgggcttcttgagaagatctgtgaacagttttagaacacgcagccatttcctcttcttgcagaaatgatccatgaccgtattgtatgtcacgacatctaccacaaagccaagctcctggcatcgttccagcacctccttgcctgcccacatatcaaggtcctgggcaacatagtcgagcagtatgttcagaccaactactgtcggctgtaaccccatcgttaccatgatttccagctgccggagtgcctcttcgacatacccgaaccggcaaagcccagcaatgtaggtgctgtatgtaactgcatctggcacccacccattccggccactctcatcaatggtcctctggacagcatcaaaatccccaaccttacataacccatttacgtagatgttgtaaaatacgacatcggggtggcatccagtggagcgcatggagctgatgagcgcatcagccgactgcatatcagcattggcacagtacacctggaggatcggtgtgtagctgtgcagggtgagcgggtaattgagggcgcgcatttcgtcgagcagctggagcgcgtccgggaggcggcccgcgcggcagaaggagaagacgaggtccgcgtagtcgatgggagtcgggggaaggccgaggcgggacatccagacgaggacggagtgcgcggccgacgggaggtggaggtgggaggagtagacgtggaggaggaaggagaaggcgcaccggtcgggggcgacgccattggcgagcatgtcgtcgaagagggccgcggcgtcggcggggcggccggccttggcgagcgccgacatggcggaggtgtaggaggcggccgtgggcgcgcacgccggggaggagtggcgcatgcggcggagcacccgcagcgccgcgtcgccgtcgccgtcgcgggcgaaggcatccaggaggcggttgtagtcgtggagggtgtggggagaggaggagaaggcggcggcggcggcggcggagggttgggggcggggaaggaggtggccgagcgtgcgcatggccccgcgcaccgcggcggacagtggcgcggaggtggcggcggcggcggcggccggccatgcgccggccgtcatgaatgattagcggaggttgcagtttgcaaaggcataatagtgaaggtgaagtaatttggagatttgctttgccaagcgagatttgcatcaaacggccatggattacgaaagaggcatatgtttcctgagtttcgaacctttaaacaaactttggtggtgttctttttctttcgaagatgaagattaagtttttttaaaaaataaaaaataaagtagtactaacgcatgattgattgagttttaattattgtaaacttgaaaaatacttcctccgtttcacaatgtaatgcattctagcatttttcatatttatattcatgttaatgaatctagatattatatatgtttagattcattaacatcaatatgaatacgggaaatgctaaaacggagggagtagattaatatgatattttagagtaactttcatatagaaagatttcgcacgaaacacaccgtttagcaattttaaaagcgtgtcacaaaaatctttatctgcatcaaactcttattggagaaatgaatgggacctttatactcccttcgttctaaaatagtcatcgttttaattcaaaacttatcttaaaaagcttatcaccttcaagtactccctccttatcaaattgatcatcatatatgtttatatatcaagaccaagtataatttaaatcacattaatcaagacaccatacacattccaagtctaattatcctctcattctcaatcttatatcatttaatagaagacattgtagtcatttttactaaaccttagttttttaaataacataaaacggcaactaatgcaggacgaagaaagatattttattatttttataatatcactttaaatttatttttaactttatagtatttactaactcatttgttggtgccttcaaataattatcaacctattgagtcattattccaaaaaagaagaacagtgccataaaaagggccacacactcactacaaatcacaatttctgtagtgacataacacataacgagaactccttatagtattttatatttagaacggaggtagaactaatcttcatctttttaccagttgcatttgtttgatactaccagtaaaaactaaaaatgagcacatctaacaaatttaacattctagacaaaagtctaatttgcccttctccgttttcgctccacctcgccgtcggcaggctctggcaccacccgttccacagtgacaacattgcgatggtctgtcttgcaaacaaattcagtggcgactcgatggccatccacgtaatgcttcttctcgtactcatcagcacaagggtctgaaaacgccagatcgttgccaatctctagctttggggtgatcaccatctgctcgagggtcatggagctgcgaaggatgtgaagtgctagctccacctggtctttgtggccaaagaaaccactgatgcgaacgcgtttgagatgagcgtgctggtgtggaggaccaacaatccttagctcaccatcctcttcgcgatacggttgatgccggcagttcagcatccacatctaatggggaaaaagaaatattgcatgcattaaaacgtggagttagtacatggatcaaggcaataatattgtttctgaaattcatgtgacccaaagggttgcctttgagtgttcacctgtgatgcaccgatacggcagtttgccgccgttcccgtatgggatacgtatccgatacggcgatacgtgggatacgcgagcgatacggtatcggagaagtatcgctgatttgttagccaaaaaaataaaaaaaaatgagcgatacggcatcaatacatggtcgatacttccctcgatacggcgcccagtataaggaataagttcactccatgaccctcaaatgtgatcgaaatctaaaccatgaccctaaactacaaaaccagatatctcgacccctaaacttctaaaaccggtgcaatttgactccctgagcggttttgctgatgtggcgccacgtggcgcctacgtggcaatattgaccgagtctttgttacacgtggcgttgacgtggcacctacgtggcagtagaaataaaaaatatgcgtaggacccattagtcattcacacaaaaaaaaatgtgggcccactagcatgtggggcccacatgtcagtcctccttcctcctccctcactcccttctctctctttctcttcccttcttccccttcgccggcgatcccaccggcaccgccgcctttccctaccaccg

SEQ ID NO: 46539 - DNA, 2981 bp, Oryza sativa
gttttcgttgtcccagcacgccaccggccgaaggggaagaaggggagagaaagagagagaagggagagagggaggaggaagaaagtctgacatgtgggccccacatgtcagtaggcccacatttctttttgtgtgaatgactaatgggtcccacgcatatttttatttctaccgccacgtaggtgccacgtcaacgccacgtgtaacaaagactcggtcaatattgccacgtaggcgccacgtggcgccacgccagcaaaaccgcctcccaaaaccgctccgggagtcaaattgtaccggttttaggagtttgggggtcgagatatctggttttgtagtttagggttatggtttagatttcgatcacttttgagggtcatgaagtgaacttattccaaggaaaaatggccttaggatcgaaagcggcacaaggacaaggagagatttatttttaaatttttcattttaattaactctaaatttggtttttgttgttttaaaattatttctggtgctttgaaaattcaagtaaaaaatttagggacccatttaaagcatggaggatttaataaaaatactccaagccacttttgaatttttcttgcacgtattttagtgtttgagatttcttttagacttttaataatttatattactcattttagaaagtgatttttaacttgggatgaatttatcaggatatgaaaatgttacccccgaaggtgaattccctgttgtcatctttattttgactgtttcatgaagtatgaagtatgtacgactatcgttagacgaactctagtccctccgctctaaaattaaatcaacataatacgagatataattagatttgtttattttaagacggatgaagtataatttatcaacagtagtcgcacatacttaataattcgtgaatatcccatactatattagtttattttataacggaagatattatatattagtttattttggtacggacaggaaagggtagatagatagatagatagatagatagatagatagatagatagatagatagatagaaatagttgcgcttgctacatgtgagggagattgaagagtggacgtggactgaccgtttgaaaaggttgattgacaagaaatagtctcttcttgacaagaaatagtctcttcttggctttatatttcgtggtgttaggataatgtcgtatttttatattagattggtttttttttgacagagagagtaggatagatagatagatataattaagtcgcacctgctacagttttttaaacactgtttgaaacaattgagtgaccagcaatagtttatttctgtctttcttcctaaaataaggatgtaatatagcttaacactataaatctagatgaagagatgtccagatttatagtatatgatgtgtcaagtctacaaaggatggattagatatctcttgctcggacgatagagatagatgtctgtcctttttcttttggcaagaacaaactttaagtcgggtgactccgttaggatttattaacagcataaatggcattgcatattttgtatactaaatgatgtcccgtgctttgttgcggccggatatatgttagatattggagaaatgatgaaatgatttggattgaaatattatgaaaatgatttgagaatgatgatttagcgtgtgtatgtttagttttaaaatgaaataaatagtagatataactattatatgcttgtatgttgtgttttgtatactaatgggttgatgtgacatacttgtgcaatatgtaggtttttaggagtgataataaatactatgcttgtatcttgagttttaagtgtttggtgggtattagctttctatagaagaaggaatgacacatttgatatttttaatcagtccgacaattttaagattttttttcaaatagactagataaacatttttttcctttttaccgaattgaacgtagactcgttttatgcatgtcaactataaagtcataaaaaatctttaaaaatggaaatatatattaacttgtgatatttcgatctataaatatataaatttaaatttgatttataaaggtagaaaaaataatatatcttaatttgatttatatttgtaatttgtgtttctattgtgtatatgtcgaatttgaatatgtatataggaagcccattataggcccataactatttaaccctaaattctctcatcttttaatttctccatgctgactggtgttactgtccacctttttagttttaatctacctgtgaatattcgattgaaatatgatgcatgattatattttgcatctgatctgttattctgagctatatctaatctggtctgatcagcaaggtcatgacgctagcttgcagccttcaacacggactcagttattcttcttgtggaacttatggtgattttattatgaaatgaagccaggttaccaagtaaacgtacttcattgttcaaccacagtataattcatgattaaatagtcaatgctttcatattcagatactacttaggcatatttgaaaagtatagaaatgtttggtctttgaaaagtataatctatttttacaatatatatatatatatatatatatatatatatatatatatatatatatacactcgctgtatcgacgtattagtgtttttgaaaatttccgtatcgccgtatccgtatccccgtaccagtatcgcgtatccgtgcaatataggtgttcactagcctaaaaaaaaagaactttggttgtttagaagttcccccctttgtgaatacactacaatcatgacttaacttcaatctgaaccaaagttttaggtatgctcatatgcgcaaaagacagaatcaaatattctattcaataaaaaagttaagaaataaactactgcatgtcactatgcgctttttagcattaccaactgccccaacagataacataaatagatcactattcttgtaat

SEQ ID NO: 46540 - DNA, 4654 bp, Oryza sativa
tcctgcaccccattcagttctatctcttgcagattagggcagatatccactaccaaatgcttaagccggtccaatggatgaagcattcgtatgctagtaaccatttcgcaatatgaaatctccaaaaactccagaagattgcatttggatagcatacgctgaacatcttcatctgtaatgctcatatctactaagctaagaatcttgaggtccagaaatcctttgaaatcagcaggcagctgcagagacacggtcgtaagctcgagacaccgcaagtatgaaccataattgaggccaagaagctgtggaggcaaattatatggtggttctttgattatccgtatgcaattgctatgtgtcaaatctgtgaaaaatgagcccttatcctgacctgataaatcaacaaccaattcctttgtttttgatgcaattgcaaagttcacccatctatcaatatggtctgcgtgcttactatgcaaccgaaacttaatttccatacgttgaacccccattccactgtgctgacgcaggaccgcatcaacccttgtaataaattcgtagtccctgagccatcgccatcgatatggagtcaaggtcttgacataaggtttcctcattgtacctttattaagagtaagattggtgtggctgcaccaaaaatatttccattttcttgacaatacacttgtccttatagcgtcatttattggcaactgcgacaagatctttgctaaaatatcctacatcaggaaacaacagcattataataatttaagtatttgacataaacagctaaatagataccatcgctgtacaagattcatcatattaatacgtgaaaacacattgtcttacacttaatttctgtatgaactcacataccattgggagattgctaagtgaaattttttgtacttctcttcttttgacaattcccccatgcaggccttgttctgaattcctcatcatgctctggttgtggctgaactcttttcagtaaagaagagccgtcctactgttcagtacatacaagaacatcaagcactagaaaaaaataatttcatggaattgataatcttaaggtaacgactcagatgagtatttcaactttgttacatgataggaaaaaaagagtctgtcagggcatgtacgatgtacccttattactttgtaaaggagaacatagtttgaaagatgttttctcttatataaaagaatttcagtgttttatgtcaactctgtttttttgtatgtttctttttatatgtataaaagcttatcgatacaggaccataaccaacatggctaaactactttttgagcccttattccaatgtgatgaatggactataatgatagttgattggctgcttgaattgtagttagatgatatattgtggatgaattgaagaacagcagcacattattgtgtctcggatgggctagctaaaataagagccccccaacccccattggattggatgggtgcactccattggaagggcatctcaccttatagggtggtgtacatacaagaagtgaagggtaaaaacctagtggatgctcgtcgccggcgaaggtcccgaccaagacgtgcgaaagcggcgccggtcgcgctgtcgtcgtagcccacgccacgagacagagcaggtcaaggagggagaaagaaaagaggaggtgagaagtagagattagtattatgtactccgcttcctccacaacttcgcttccgattctgtttcctctccccgtgcgcgagggagagattctgttcccgattctgttttttttttaacgtcaagaatatagtctctgaatgagactacgagagatcaatgaacgagaaattgaggctacgagagatcaatgagctaggagattggttactcctacatataaatcctccggtacctgatgagattttttttttaaactgtagatggtcattggtgatactttctgacgcatactgcagcttcagggatttcagaaaagaaactgaacttgtaaacagtcagaattccgaaacccagcatgggtgctcttgccattgagctcgcctgtggccaccagaatatttcagggttagggacagtttgctctgtttattcaatccctcaacttgacaagtttcttaagcatagatctagcagagatcttaatgtaggaatttaacaaggatgaatagcggagcatgaattttaccgttgaacacaaccacacagacacaggagcagattaatttacattgttctttgaacaatggcgccacaatttagacgcagatggcctctcgcacaactaaaaaagggcacgactaaaaaaggtcccgcaaattcaaaccatatcaggaaacagataaaagcatgtgatatcaggtttggttagagtctgtacaaatgtggcatatcaggctatcagcagctactttgtcatgtaaggtatccggtggccaccatgagcagctcgggcatcgcaagccattgcaagatacctcaaattgatttaatggcgtatcaagccagccgtgtcgaaccttgtaaaattaacagagccagccatgtcgaaccttataaaattaacagcgccctgtgagctatcagccgatgaataagttgtctcttttgacaataatcatgtcaagtcccgtacagaagcctcacagattttccaagatccatcactctgtctcctcaatatgtactgaacttcatacatactgcaattgtaacagtataaagtatcagtaccgtgttactttagagcacaacaggaaagcgtgataaatagaaacattatcttctgaattacctgtaatagctaggcttcttgggctgggattcatcaacaagctcagccgcttcctcaagaacagcaccaatttctgcaacttcaccagtgccagactcatccaatagtatctccgctcgaacaacagagagatttaacaaaacaaatctccaatagcaggactgatcctttgctgacaatgccaactcttgccactgctcgacaagtaggtcttccattatggacaattcaaatatttaaacatggaagtctatatgtaagtacaccatggataaaaaggaaattaccttcgaaagcattgaaccgtcaagaatttcagggagcatatcaatttgataatcagggccaagagcttcagatttgatgtcttgccactgcttcacaagtgtttctgcttcttgaagagccatactttgcttgcatactgtagcagccactgcattagcaacagaagataggtcgctttcttcgcttcttgaataaagcctattgtttaaccaaagcatcttgggcagtttttcaaaatgtttcctgacgctgctagtaataaaagaaccttccaacgtcgattcttcattcagggactgtgtggcagcagaacccctacttgcggaggcaggtttcatgtgaccaaactgaagtctgagcagttttaatgtaccaaatagggcaaacccaatgagtgcactatatgcaagtttccctacaatatcaccagtaagaccccacgattccaaggttcttgcaggatgcgatacaagattgcgcttcaggggaacagatgttgtggttgaaccatttgctggcctatccattgaagaatggacccccaggttgtttggtgcaagttgctttacagcttcccccaaatggctggtagaatttaatcttggcgtctgctcccctaaagctctgttgcatggtgacacactagaagatggctgagaactcaaacggaccattcttgtggctcctaatttctgcttggaagtgctaaggatgcgcttaggagccccaaagaagttggcctgccgtaagagaataatgatatgaaattagtctgtgaaaaaaatattcatgggtttcattactgaaaatagtaagacacagaccaaagatggtgaacaatctcttgtatccgcaaaacgagaaagtgccatatccttcagccacaattcctgtaaagatacgctatttgccatgagaaaattttaacacaatggagaaatataatattcagtaatctacagtagcacaatttatttgctccaaaacatactacagtgaaatataacataccagagactgacagacagtaaccttgtcattgccgtctttctttttaggtaacccataatttcttgagttggaattcccattactttgaagctgctgaagcttttcaaaaacagtggtgccagattcctgagagcaaacatttagttatgataatgtaaactagtaaaatttttgcagttcaaatcagcttatcacctctccaaggagatacaaacaaaatgattcctcaaatttcaggtctgtgttttcagatgcaactaaacaatcgcaaatggttttggctttactgatctgcataaaggaactgtacgttaaataatgcataaatagcaaaaatgatagtttactactattgagaaggagaaggtaccaggtcagcctgccgggttgaaaaccctaacgcaaagtgagcaagcatcgctacatggaaacaattgaagtcaactactgcccgctggctctgggattccaacgattttttgtttttacgagttgtagccaaagtatcccaagaaagtagatccacaatttcagtggctaacaa

SEQ ID NO: 46541 - DNA, 1559 bp, Oryza sativa
gcacactcttccgcttccctcttaggaacgaggtgctgcttctagaagccaaataaagcgagaacaatatacaccccaagatgtggaaatgcttttctcttccttctctgaagttgtatctgaggctttactttttctccgcaacgtaaagaatataactctgtatgtcaaggagagtgacagccaggagatgaaacttgtacatcgtgtctcgaagcataatagttatgagatggccaaagaacctcatgcgcttaatacgatgcttgcatttataaatggaaatcaaccatcaggaatggataggaatcaatttttcaataagttgaataagactaaagatagtgatttaccttggagttctcaaaaggtctctatctttgagcaaagccctgctgcttgcttggtgcattcatggatcttaacagagagtataggtgggggccatgctagaaagttgtcaactgcctctggtagtaagtcccacttctttgttccctgggcatctgttgctgcttatctgcattctgtgactgtggacaatacaaaagaactgtctggtgaagctgaagtcaaccttgatgatttggttctcaagcaactgtctcttggatcctctaaggacaggaaattttttgagggtcgagccttctgctttcttcctttaccaatcaacactagcatgccagtgcatgtgaatgcttattttgaactatcttcaaatcgaagggatatctggataggaaatgacatggctgggggaggaagagtacgatcagaatggaatcttgcactgcttgaagatgttgctgctcctgcttatggtcacctgcttgcagccattgcacaagagcttggtccctccgatctgtttctctcattttggcctactgctgtaggtgtggagccatggtcttccatggtgaggaagctttatgtatctatcgcagaacttggacttcatgttctgtatacaaaagcacgagggggacattgggtgtcaacaaggcaagctatctttcctgatttcagtttttcaaaggccattgaactggcagaagttctttctgaagctggtttgcctgtggtatctgtatccaaacaaatagttgacagtttcttgaacgcatatccttcagttcatctcttgaatcctcatctgctgaggaatttgttgatccgacggaagcgtggcttcagaaatagagaagaagcaatacttgttctggagtactgcttgagtgacatgggagatccttcctttcctgataaattgcaagggttagctcttcttcctttggcaaatggatcattcacaacatttaccaaccggggggagggtgaaagagtattcttttcttcacaaatggaatttgagcttctgaaggactctataccacatcttgttgttgataactctttacccggatgccattttgaagaagttatatgacatagcttgttctgcacggtcaaacatttacttattcacatgcaattttctccttgagttgttgcctaggatcttgccacctgaatggcagcatgctaagcagtta

SEQ ID NO: 46542 - DNA, 741 bp, Oryza sativa
gattatctgaatgtacttcagtgtttacaaagcgatgccaaaggagagccattgtctacagagcaactaagttttgttcatcgtgttttggaagcatttgttgattgttatcctgataaccaagcacctgatatgatggtgaattcattgttgattcccgattcatttggtgttttgacacctgccagaaatcttgtctacaatgatgcaccctggatgaatgctgatcctacttcaaagagctttgtgcatcttagtattggtaatgatctagctaataggcttggggttcgatctcttcgtggatcatcattactggatgacgagctaatgacggatttgccatgcatggaatatgctaaaataagtgagttgctggctttatatggtgagagtgactttcttttgtttgaccttatagagctagctgatcattgcaatgcgaagaaagtgcaccttatctatgataaacgagatcatccaaagcagtctttgctgcagcagagtttaggtatgatagaaattttctccctagtcagctattttactgatatttttcttttccaatcataattgtgcaagtattttgtttgtcttgttctattttctgtttatgtttatataagtaacatatttttattttccaaaaaaaaaatctaggtgacttccagggttcttcattgacagtcgtctttgaaggaacgataatgagcagagaagaagtttgcagcgggctgcagg

SEQ ID NO: 46543 - DNA, 2176 bp, Oryza sativa
cgtcccaagtgcagttttgtactattcacgtttaacgtttgaggttgaatgttcgttttatttgaaatttttttattattagtatttttattgctattagatgataaaacataaatactactttatgtgtgactaaatttttttaaatttttcgcaaatttttcaaataagacggacggtcaaacgttgggcacggatatccatggctgcacttattttgagacggaggtagtatttaaatttgtgcaaatggattagtagctacctagggctctcggtttccgagtcaccaagtgatcagcgatacatcacgattcgtgctggggtaaaccggctcggtccgatcgatgcacacaggtttaatttgggccaagtacgagtcgggataggggtcggtttgacccttgtttagcctatcaaccccgtcccaggtcgaggccaaattagcctctaattaaacaattcgccatctaataaacgcacggtgtccgggcccacgagtcagtgactcgctctagctggacgtgacaagttgcacgctctcaaagctactagcagcagctacccatagggtagtttcacctattgcgtgcactccatttataacactgttaccacagtagccatggcgtgtgcaaggtgagagatcgtcgtggacctaatggcttaggtgaccaatcaggtcgagcggcaagaactgactggtagagatgatcatgtgatagcctaccagaaagcaccagacgagggaatatgtcaaacatttcgggctctgggataggtgacagctgtgacatactccctctattccaaagaaacttaacatagaactataatataatactaatataatctagtacaataaatctgaaaaaaaacaatctaggattgaaatgtgacataatctagtatgtctatattcattatattaggttgagtttttttttgggacggaggggatgtatgatcgagctccaagaattaaaacttttataaatagtttagctttttattcagattccaaaataaaataaataaaagtcagaaaccgagaaattcagcttctcaagaatctcataagttaactaccaaggacaacttctcaaaacttaagctcatccaaacaaatcctaggacacgaagagagagaagtttggcactacagtaaactgcacccacagatcgttgttgttggccagttgtttcggcgtcacggagaccgtgcacgcacgcacgcacggacggacgctgtccgctgtggctgaagcgacaagcatcaaggctctataaagtgaagtaatagtgccctagatatataggcctagggctgatttcatatttggtgaatggtgaaacaaattccatgctgatacgatcgaacattgaagtcgtgcggattatctaagcggaaaatgacccttgattttgacaataataattaagcagaagattgcatatagcctagtggctacagtgacctgagtagtaccccaaggttctgagttcaaattttctatggagcgaatttattgtttgcagaactaaattccctatttcaatggatgcatatattcggttggatatagaggccgggtaaaaaatacccttctaaaaaaagaagcagaagactgcattttggccttgattttgtagtagctagaccgtggacaaccgaaggcgacgcggcgtcggtatcccattccagaccaccatctaggtggaataagttcactttaggtctcttaatttttcgcttggtctgattttcgattttgaaaaaaaaaatagctagaccgtggacaactgaaggcgacgcggcgtcggtatcccattccagagcaccatctgggtggaataagttcactttaggtctcttaatttttcgcttggtctgatttttgattttgaaaaaaaagccagttacaatggatccaggagttgaatctggagtgtaattgttgagtagtctaaacctaactttgcctctctagttcattttataaaaatgctccaccgagcttcgcgagctccgctcttgttttagctagagctacaaatgtttggttggttcagctccaggacatgtggagctggaacccacaaattggtcagcccacaattgctgaggccggcccaacatatcggcacagttcacgggaatctggctcaggcccag

SEQ ID NO: 46544 - DNA, 2785 bp, Oryza sativa
tgttccggttaatttccataatcaccaagaacaacggatggttttattctcaccgccataaaaaaaatcgtggctgcattggacggccagacgatccaaccacggcagcatctccatcttaggcctcgttcggcagcgccaggaacggcccggaacggcctcagttccggccggaacgaagcggcccgtttccaaatctggtctggcccggaagcgtcgttcgtttcggccggcccggattggaaacgggcccggtttggcctgcctccccctgttcctggcccggatccattccccacctctgaccctccggttccaatccggacgcgaggcgacgcgagaggagaagcgaagaggcgacggcatgcggctggcgacgcgagaggcgacggcgacgacgacccgcttcccatccgacgtccacgctctccgccgccttctcgccagtaacgcatcaccgtcgtcttccttgttcctttctctccccggcgctagggttgttgcttgctagggttcttggccaccgcctcctcccctgccgctgtagcacgccaccgccgcctccttggtttttgcttgctagggttcttgtgctgctgctgctcttcttccgcccaaatgagggctttccaagggctggtgtttgttggggattccgatccgcgtagggggtggggatgggggaatcgtgatgggttcttggagatttggtctgtggtttaggttcttgcagtgttgcgggggattcttggtggaagagccctaggttcttggttctgtttcttgccctagatcttggctgaaggatcgatgtgttgcatagccatggatctgtcaaccagcttccctttcagtttgtcttcttctcgaatgaaccaggaaattatgctgaaaaaaaaacatgtcactgtaactggactggtgctccatctctgtttttgtactcacccaagccaggctaagtcaagattgttattaaattcagtgttgcataagaaaagatcctttgataaccagtttttgtcagttcttgatggcatttctgttcattattcagattttgataaccacatgtcctcatggattagctgctttttagcttggatacttaattttagccagcactggctgcctcaacaaactactatgctaattataaaccttttctatttccatctttctgtttatgattcattaaatcttagccattttccatcagatgctttggtcccttctccctttctctgcatatatcattgtagattgtccttgttccgatggggccatcctctttctctgaggatcatcatgcatgacaatttgcacctcataaccagaatttgcaggaagcttcaggcgttttcaacagacatgaaggcctggcattactgacaactattgttgagggtggtggaaactgcaatcctgctagtgatccattaacaaaccagcccctgttatcagcaaacatcattaacaagcatatttttctgctttatttggagaagaaagctttgcgcatcgatgctgaaatataaattgaactgcagtaggaagatgattttgttgcctcttttttggctgcctcattctggcaactacagtgcagtatcttaacatttttttcagctaaattgcctcttatgtagtctgtaataaatgacaacaacaaataggctcatatttttcaattacatctaagtcctggaataggaccattttctttctaagctctgggtagtttaggctaattaaaaaactcaaacatgtgaataaatggaaattctctgttcattaccaaattttcttttgaatttacttgatattatgttgtattagacttcacatatctacttattatataagccgacaagtttggttttttcgaatctgaagatatcaaatgttgtgtccacataggatagcccttttatgatgataacacaaatgcagatcccccaagtttgtttgaatgcatgcaaacaaacttgtaaaatggataataagtgtgaagttcaacagctctattgtatttttacttgctctgtttttacttgcaagagttgtactgcttctatatcacactgtctaagtcttaaccgcaagatttctttgctatggctgcagcggataatcaattgatattcccaaatgccgatggattgctaccagagggaccggaggaaggcgaagccagattgattagtgatatagtcctgaaaagaatgtgcttaatcctgaaatatattactgttcatgcttaactagatagaaatatgcatgatgttctgaattctgatgaatgatgacagcaactgaatatggtgaagaattgtcctgatgctattcagggtgttccctgtctttctatttgggaattttggttaattaactcctgcaatatactattactgttagaaattagaaatgtgcatgattctgaattctaatgagtgatgacattaactgaatgttttgagttctgaatcactggatctgatcgatcgacaatccacggcagcttgaatggcttcattccattccaggtcaaaccgaacacagatttttgaagaggtggattgaaaaaaggaatggattcaatccacaggtggttccagtgaatccacccggatccactgaaacctggccttgatcaattcctggcctggattggaaacatgcgtgccgaacaaggccttagccgactcgccgtcacagccgtcatcggaggcgtcgtcgtcgcgtctccgcagcacgacggtgacgagccacttgggcacgaggt

SEQ ID NO: 46545 - DNA, 1058 bp, Oryza sativa
agacaggtttttttacatatctgacttacgttattctgcagatatatggtgatagattcgacaacttcacgaaaaactttgagaaatcatttggaagtacattgaggacacttcatttaattaatgagacacctgtctatgagcaagataactctcggttttctcacgaagatggtacttctgctgctgaaatcaaattgagtggtgctgattcaaaaaggccggtacatgatatccaggagagtacatcgttaagttcaatggataatcaaatcattcttcatgcgggcaccgatcagcagttggttaaactacctcataataaagctagtccagaatttgataggcacattcttaatgtatttgagagatctctgaatgagcagactcgttcaaatgagctcaaggaacttgaaataggactaaacatgaggaaattgcaattgaagcaatctcagatagctctcagctcatactcacacatgctagagaagatcaaaatttctatgggatttcagaaagcttctttcagagaggaaaaatttaggacgcaaatggaggacacaagacatgctgaactcctcaggaggcttatagatttgctccttaccgcagtggtatttatgtctgtctgttttggttatggaacctatatttattcgtacaagcggataactgctgttactgcagcttgtgcagcggcttcaagggtatgtcccatcatttttcgctactaactgctagtaaatatttgtgctatgaactaatctctttaacccactttttttttggcaggaacctaaatcttggtggatgccaaattcagtatcagctttcaattcgggtttgctgtttttcaggtgtcatttaatagcagcaacaaggatgtcatttggcatgttaatgattctcttgattgcttggttgatattccagcgttctgcaatgactggaccaaacatgccaataacgttcaatgttatgttattgggagttctctgtggttctgtcggaaggttctgcgttgacacactaggcggggatggaaatgtctggct

SEQ ID NO: 46546 - DNA, 846 bp, Oryza sativa
atatatttcttttttgctgggaatgctaaagttggtcagcacatctgtgttgtttatcatcgacagcaacaatcgccaatgaacgatgaaagtttttttttgtttgaaggtcccaacttaactcactcgattttcacatgcacatttttttaattactgaacggtgttttttttaacaaaaatctatatgaaatctatatgaaagttaatttaaattttatattcatattaattttatttttttaaaaaaactaaaacttaattaatcatacgttaatgagttatgtcattttgcatgaactagggatgaatacctaacccaagcaacgacctcagccttaagtcgccgacgctgaccaactttgaccatttgccgtggcagttcatgccttcatgaacccagaactgacagtggaatatgttctcattgttgcagacttgcggtggatgctaccacgcgatgacacgagtactaaagttgcgagatggagtaatataccgacatactccaaggctactatgcgtctatgcctaaatgaacttttaatatggacagcttgacaaaaccgtactaatggctttcagtgaaggactagtaaaatgagaataaatatggcatggcacacagagaaatggtaatcttgggtggctggttaataacggaattaaagtcatggccaacaaatttatgaaagaattacgctggtcagacgtcactcgacagttaaaagacaggtgcgattatactataagtcaacttgatcctctttttttttcacataagttctcttaaaaaaaataatgggcataagtcaacttgatctttgcttaggcacccaattcaca

SEQ ID NO: 46547 - DNA, 1243 bp, Oryza sativa
taattttcatttccatgtctatctgtaatctcatatgtgtttcagtcgcctaccttacatgagaatagggaatcacattgatatttcttaaatgcagtatcgaatttgaccgtgatgatgagctatttgctactgctggagtctcaaagcgcatcaaagtctcgagttttctacagtaagttttttttcaggaatcttatgttggccatagctatatgcctgtatagtatttgaaaatactcaaatttggcctatcttatgtcgtaggttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccaggtatttcttgctctgttccacagttcattttgcacacttgtgttattttctgaacttggattcatgatatttatgtattcaatcttctttagagtgtgatggagtatgaagaacatgaaaagagagcatggagtgttgatttttctcgaacagaaccctcgatgctagtatctgggagtgatgattgcaaggtatttgcaaatttcaatggtacaactacttttgttattcccgaaagcaagaaaactttgcgtagttctcaaaatacagtaaaacataacttggatatatcgcatgttatgcaacatactaggattttattttatttatcagtttttcatgtccctttttctataatggtgcatttttctacctaggctatcccaacctcattgaatgcatagatggaagtatctgtattgcagtataccttatggaacctactgctgtttgtgctaggtcaaagtgtggtgcacaaagcaagaagcaagtgccatcaatattgatatgaaggccaatatttgctctgtcaaatataatcctgggtcgagccactatgttgcagtatgttcctttgattttcttggctcatatcaaatataagtttttttttccttaccagatgttacattattgcaggtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctg

SEQ ID NO: 46548 - DNA, 829 bp, Oryza sativa
acattttcaaaagtaaaacatgtgaagtgactgacctgttgcagtgcatatcgaaattggtctatcggtgatgctgtcttcgcaatttggcgagctgacattttcttcaagacctatgcagacataaatgtgataaacatgcttagagatacatttatacaatcccagtatcaagtaaccagtaattacagcttgttttaagttttaacagaactagagaagaactctagtgatgaacaaattatataataggtactgataaccagagcagacatagaactaatactgtccactgctggtgattctaaacaaaacttacattaacaacaaactgtaatgtaccgtgcaagtcaaataaaactgagctatccaatcagaacacctgctactacttcagaagctaccacaaacagtagtacaataaatcgcagctcaagcgctgaatactgttgaatagttgctacaaacgaatcgaaaggcatactgttgaatagttgctacatttgttaaaattggttataccggatacctatcccaagccacatccaaaggtacattcagtgacatttcaattttttttttttgcggggcagtgacatttcaattacaaagccctgcgtttgaaattaggataggcatccaaaattcccaatcgatcggcggaatatggaagccacggccaatccattatccatctcggctgtgtaagcagaacgagcaagcaaaccttgtcgaggaggaagttggggtagagctgcgccttggtgaggtagttgccgcagcaggggcagtcgctcttgtggctgagatgcgtgacgatgcacatgta

SEQ ID NO: 46549 - DNA, 2482 bp, Oryza sativa
tgcgcatttaatccgagtagtttggtttgcttaatccgtgcgaggaatttggcaggtcgggacggacgcgtcgcgaagcgaccgggggagtggttagagtcccaattgtcctcataaatgaaaaccaaaaattaaaatttcaaacttgagaattttaggtcgctaaaacatctctgtaaattactactaccttcatattttaatatatgacgctgttgactttttatctaacgtttgatcattcgtcttattcacaaagtttatgtaattatcgtttattttattgtgacttgatccatcatcaaatgttttttaagcatgacataaatattttcacattatcacaaaaaatttgaataaaacgaatagtcaaatattgataaaaaaagtcaacggcaccatacattaaaatacaatacggagggagtactttaatttaggtaaccgatgagtaaccttagtttcagacgtgctgggtccggttgttatgtgggttacaaaacagcgctgcattgaacaagtgggtgtggtgaaatggatgttctgttagaaaattcttgtaagagaagatcatgcgtgtttctgggatcattctccgtgtaaaaaatgcatcatctccatggccaaattggccactggatgctatcactgacccggtgcgtgagcccgtggccaccacacgaattctgtacggctgtaccgtattacaggcaagggtttatatttccaatcgaggtcccgctcctgaccctgtcagtataacggttttcacgaaaaccgtcaaatttcaaacaaaattaagaagccaaattctcaagttccatttgcccgtcaatgaaaaatgatcaaaatcaccgaattccaaccggaactaccaggatttcagttgattcgaacaggaaaccaccgttccagtgttttggaaaccaaacaaaagcatctaaaactcattggatttgctgaaaagccaaagagtagcgtgggaattaattgtgttttctgaatatttggataataggggaaaatgtttgaaatatgagaaaattcatggagatgataggaacattgcaaactaaaaggatatcaaaatggggaaaccgtggaaacgtgggaaaatgtaagaaattaataaagaaattcagcatgacctttcctacaatttgacaacctcacattgagcataagcgcaatgtatattcatgaacacaaatacaagataatttgaggtccatatcattgacaattaaatatgcataaccaaatatatgttacgccattaacatcaacacgcaaaatataaagtacatcaacacaatacaaagcgacccacaatcaatacatactgtaaagtgcataaacaacatagtataacatcaatacaaagtccataatataaagtgcatacacaatcaacacatattgtaaacccttctagatgtcttttttcaatttaccaattcagttgttgtccaaagagcattttcattctacgcctatattttttgacatttcatatgcatgtatttactacaaatgtaggactatttacaagttatttttaaaatattcttcataaattttcaattcaaatttgaaaaattctgaaacgattcaaaaattccaacagaatttgctttcgcgctgcgttgaaacgtcagagttgtgaagtgtgaaccctaatctatctgatcaaagccttctttttttttggattgatttcatccaggagagatgtcagctagacagagacgatcactgatcacgcgacaagttgccatatcagagacctcaggctagggcaacacactgccagcactaacccatacttaacgaggactggggttcagtttataaaggagtcaagagttcaggactgattcgatgaccgatttcagtcttgctacattctatcactgtctggaatgataagacaaaccaaaaacgaaatttcaatgttttatactacatcctatcgatctatctgaactgagaagagacgctgactgaattgcctagacaagaacatagaacatccaactccatcactaagaagcaaaattttgcaggtaatgcctgttcacgatatagtttgcaggtaatgaccaggtacactttcttatgccatggtaaggaacgccgagctactactgttcacttcagttcagctcacctagtcactcgaccagctcagcgagcaccttggtcacctccttggtcaggtcgccacggcgcagcaccaccgaaatctcggcaatcctctgcttcttgatcttcatgtccagcgcatgcgccttgtcgtcatcgagcttcccgaagtccctcttgaacaagccagggtgtgccgcctccagcaacttgacctcctcagcgaggtgcgggtacagctcgcacatctcgccgaactccctcggcgcggtggtggtgccgttcaccgccgccgctgccgcctcgctgccccagacgctcctggacaggtcataga

SEQ ID NO: 46550 - DNA, 967 bp, Oryza sativa
ggaccggatatgaaaaaacattcggttcggttaacactgtgaggccgtcaggtgcatcaagctggatgtgtcaaacagctccatgaatctctgatcagtacttctcgccttcgccgctgcaaaatgctggtactcgtcgaaaactgaagttaggcaccatttctgcaactttctcaggcacccaacgacgcagccagtccggtgctgaaacatgtggaatatcaggaaaccgtcgaattcccatgtagcaaaaggtttcaagaaaatgggatatcagggatgtgcaatgctaaatagatatagctaccttgcctctcttgcagtggatgagcaccggttgattccttacgtctgaattgatcaaaacgataagagttagatacagatagtgtgatgaaattttgagacattggatatatctttgtagaggcagataccaagaataactttgagtgcttctcggattttttcttcagggatgtttacaagcagctcctgtaacagcaaggttcagattattgtcaggctatgcatcaactttaagagtcaacaggattgaagagaatggtcagttggatgcatactgaattactgatgatatggtatagcaatagaaggatgttttaatttgtttcacagtttcaggctaatgcggtaactgataaggttcacctttatcgaaagttcagatgcaaagatatcgtcatgccactcaagtatgtactacattattggttctagttaacaaagaaacaagcttagaccctgtttagatgggactaaaactttttagtccatatcacatcgtatgtttggacactaattataaatattaaacatagactattaataaaacctattatatgaccccggactaattcgcgagacgaatctattaaacctaattaattcataattagcctatgcgatgctacagtaaacatgcgctaattatggattaattagg

SEQ ID NO: 46551 - DNA, 3073 bp, Oryza sativa
acttgtatggcagatatgtgaaaaaatcgtgactgtagcattagaggaaactagaaacaacaccaattgttccagttgtatttttctgtccatatagttctcgtttggccctgaagagtgaagagtcagaaaagtgtacacgattggtgtttagcgtgatgttgctgttttggaaatttagaacattgggtctcgtgtctacatgattaacaagctttcttagatgattttgatgttctgacttgttatcttagatgtgcatgttctgaaccaactgaaatcgatgttatgttgacgtactatgttggtttttgttactttcctttaatataccctttgttgtctggtattaattcttaggaatgtatgtggcaaaccgtgcgtcggacaagattactcagctaactgacaatgtgtacatctgccgctctggatctgtaagtatctatattagggactttactcctttttcatgttgtctcattgtactgtggccataagatattgggaaatcacgagcttcctattcatcaagttatatatgttcttttgttatactgtgtcatgtcatcttgatcggttttcccagtcattcattgccctctcataagttacactctcattgtcaatattttactttgattcatttattctgtagttgttagtagtcggcttctaattattatcagctaaggcatttccaagagtccagtagtattcacatgtaaatatttgtttctctctgtctcacaggctgctgatacacaagtaatttccgattatgtacgctattttctccaccaacacacgtaagttgtccccttgaagcgaataggaagaagttgaatgaactcttcatatatattgttctactagttactggaaacatttgatgtgcaagacagttcatgctaaattttccctccattttcagaattcagcttgggcagccagctaccgtgaaagttgcagccaacttaattaggttgttggcttatcagaacaaggtatattttctatagcattctgcgatccaataactccatgactacatgagatgaaattctttctctgatacacgattttttaagttattgttttattgtcgcaatggtttctctgatacacgattttaagttgttgttttattgtcgcaatggttttttttttaccattttttttatttttcagaacatgttgcaagctggcatgattgttggtggatgggataaatatgagggaggccaaattttctcagtcccccttggtggaacaattctgaggcaaccatttgcaatcggaggtatatatattatggcaaatgtctcttcattgggctcagagtaatctaatgggaaacatatttcccaccaacatttgtgtctatatataacatatctacatatcgtacaagaataatttgtcagttcaatagtataagccaattagttatgagatattttttttcaaacttacctgagcagtttaattttttcaagcaaagcagaagcaatcttttgcagttagcaagattcatttctttctttatttgttgatgtcttgaattagcttgcctcattcttttttgtttaccaacactgtcctgtgcaaccctgccctgttataatcattgactataaaattttcccaagcccctgtttgctgtttgcctgacaccagatgctatttctgagttttgcaggttcaggctctagttacctctatggattgcttgaccacgaatggaaggagggcatgtcccaggaagaagctgaggtacatcatctaaatatcaaacagtcgtaatccatgagtaataagagatagtttgtcagcatttttgccatgatttaatgaaaatatcacaaattatttatatgtccagattcatagagtgcaaagatcattttccatcacttcagtgttccctgtataatattgctggctgcatcacatctcttattacttaattttcctcttcatctttacagaagtttgtggttaaggtagtttcccttgctatagcccgtgatggtgctagtggaggggttgttcgtaccgtcactgtaagtgctcccttttttcgtccttattgtcattgtctgttcccttgttgtagatattttgaaacatcagataccggaactgattgctttagttgacttcatacaaacatgtaaatttctatgctatatttgtcatgctgtttgctgtgatggccatagaatatagtatcagatgaaacttaaaatgaaaaagttggccttttttaacttccatggactggttttcttgccaaaaatggataatatttcagtgtgatatatcccttatacttcattcagacctgttttactcttttactaaaatgtgttagggtattgtagacaagacattggatgattggaagcattagtaacaaattttcttatgtccttgttgggcatctatttgctttgattgcattttcttgtagctcttcctttttctgaaaatgtgtagcatgtggcaaagtaaattttaagttgaggcatgtcttgttatctttgcttaaaatgctattacttttctgaaagaccaatgattcttgaacttatggatatgataatcttgagataaacgcagatggtgtttcgaggaaatttcaccctggagacaaactacaactgtggcatgaagagctggagccccagaactcgttgctggacatacttgcagctgggaaccctgatccgatggtccaagaatctgccctccagccatacacctcccttaagcaactttcttctgtatctgactttcactagatttactgaagaactggactgcagaattatgttcagctgtgcgcaattatctagtgcaagatgcttcttgtgctgtatgtaatttcttttcgttaaggaagttcaaaaatatcatttagactttgatttgcctccttttgtggttttgatgcatatggcttgccccctcgtattggcagtatgttgctttctcttttctgcatattttcattttgtggctccatatgcacgtcgtaccttatagtcttcaactgaaaaccagactg

SEQ ID NO: 46552 - DNA, 4628 bp, Oryza sativa
acggctctcatcgacgggtgcgtcaagaacgggcgccacgacgaggccatcgactgcttccgcgccatgcttctggacggtgtcgagccggactacgtcacgctgatagccgtcatctccgcgtgcgccgaggtcggcgcgctggggctcgggatgtgggtgcaccggctcgtggtccggcaggggctggagcgcaacgtcaggatagccaactcgctcatcgacatgtacgcgcggtgcgggcaggtggagctcgcgcggcaggtgttcagcggaatgaggaagcggacggtggtctcctggaactcgatgatcgttgggttcgccgccaacggccggtgcgcggacgccgtcgagcacttcgaggcgatgcggagggaggggttcaagccggacgccgtgacgttcaccggcgtgctcacggcgtgcagccacggcggcctcaccgacgaggggctaagatactacgacctgatgagggcggagtacggcatcgcggcgcggatggagcactacggctgcgtggtcgacctgctcggccggtcggggcagctcgaggaggcgatgcgggtggtgaccaccatgccgatgcggccaaacgaggtggtgctcggcgccctcctcgccggctgccggatgcacggggacgtcggcatggccgagcagctgatgcagcacctgctcgagctggaccccggcggcgacgccaactacgtgctgctgtcgaacatctacgccgccgtcggcaagtgggacggcgccgggaaggtccggagcctgatgaaggcgcgggggctgaggaagaggccgggctacagcgccgtggagatcgacggcgacgtgcacgagttcgtctccggcgatcggtcgcatccacaggcggaggagatatctcagatgcttgggttgctcatgcatgagatggcagggcatgattatgaccatgtaatcgattgcttggatgggggatgaattcagaccctggagactggagaatgcagaagactgatattctgaagtcaaaagatagccgacgttagattagagaactgttgtatatcagtagttcagtacatttagctgtcctgccactatgattccccctcatctgtgtagtcacaggagtgaagtccaacatgaattgaattatcgcaaaacacactgatttttctggacaatttcacggtatggctataaaacaaattggattttctcgtcaacagtcaatgacatacacaaggaagccactttacaggtacaaaaacgctgtacagaaacgcggtcagaaaagttaactgtgccgtgagcactgagctttctacgtcccctgcttggctgcttccataggccactaggcgagataccactaatcctccttttgaacctttcccagtttttatccaagtcatgaaacgtagttcgatggttcgcactggaactcataatccctgacaatcagcactaaaaactttggacaaccaactgttcaccctgatggttgtgaaggcacggagtaaacacctgacaaggtatcttctgttcacatgatccagcagcctgaaaggtatcttcagttgaatatagcttgcacatgctgtaagctcgacttcctacaaactaccgctgtatcatggcaagggatttgggatcatcctcagcatcaacagctttcctgtttccacaggtaaaattaaaatctatgaaatgcaacagagagaaatccattaatgtttgcaatacaggatcatagtcatagcgccctatttcttgaaatttttgtatgagaaagaatggaatactgaccagcttatgtacaagcaagtttgttagcaacacaagagtgattaggcgcctttatgttgcagtgatctctggacaaatggatggtccaacagctgagcagcagatggccgatcatttggatttacttttacacacttaattatgaaatcacgagcatcttctgacagtgtagctggaatttctggtggtattcctctaccaattttaagcaaagcatgcgtctacatagcagaagaaaagactgcatcacggacagtaataatacaaattcccggataataagaaaattaacacagcaacatacagtggatttgctgtttgcagttctgaatagaaatgtttaattttcctactgacatttttaaatccaatactacccaaattttcctgatgaaactaatgtttgattttcccaaaaagatatacttcatacgtactgatgtaagcaaacaagtcatcaacatgaagaagttgtcatcaatgtttttgctcctttaattaaatagcgtgcagcccgcgtatatcagtgcatttggtatttaaaaatgggatgctgttactggaaagtaagacaagagatatactcacccattccatatcagggtatggaactttgccagtcagcatttctaaaactgtgcagccaagactccatatatctgctggaggtccatgaggcttagccttagcaacctgaatgagaacatgctatcagaaaatttacacgctcggtacaatatggagacacataccactttatgcaaaatattgcttgaacttgcaagaccgtgactttttgaccacagagatacaattatgtgtccatgcaacatcttacaagtataaagaggtgaacaatatgaacataatagatcaggcatagaaatatgcttaaaacataaaatggtaaagcacctacactcttctgaataggagcgtaaggtaaatgggttgtacaaaaaggaccaaagcataactgtgagactaacctcaggggccatccagtaaacagttcccttgctagatcttgcctgactcaaaattgacatctgggacatgccaaattagaaagagtgagggcaacatgtagtctagtgacaaattgattacatcagatatttgatagagcaaatacctcttttgcaagcccaaaatctgccagtttaactaatccatttgaatccactaggatatttgcacatttaatatctctggtaacatagaaaagaacggggtatcaataggccagcaagaatacagttgagcaaatcctaaacaataaaaacatctaagctagagtacactatcacattgatagagcattatagtaatgcacctgtgtaacacgttccgctggtgtagatagttcaaacctatcaaaatctgccttgtgtacgctgagacttgtgagtcctgtaaacggtatttttgatatagagctgccaaagagccttgagttactagttcaaggaaaatatacagttttccatcttcctgtaaaatgtttatccaacaaagtaaacgtaaacgtcgaaatcagcaactcaagtcagacaactgttgtttacatgaagataactagcagagtaaaagcaacataatattaaaatcaaacgaaaagaatacattcacaactgtaatcttaatggaattaacatctataagaaaggaggattaccttgtctgttccaaaatactgaacaatgttttcatgctccaaacgactcaacagagagatctcctggaaccaaatgattcaccagtattctcagtggattgaaacaaaacaattgttgcttggatattaaatagttcaataacaaacataatgtttgaaacagggtaactcacatgctcaagttggacaatgcgttgttttgcattgatcccttgatcaatcaatgacacctccttgacagcgaagaaaaaaccatcactgtaaaataaatgttaaaagtcgattatgaagctttttattaacaaaacgaggcacggctatatagtaactgttgacagaagttatattttccaagagtggtttagatggaatccacgcagtgctacaaaagaactacacaagggttcacctaaataattaaatttgccaaatgaagtgtaaaagcactgagtaagaaatttagctagccgcatgattcagataatatgttgcatcagtatgttcaagtatttcattcaacccggcataaaataaatagcccaacaagttgaaatggatgcagccaatttgtgaaatctcagttcggtggacacatgaagctaatactcattctgatataccaacaattaagtgaactagacagatgacatattctgatttctctgcatagtccaaaaccattgatattctttcttcgttgtattcctctcataaaacagtagcaaatgcaaacatattaacaacaaacataatgaaaacgaattatgcaatcgtcaagacagagtaggcagatcgatacttactcactgatagcctcatacactgacccgaacgatccactcccgagatgctctcccttaagccaggacgtgatggttctcctaaaccgcctgtgaggagagggtgaaatcaaatgctcgatgtcacgtgaagtggactcccttgtcgcctccacgaccagagccgaggcaccggtggtctcccttgtcgcctccacaaccacctctcctctaatttcctctcgtgatttatccaatctgaccaatttacctttctccttgtcctcgtctgcactatcctgcttcagcagagctcgtttagaagctactgatctgacgctcgctgcaggccttgcatatgatcgtgt

SEQ ID NO: 46553 - DNA, 2254 bp, Oryza sativa
tcggaaccgcggcttcggctggagaagcttctagaagctccggcggggaagccacctcgagcgacgcgcggcggcgggcggagctggagaggtgggacatggcggcggcgtagaccgcgggcgggatggtgaagtcctcgggcccggagagccccagcttgcggaagatggcggtgacctccgcggccccgcgccccccgcggatgcggaagctggtctgcgacgcgtactcgcccccgccgtcgtcgagctccccacacacgtcgtccccggagccatcgtcccccgcggcggtgtaggagtgcctcatggcgttgatccgcgcgagctgcgcctgcggccgctggcgcgccgccatggccagtgcccctccctcttcctcctcctcctcccccgcgctcccgcggcgcagcagcagagcgagcggatcgcgagaagattgggggattctgctcgtggtggggtttgactaggcacggggggctcacgcgcgacgacggcgacgcggccgtgcgatgtgggtgcgtgcgcttttgacctggacccggtgcgctgctcgccgtggcgccgaggggtggtggcgagcgagtgacaaggcgacgccggaaagagacccgcgttgcggatgagggccttttataacggcgtggagccgactaccctccccgtaccccgagagcgacccgagcgtcgatcgagacgacgtcatcggtaactggctaactgctcccgttacgaccaaccgctatctccgagtaccaagtcgtgggaattgcggaattggctttgcttgtaagattcagagtgtgtggctgtttggtttcgtcaccgggaacgtcagcgccgtcggttcagacttcagactcagacatgcagacgcggagtagcaagtcgtcgtaagtctcaaccataaaatacatgattggttgattgctctcccaactaatggtcaaagtcgcaaagttggatagtgggatatttttataaggaacagatgtcgtacaaacaagtactcgtgaaattagccataggactatgaatttccaaccacaagcattctgactttctgaccctgaacttacaggaaggaaacaaggagctactgaatgttcttcgcctagcaatgttaagcaaacatgcagcatactagtctggttctggaacagccacgaagggatgattcagcagttcatctgcagaaggccgatcatcaggattcacctgcaagcatttgtggatgaaatcgcgtgacaccggtgatatggagcctggaactggaggaagttgaccacggccaatttggtagaagactgatacctgatagaactgaatcagtatcgaatttgaagagactgtaagaagtctaaatgagtactgtaggatttactgacccagttatcatcaggataaggaattctttgggtaagcatctccaagacagtgcatccaaggctccaaatatcagcagaatacccatacggattgccacgaacaacctgatcatcatcagatattcagataaccaatatagattctgctggtccggaaagttggacgactatcgtaaagtaaaagtgcaataaattcttcagagtaacgtttatctagatacttcatactaatatgtctaagagggttgctcccatccagcaacttgtaccggcaggtactggtaccggcaggtacagagataaatccatccgtccatgttagaagggtacgatcgggaaacagagaaaggagtcgcaccctcgctttctctttttcgctctttctctgtttcctccctccgtgtggcgctgctttctcatctaatctccttttttttcctccctccgagcgcagccccacccgtgcgaagcccacctgagccgcgcgcatgctcaccccgcatccatgcccccgcctgtgcgctcgcttgctcgccccgcatctgccatccgcggcggcggaaccagcgagctccttcaccagcggcttcattcacgcccttactcgaattgcagtaatcagtaaatgatatgggagggtattggccatttgaacattcacaaagaacaagtaatggttgagctcatcaaaacatccaataaatcgtacaatacaaatcctataagcaatgaagaagaagagtatatgcagcccagaaaatgaaagtatctactgctgcaaccaaccgaacctaatgatttagatcggatgaaaagaaatcgatgtatacactgccacatcgcctgctaagacgactccatga

SEQ ID NO: 46554 - DNA, 3799 bp, Oryza sativa
ggaaaaaaggacactgaaaccaaaaatgaagtaacctcctttgccagtccaaaatctccaaccttcactgctccatttttatcaaccaaaatatttgcacacttaatatctctgcattgaaaagggaaggacagtgcagatttaccataatatgacaaagaagtacttcactcatttagtcatttgatcgagagttgtacatctgtacttaacttgatcactactataacaagtacattttcaaatgaccgggccagcagcaagaatttttttgtggagataatgtgttatcacctatgcattacattatgatgatgcagataagccaatccattgaggatctgtcttgtataaagatgatatagttgattcctccagctgttgcttctcatatacagataccaaagaaccttcactcacaaattcaaggaaaatacatagcacggtttctccctgcaagcaaatccaaacagggatagtaagctcaaaccgaagaaaaataacctaaaatgaaggtgtttgggaggcaacagtttgcagaggcgatcagcaacataatgaagacacttgttcaactagcatatgagaactggcataccattttggcaccaaaatactgcactatgttcttgtgctccaaccgactaagaagcaagatttcctgaaatgttgttactaatactgaattagcttatacttggaatcatttagaattggagaacatcaatactctgaaattttacccctgacaaaaattgcaatttgcttaattaaacacttacaagataatttttcacctaattaattgataagagataaaactacctgctttagctgacatgcggtttgcttcgtatagctttcgggaccaatcaacgaagcctctttgacagcaaatacaaacccatccctgacaaggcaataatacgaagaagcattgagaaatacagagataactcatccgaaattgccggtctgctgaaagaatagaacacacaaccagacacgaagtacaatgaagcattgcatcgaacagttcatgagcaaggcaaacggtaaatcgcaagcggacttactcagccaccgctttgtacaccctgccggacgatccggccccgataagatccagcttactccaattcaagatgctcctcctgatcaccatagccgcgtggacagagaccgcagacgagctcgaagtcgacgcctcctccaccaccaatgcggccgcctcggctccacctgcctctgcatgatctccgacctcatcttccacaaccctttcctccagaacggattcctccgtcgaataccagaaggcgggttggtccgactccgacggcggcgagagctgtgacgccggccgggccacgtacgccgactgccggatggcattgcggcggctcaacctcggtggccggcgggatcgttgcgacggctgcattatctgtgttcgggctgactggatgatttgttgcttgctggtgttcgacaaaaagaattgttgcttgttgacttggcattaatcgttgggagatggagtactctacttcgtggcgcgcggggagcaaacagcgtggaggaatgggtgtacggctgtacgcgtcacgggcgggcgggacgcatctccgcgagaatttaatattcagagtatcgttcagatccaattatcggcccatgtacggcctattttatataggctaaatccaggcccatttcatggacggccgctaaactagtttaaactgagtaaagttatggcccatgcacacggatataagacgatttcagtctaatataaagtttttactacaattttgataaattgcatgtttccttatatagtggtagtaactttggtacgggagtatctaaaaaaatgtctcaattcttttaatgaaaaactttcacatataacaatagtagtatataattgagacacaattacattgtaactgtactgtaattacatggtaactacgatatagtaacttatataaaacttgtattcaagtatggtttgattagttagcatcatgttcttacgcgtgatatgtgtaaaaaattatttctagaaaaaaaattctttcatgcgcaaatctcgaggtaatccaatggttaaaaatctaatagttttgaaggaaaaaaaaaaacttacggaagttttcgagcaaataggtgcactgcctaccagagggcacgattactgtcctttacgacaaagcttcagctctggattctcatcctgtgaatagtggatttaaagccaaaccaaacgttactaaattacaattcttttgagattatagctagtgtaatgccccgttttttacgtggcgttcaaaactgatgaaatacctatccgtgaaaatctcgtattctgagtgctctatttatctcctttccttcaaaaccaaaattgactcctcaaaattaccgtttcgaaatagactcggagtttaaatttgcttgtttgaacctccctccttaagtctatcagtaaatcctttcaactattcaaatccaatcctcgtttcaagtaatcttacaactccaaaatatttgagtcccaccgtgtttcccttccttgagtagtccctacattcaaatatcaaacttgaatcaaatctccgtaacgtccaatttcaaatccaaatcaaatcaccctcaaacttcatccaaataaatccctctcatgcctatttctccaatcaggccgctttctcccttctttatctaagcaggacagcccagcagatccctctcccttacgctcgcgtgccgaagctccggtctgcccgagcccgactcgccacggctgctcatcacgtgctgccgcgcacatgcaggagagtaggcaacctcgctcgctcgccagcgcggccagccatgcaacctcgccgtttcccgccctcgcgtgcgagtcaccgctctggccgccgccttgcctccgctcgccgccaggcgccaagctaccatgcctgcctttaccgtcacagccggcgtctcaccatggccccgccgctagtgtccaaggcgtcgacgccggtcagtccgccttgccagtcgcgccaccagaagcagtcaagcagagggaggcctcgctttttcgcctcgcgcttttcctttttcctccttgcctctaccttgtcctctagctcggggagacgcggaggcaggcacgccgatgacgtcgccgctctgacgcgctcgccccaccttgaccacgccagctctgttagaataggtgtcgaatatactagtcctatttggttatagttggacttggagttgtaataggtgttaggggtggagttagagtcggactctgtaacccggcaactatcttaaatagagaggggggcaccacgatgtaaccatgacgactacaatgtagcgtagacacgcagtgagaggatggcggcgtggccatggactcgtagcggctaggtgctatgttggttggggaggagcgtccataatcagagccccggggatgtaggcttcggctgaacctcgttaacaaatatcgtgtgttcctgtgtcgtcatctggcatgtcttgggtgatcaacgactgaagcgatcgggaaggttagtcgtcgttccgctatatcgactaaattttataacatgtggtatcagagcccaaggtttgaaacccggaataatttccatgggtcacatggtggagaggccaggtaagaagtcttcggggtcacatgggttgatgtgacgggggagattattgggcccgatgtgtgacgggggagattgttgggtttagtcccacatcggta

SEQ ID NO: 46555 - DNA, 1455 bp, Oryza sativa
acgaggccgggcgtggccgaaggcgttcggagagatcggaggggtagcgccatggacggcgcgcccgacgcacgcggcgatcgcggatccgcggcggcagggaggctagtgatggaagggcgaagccggcgagcgtggcgcggcgcggcggacgtgcatggccgatgatgacggggtcgtagacggtgaacacgagggctgcgactgcggtgcgtgcggaggtacagacgaacagtacggatgctgttctttgcgtacaacttgaacggagtcgagcaaatcgcatggatcggagaagacactttcatgcggcacgatttgtatacaatcatcatggctgcatgcattaaaatataggatggctagtgcatggtggtcgtcaggcatatgcacaagctgcatgttacagtgctgagattaaggccctgtttttttcagcttaggattattataatccaacttattgagtcagattattataagctggattattataagctagaggaaaataagctgtgagctgtttctttctctagattattggaaacctggattattgagtttgcatggctaaagtctagaatgccctcaactatttttttggatgcctttgtcatcattcggtgactttatacaatagatataaatttgatgtagataaataaaaatttgacaaatatttataattatacattcatgaatatttcttccacatatatattagacttaaaaccaaattattatctcctagcaaataaagcatcagcaatactatcacggaaggcatttgcgtccccatcttcgtctcccatgtgactggcattcccttgagatgaaggcatcggcatgtagttttcatcattatcacacagatcaaactcttcatcactcaatttgctatctcgaataaaattatgcagcgccatgcaagcatgtattatttttgtttgcttgagcattggataacttggtaagtccaatagaattctccatttcatttttaaaacaccaaaagagcgctcaatcacattacgaagcgatgaatgtaagtggttgaacacctccttcttgccactaggacgtggaccctctcgaaattccggtaaatggtatttggtccctttatatggagatagatatcctagtcgatttggatagcccgagtcaacaaggtaaaatttccctgttagcataaacataaaccatgagacattattttataattgatgctagttcgacgagactattaaacggataagagaagttaccaggtggtggatgagggaagatagcggcatatttgcgcaaagcatcattgaacaccctcatatcatgtgccgatccaggccaccccgcaacaattaatgcaaacctcatgtcaaactcacaaatggccaagccattttgcgtcggatatttatttctacccacatgttgaaccacctttgatgcggg

SEQ ID NO: 46556 - DNA, 992 bp, Oryza sativa
cttttctatacttggacttgttcaaataattttcagcgtagaacataccaaatgatgtcaacaccggtccaaattttctcatcatatctagttgtctgctagcaacaataatagtttcatcctcctcctcatcgtcatcatcacttccatacatgcccatctacaaacaatgcaacaaatgatatcacctcaatagtcacagaaagaccatgttgatggatcactaaacagtagttcatccaatcaaaattaaggcgccatattacatggccaggcagtacataagttcatgcgaataaataagtagcaatcttgctaatacatattgtctgacaaagtaaaaacagagataactagttcatgcatataaataattagcaattttctactgctgcccttccttctcgcaccatctctgcaaccaagagagccttcccaccttggtggtaagagtcttgaacatatcacgatgttcagctttcacaaataatcttgtagccatgaaatgctccgcacttccttctgctgccccgcaatccaccaccaaatccatcacctccttaatggaattgaacctaaattcaccttgcatcaccttgttggcaatatcacaattggtatccatagtggtttgaatattcctcattatcctaaccatggggttcttaaccttcttgtatggactagtggcggtgctggaagaccctcgcttcactggttttttacccaatgagcaatctactggtgtgtcgccaaggtcctgtacatcaccacttgcatcatcccctccagcattttctccaggtgcacaagcagaagaaccatcaacagcaatagtaccaaacatttcatccagcaattctaaacattctggtggtccatgttgtagcttcttccattcagaatgtccctaaaaataaaacatcaaatcttcaattattgcaagcacttaaaacattttcatgaaaatcatgtacatgagacatgaatta

SEQ ID NO: 46557 - DNA, 918 bp, Oryza sativa
ggttggtattgaacactgaatattcagcaaccaagagaatggcacagcgacttaatgcattcacaagcagtgtcagatacttcctgctgacatcatcagccagaatcatgcgcacacagaagtacactttaaaccactcatttcctattttattaatcaaactgaatgcaaagcttagctgagcacacaatctcaccgaagccatggctggagttggtcaacaaggctgacaacccgttcgtatggggcagcttccttcaccttgcacttgctggcacaattagcaaagcacacggtgagctcaatcgcgaggatggtgacttcagggtccgcaccagcctcccctgagatgccaggatcaggaaggagggaagcaaaactcgcagtcgcagcacggcgagactttgaggccgtcggcactgacagcacagaccgaagcgaatccagagtggcagcagcgtccgcctcggcgcgtgcgtagtgtccgcgcgactcgaggcagcacacgaatcggccgcgctggagcagcacggagtagggcttcccggcgaggcacgccgatatgaccgcgaggcagtcaaggaggagggcgtaaacgtcgagcagctcgtcggtgcacccggcgtcgcctgagctagggttggggcggagtagcagcgggagtacctggagcgcgcggcacaggaaggggaggaaccgcttagcgagcgggcggaccgtggccgcgtcgggtggcggcggcggcggctgctgcttgcgctgcttcgccgtcctcttcgccggcggtttggcgctagggtttagcgtgggtaggtagggggagaagggctcgaggtaggcggcgaagcgggaggtcaggccggattgggaggacggggaggagagcgcggcgaggaggtcggcggcggcggcctccat

SEQ ID NO: 46558 - DNA, 1580 bp, Oryza sativa
tatttgctctagtatgaccaatgaaatatacatcttgattctcaaatgaaccatgtgcacaaccatccatcaatctacactctacactttttccatggccatcgaatgcgaccgccgcgcgctactccgatgtaccggaactcgagagagctccaaactttgaattaaaatttatgcaactatgctacgtatatgtacagtttttgcagtgtcgtacactacacacgtcacgtttcagaagacgaggcaggacttgtcgaggtcatagcccatcttctccaggcccggccgcaccgtgcactcgaccatcgccggcggcccgcacacgagcgcgagcgtctcgccgtcgcccggcggcaggtgctccctgagcgtccgctcgtccaccctccccacgccgtactcccacccgtcctccggccgcgccaccttgctcaccacgtaccacaccttgagccgcgccgggtgcgccgccgcccaccggtcgatctcctcccggaggagcatgtcgtcctccgtccggttcgcgtacaccacgtgcatctccgttccgtcgtcgggctggtcccagagcacggcctggatcacctggtacaccggcgtgatccccgtcccgccggccaccatggcgagccgccgcgcgaaccggcgctcgccgttcaccgtgaaggcgccgcggccggcgtactcgatgtgcccgatcgggcccttgatgtcgatggtggcgccgagcggcaggtagtccaggtactgcgacatgagcccgccgtcggggaacttggggtcctcgcccttgaagtatatcttgatcaggagctcgatgtagccgacctcgtcgacggagctcgtcggcgtgtacgcgcgcatgcagagcttgccgccgatcgacgcgcacacgtacacgtgcttgccgaccggtagcccgagcttctggtccggcgacggcagcgcgaaccggaacaggcgcacgttgtagacaggctcttcttgtccatgagccggcatttcaccttctcccgcgggttggacagcgcgacggtcgacaccggcacggcgggcgccgccgctgccgtagggctctcaacgatggacgtgaggtcagcactgctgctctgcggcgagtagtcgctgccggtgacgatgagctcgccgatgcggtacatctcgaggaggccacgggccttgtcggagtggatggcgtcgaattcctcggtgcagtcggtgccggcgttgatcatgatgctgtcggcgccgccggggtggtccttgaggaaccccgtgcagtcgtagacatggccgtgcacgatgatccaggcggactccggcgtcgtgtggcggcgcacctcggacatggtgtactgcgtggtggccgtgttgaggaacggcgtggacgtgctgcgcttcagcgtgctcaccgcgctctccgacgtctcgaggtgcttctgcctcgccatccacccgccggcctggttgcccggctgcgtcgggtgctcgaacaccagcccgatctcccccttgtgcggcctgcacgtcttcgtcttcaccctgaaccagcagttgttcatcatgccctgcacaca

SEQ ID NO: 46559 - DNA, 2445 bp, Oryza sativa
tcaccatcagtacaaagatactgatattataacggcccagtaaaagcataaagtgatcatggtgggcttttagaacgagcatgccgaagcccaaaaacaaacaacatgatagatgagatgggcttggggcttaccggagtaggcgtatcccttcatcgtatacggccgctgcgtcgtcagcgcattgatggggagcacctcatcgtgtcccggcgtggtgatcaccgagtttatgttcagctcgtttatcatgtactccggcttggtaccaccaagctgcacataatccaaaaaaaaaacacacaagttaagatcacaaagatgcaacaatgtgtgtctcgtgcagtgcgttcgaggaagatatggttggttaattaccttcggcattggcgagctcggcgtcgacgtgagacgggaggacgcggttgtcgcggtaatggtagtagctctccgactcgctggacgcgacgatgatgcgcttgagccatttcaccatgcggccgccgatgaagcccgggacgatgacccggacggggaagccgtggtcgggcgtgagcggctcgccgttctgcatgtaggcgaggatgacgtcgtgggcggggtccatggccacctcccggcgcaggctggtgccgtacttgcacccgccgccgcctgggaggtcctcggcgccctcgaagcacacgttggccgcgccggcggaggcgcccatgacaccgcaccaccgcagcacgtcgcgcagccgcacgccgcgccacacggaggtggagatggcgccggggccccagttgaagcccacggtctggcgcaccatgttctgctccttgcgccggttgcccgcgcacaccagcgtgacggggagctccacggcctcgaacccggtcacgagctgctccatgttgagcctcgcggggcgcttgacgagcccggtcacctccacggcccacgtcgaccagtccgccttgggcacggcgccgtggttgcgcacgtagtggagcggcgccggcgtgatgaagccgtgcgacatgaggcgcggcagcggcggctcggagttgaacgggtgcttgccggtgagccggacgagcgccgggtggcgacgcacccacgcgtcggaggtggcctcgtcgcgggggtccttgacggccggctccgccacctccagccgcgggtggtacagcgacctccagtccggtggtatgctgtcctcgtcgtcggagtcggtctcggagcccgaacggcgcttgccgccgccggacgggaacaagtcgaggttgctcgacggagcattgctcgcccacgggtgcggagccagcttgtactccaccgaggccgccattgttgccgatggaaggacacaatgttacaattttgcggacactgtaagctgtaggttgtagctgtggttactgagctagaagaagagatcactcgcgagctagaagctcaggatggcatctgttcttggaagcagtggaggtggtggtctggggtttatatagggacgaggaacgcgaggtcgtagtagttgcctctgctctgatgcatgcacggacccaagcaggccacgagctggcgtcaccacacgcgcaggcgcgcgatgggatttctagggggattcggccggattttttttcttcattttccagattaataccggcgacgtgacgtccatccctgtagcagcctcccatctaatacgtcctttcaattcctcttgtactagatagaaaatgacctatttcttttggagtttcagactgttgggagtgaattttgatcactctagggatggtcgatctctcgttatctgtatgttacttaaaaaactagcatggttgccccatgcagattgtgcggctagcatcattatattttctttcatataatagcatatatgttttctcattatattatttaaatatattaaaatgacaacataattttaaattttgcaataactttataaaaccactaatgtgtaatattcatattgtattttatatacgtgttagttattaattatttttaatatcaaattttagttatttgtaaattatatatattcctatatggactctacactcgtcttttaatatttctttttttaattctgaattttcagtgctcttctttcaatattatttatttttatttctgaatttttattatttataattgtatttctatgtggactttaaacttatctttcaatattatttaatttttaatttcgaattttagttacttctaaattgtattcctatattgactttaaactcttcttcctatgtttttcttaaattcgaattttagttatttgtaaattgtatttttatacggactctaaactctacttttaattttattatgtttattccaaattttagttagttttaaattcatatatgaactctatactctacttctaatattccttatttttta

SEQ ID NO: 46560 - DNA, 4633 bp, Oryza sativa
tatatttctatgtggactgtaaagttatcttttaatattctttaattttcaatttcgaatttcagttacttctaaattgtattcctatattgactttaagctcttctgctcatatttttcttaatttcgaattttagttatttgtaaattgtatttttatacggactctaaactctacttttaattttattatgtttattccaaattttagttagttttaaattcctatatggactctatactctacttctaatattccttattttttaattcataatttctatttttttcttaattgtatttctatatggactctatactctacttctaatattccttatttttaattccaaatttctattattttctaatcgtatttctatacggactctatactctacttctaatattccttatttttaattccgaatttcagttatttcctaatcgtatttctatatggactttatactctacttctaatattccttatttttaattctgaatttcagttatttcctaactgtatttctatatggactctagtctcctcttctaatattccttattttttaattctgaatttcaactatttctaaattgtatttatatatggtctctagtctcctcttctaatatttcttattttttaattccgaatttcagctatttctaaattctatttctacatgaactctgctttttctttttctccgattaatgtgagaatttataggccatgagagcgaacgtggaggctcctttttctattcctttaataatataatagattataaaaaataaaaaaaataaaaagatgtattaacatatgatatatcgctccataaacatacaagtttaaattcaacttatacatctcgaaaaaaaacagacttgatcatgaatatgatgtactttaatttgtttttttcgttgcaggatatagaagttgaatttgaacttgcgtggagtgatatgtcacatgttaatacatcttctcaaaatttttcaatttttttataactatttaagtgacatgcaaattatgagaggagatcaaaatagttttctcaaactgttgcactattttcacatctgcattgttaactctggtgagaatgagcagctcggactgttcaacctctcgtaaatcagacacgtgcatacgtgcctggtaaatgccgtggccgtgttatgctaaacacaggctgatggattagttgatcgaggttcaaaaaagaagtttttttcctgacctcctaataaccccagctttaggtgcaagaaaaggagacggcatttggtggctgccggatccagccacccccgaatgcagcttgcctgagaaatgacctcgcccaggtgaatcctggggagctcatggacacggacaccgggcatgcacacacgcacgagccccactcggagatcctgcctgtacactctcgtcgcttctttcctgcttcctttacgcttctctgaatgatcaacgccaatatactaatcaggggcacggacccgcgttccatggtggatggatacgtgcatcggcaaattcgaccagccgacctccattagatcggctgtgatgcagcattggagcgatcataatttagtagctttctttgttgattccccccgtgttccaggacatgcgtcaggggcaaatatttttagcaggtgaaagcctgcaagatcatgcatgagcttgcagcaaacgtcctatgggagttgttcagaactggttgattaacagcggcttggttagtttgagaagccgagtattgtagttatggaaatggcctctaggatctacagagcaggcaccctgtggttttaattactgtaaaggcaagttctacttgcatcattttctcacataattaagtcaaaagtcagagcacaaagtcataagcacacagcaaattcccagctctctcgagtcgacacactaaaataaaccaaagccttgatgcatgaccagcaccccgattccctgtaaattaatataaaccagacagaacaatactaatccaagcatgatgcagagagtatcttatcacaggacataacatagaaagatactttcccattcaaaaggaaatgaaaaaccaaatgattgacttaacccaaagtataagcagcaacagcaggtcgggtggtaattaacaatggcttggcgcatggcattttccaatggccaagtaaccggtgggaagctcggaggatacttcatcacatcacttgctggctggtttctttcagcagcagctgagctgcctactgtagctgcatcttctcaatatcccaaagccggccggctccaaagcaggagttgcctcccgccatcgccaagggccaactggaccaagccctggtccagaggcaggcaggagagtagtagtagtagtagctagtagtagcagcggtggcttgtcgctagcttctggagtccagccttccccagttggcgactctgccgctgcgtgccattttgatttcttgagagatctctctttttcatggatttggtgttttgcgagatgcatggaggcaacaacctcctgttactgacgttaaagtgttcgactcgccatcagaaacgtggtctgccagtatggtttgtcgacattgtgactttgtgaggctgacacttcattcacttggctttaggtctagtagtatcctaatgtaaggtggttaaatatctatcatttcctgtatagaattttttgtttgcacattacaaaacagtcattgcttcgcttattctgattataagccacaacagcttattagcaatcaaaaaaatatataaataaaaattatatatatgtgttcttaattagcaatttaaaagcaaatggtgaaaaataagctacaatgaaaagacccccaaaatcaactttaaatttaagtttttaaatccaaaattttgctgcagcttacgagctgagggtaaacaatgggagttttaagagagtaagtgttttctaattggtgcagccctgagaccctatttgagagaactattagaccgtagcccctgtggagaagagtgttgtcacgccccgaactaatcccgaccggaactagcccgtgacgctctaaattaacctgttaatcgatatcagtcccaggaaacagtgctggtatcacagggagacagaatatcacagcaacagaggtctttttattatagagtagaggtacagtcatgttgggctgcggacagatcccgagctcacaactgcaatacaaaagggaaacggaagccaggacttggaccaaacaacacaggcgcgacttgggaactaggccgaaaccctaaaactcatcgtagccggcttgctcctggaagaactcctcatcggcaggttccgcttcatcttcttcagcaactgggggggattatttatatagagcaagggtgagtacgggagtactcagcaagccatgggaaataagtgtttaatgcaggcttcaaggaaaggctgttgtttttgcaattgatttttatttgaactcttttctgaaaacaactaagtgagtgcttctcaaacgacacggatgggacagtgcgtctcgtccggtcggagtatgtgcaatgtatcagtctttagaattgaaacaaggttggcacccggccaacagcttttcaaacggccacccgggccaaccactttcaaacggccacccgggcctagctgatcccatcagctgcagattttttttttaaacatcgaacccctttccacaacagtaatttcgcaagcagtagtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgacaggaagcccaggggtcctccccgacaccaccccggcgaatccacatgtctctcggcatcaagactcccctgataagctagttactcagccaggggtgtcccattccacccatgtggtcgtacttgtgttatgtttggatgaaattccaaggaaacggtccttaagtgcaagagcggaaaaccgtacacccggtacgttccccggtccgcggttttggaaattcatttagttcacaagcaccgacccaggtgtcgggttttccaagtcttttgtaaaacccaagttttacccaagttgttattcagattttaagtttgaaggcgtccgtcgatactcgcacagggtgcacgaatatcgagacgcaactagatggatacaaggagacatgatataacaattaacaaaggaaggatcaaatgcaacaaattaggtaggtccgccaatctgccttgcagacgggacaacagattaagtgcgatcctatcaatgcataatattttacaagcaacataattaaatttcaaatataggctcaagatgttcaaaggtggcttgccttgctcgagatctggagcttgatcctcg

SEQ ID NO: 46561 - DNA, 775 bp, Oryza sativa
aagcgagcacaccgggtggttgcacaggacgaggggagacgagccaacggctcggattcgccggagggagcttgacggcggcgaattgcggcggcggcaaccggcggcgggagaaggggaaaacggcgacgaggtcacgaggggccgattcccggtggcgagagcatctacgcggctacgggaatccaatgctagcgttggattaggaggaaacgcatcgagggaggccggcgacgagaggcgcttccgagctcgggcggcgacggcggcgggcacatggcgagcggcggcaacggtcggggcggcgccggctagctatggggaggctactcgtgctactacccgagtctaagggaaggagatggaacgaggaggaagaacggagggaggctctaccgagatgaggtggggcgctgtgacgagaggccgacggcgcaggagtgatctatccggcctcgggcaggggaagaggaaggagacgagcgcccggagtccccttccgcgtcctcgctcgtgccggctcctccgacgcgcgcgacgacgaacggcgacggcgaaacagaggggtggcaataatggagtggaggcgatgggaggagaagagagggagggcgcccggggctttaagggcggcaatgtcggtttggaaaccgactttgggcggtcaaggcgcgagctggcgctcggcgctcgtggccaaatcggcgacaggacggagggaggatgatgccggcgggggaaaaggggaaaaggagggagagaaaggggcttgcct

SEQ ID NO: 46562 - DNA, 1088 bp, Oryza sativa
acataaggaagagaaacttttctccaaatatcataattctcagccataatgtaagattgcatcctactacaccaatgagaaaaatccattccatcgaaaacatgaggcttagttgaaaacttattagaagcagccatggcaaaaactttggatcggttaaaatccaaagaagcaaacaaagctctgatactacttgtaggatcgaatcacaagaactaagccaaccagagggggggtgaatggttgatataccccaaaacccaaacttttagcggaaataaaagttaccctcaaattcgatgtagatcggtctgaccgaggttgatccgccggtctgaccgagctcgtgccgctggtctgaccagtgttgatccgccggtccaactgcctgaagattgcctgtcgcgtgtgaagtcgccgccggtctgaccgccggtatgtcgccggttagaccgccgaaacccgatgaaacacaaatcgaagaactctcaaagtagatgataactttattacttctctctatgtttacaaagtgcaccaacaacactccttacaaaaatctcgactaaactcgaaaccctaactaaactagcaactcaattactctcaaaagtgatactgggaagactcacgctccccctctatttattcatgaggtaggcagcctaaagccacgaaccaaactcatactaagagtcctaaacaccttaggaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccatcaagccgactctcagtccatcaccgcaaatactcttccgaggcatcgagtcacctacacacgaaataaacaaagaaaccatattccgataccaagctatccccaacttgactcattgttagcaaacaacagtattacatacgtatagtatccatctagaagccataaccatgaaacaatc

SEQ ID NO: 46563 - DNA, 2110 bp, Oryza sativa
aggtgtattataatacagaagagaggatagttggcgtaaaataataactatacattgttactgaaattctgtgtggcccaaacaagttgactcgagattttatacggagacgcaactgctagtccggccttagttttccattatactgtataaatcttcggtcatcggtgagctatagaaggagatcagattaaggcactgaaatggctatcaccttacaggatgcagacgatggcatgccatgagtcaacattgcagaggtccgacttaagacatcgaagcatatatatacactaagtgttgtgaatcacaattaatgcatgcgtttagaaaacaaaatggtaacaccttaggtttttttttctaactaatttttgggttttgctaggtttgcatacaagctagctagcaacctcaatcaagggcactccttaattacataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatatgtattcatcactgacatgtgtgcccccaaaaaatatcaataggtgtagaaggtcgtgtatatatacgcattcatgtgtgtcaaggcaatatattttgttgaatatgagatgacatgggataataggattaaggaggagtcttccctcctcattgcccttttaatacgtcttagacacccagacattgacttagatgcctcgggagaagtagcattaggatttaagaccgttccccattttagctgtaccaagagagacaaaggtacacaagattaccagaaagaggccaggagcatgtcatccaagaagaagagagctgccatagatctctccctggaggcagagagaagacggccagaagaacgcggcggcggcagcgatcgcgaagccagcgatggcgccgctgctgcagctgaggaagatggtgatgtcaagcaacgagagggccctaaagaggaaaccggcggcgaggaggagaaggtagttgaagtggttgtggaccaaggagaagacggctccaatgaggagatcaaatataggactcaacaagcagagatgatcgaggaggacaagcaaccagctgcagcagcaaacgtcgacgacgatggcggcgacagcgacggagtcggagctagcgcggaagagaagcacatggtaacagaggccaccggcggcgaaggcgacgacggaggcgatagccgtacccccatggcgcaagatgaggtactatacacagtactacaattaaacttaccgacgattataaaaactcctaattatactattagctggtgatgtgatgcaagtagatagaattaatatcgatggagatttctcttgtcctttgctcccatttggagttgacatatatatgtgtgcttcttcagctcagcgagatgcaggaggagatggagaggatgaaggaggagaaccggatgctccggcgagtcgtcgacaagacggtgcgcgactactacgagctgcagatgaagctagccgcctaccagcagcaaccggcagcagcagatgagcctaaggtgatttaatttcttaattagctgagctagcttaaccaagctgatttagctagctat

SEQ ID NO: 46564 - DNA, 6824 bp, Oryza sativa
  unsure (1)..(6824): unsure at all n locations
cggcgctctgtcggaagcgacgacagcgactgcggcaaggaggatctagggctgtcccttagcctgggagcgtcgtcgtcgtacgacgacgaccagaaggcggtggaagcaaggccgcacgacgtcgacggcgcggcggctgcggccatgatcggcggcgacggcagcaggccggcgccgagggggtacccgctgctggagagcagcaaggtgcagggtggcgcggcgccggccgccggcgagctcgccgcggccggcggcatcacgagccagagcgtcaacccggccaaccgcaaaactagggtttcagttcgagtccggtgccaaggccccaccgtaagacacaatgcatgcaacatctgtgcgtgcatgcgtgcagtacatgatacgagtactaattactaatattgatcttgtgatgttgtcgcaccggtgcagatgaacgatgggtgccaatggcggaaatacgggcagaaggtcgccaagggcaacccgtgcccgcgagcttactaccggtgcaccgtcgcgccgggctgcccggtgcggaagcaggtgacgatcgaaactgacaagaattcagattgattagcattggttgcatgcatgatcatgtgtgttcgtgcatggattgatcgatctcgtttgattgtgtgcaggtgcagagatgcctcgaggacatgtcgatcctggtgacgacgtacgagggcacgcacaaccacccgctccccgtcggcgccaccgccatggcgtccaccacctccgccgcggccaccttcatgcttctctccagcaccacctcctcctcctccgtctccgacgcctccgccgcgccgtcgtcgtcctacctcagcccgtacctgctcaactccgcctcgccgttgctaatgccgggcgccaccggcggcggcggcggcatgcagcatctcaacctgttcgggaattcgccgtcgtcgtcgtctctgctagctccgcaagcgccaggctccagcaagtacccgtggtctccgaaccaccctccgctcgccggcgccggaggtaataagagaccgttctggagcgccggcggcgacggggacaagccggcgccggcggcattggccgagaacgtcggcgcggtgatgtcggacccgaacaagttctcggcggcgatcgccgcggcgatcaacaacttcatggggaaagacggcgagagtagcagcggcaagagtagtagtaagtggggcgtggttgaatcacttccaccccatgagtagtagtgagaattatattactagttactagctaatcaaatgtgacaagattgattcaatgattgggaaatcagttaggattattgcgtgtaaacaaatcaaactaggggaaatcacacattggaaacatttttttcggggagatttcgttgtaatttttcagtttttttttgtttggaacagatcgaattgttgttaaccgtaaattacagtatctgttcatcgtctttattaattaacaaggttgtacgatcatattcagatcatacaaagtagtatcctatattagtagggccgtgggggttcagttctgtgtgctataacagttttttatttactacatttataagcatttttatggttattttaccatacttaaggagttatcgggagttaccatattttctatattgaaaatattttctagtataaaatttgatgcatatggtggtattagttatcaaaatttttagtgtaaaatgtaggtacctgctctattaagaaccataaaatttctcattttcttatgggcagtcgatttcacacttgcccttggtttattcaagaatgtttgccggcattttaaattttggagaaaaaaaactaaccggtggatatatcagtgcatttaatagtggtttcaatttggtccctatgtctaaattgatcggttgttttgctctctccttttatttatttttatttttttaacacgcaaaacaattgcacatcaatgtattagaataaaaaaatgttacacaacgtaagtggctagacatgtaattaatgaaaaagagttttcattatttggtctattaattatacacatgatctggttgtaactatatatattgtgacaattattttttctgtttgagaaaacaaatgtccacagaggttcgcttaaatagtaagggttacatcatgacaggatcgcatcatttatgaaacactgtatgggctactgtgccagggtcacacctgtagctgatcaagcattatcagttggcttccagaacaacaatactgaattaggcctaataacaaaaccacactttgaaatcttgtggctagtactatatatatatatatatatatatatatatatatatatatatatatataaatatatagcttgatgactacttcatccgtttcataatgtaagactttctagtattacccacatttatttagatgttaatagatgtagacatatgtatgcgtttaaatttattaacatatatatatatatatatatatatatatatatatatatatgtggataatgctaaaaagtcttacattctgaaatgaagggagtattaattaagacagatcatacgaattcagcaagtattgttttgtgctgtactgctagcagtgcaagagttgttccgcgaataactcatttttccttttgatttttcggtttgagaacgtcgtctagcaccattcaaattaaggaagcctgcagtgcactgtgcactctgcatggtctcctgactaattagcaatctggcgccgtcagctcagctttctcttgtaaaacatactccctccgtaaaaaaaaaagacaaaccctgggttttcgtattcaatgtttaaccgtctatcttatttgaaaaaattatgaaaaaaattaaaaagacaagtcacgcataaagtattaatcatgttttatcatctaacaacaatgaaaataataattataaaaaaatttcatataagacggacggtcaaacgtttgacataaaaatctagtgtttgtctttttttttttaaggcagagggagtacgtagagattggcgcggccggggatgcaatatgcaagtcaaggccgttgcagcgaaccagcttgttggtagcggccatcaggatgcaggccggatcgatgcctgcaaactattgttgcgcatgaagcgactgttgtagcacattagaagccagtatggtggacaggatcttccggcaggcctctgtaaggccccagaggaatttcacagagagaacgctaagccgctaactcttcagttcagtaagatatcttatatatggggtatatagggcaaagttgtctcggtacccaaaaagaaaggggaaatgttatcactaaacaaggaagaacagagatcgcatattacattcgtatagaggaaaacaatcactgtacgctccggacaagcttctccagactctagagtggtgtactacgttccaacttccaaccccttgtttccattgatcattctaacacctctggtcacatggttctgaccatttctggaacatgcctatgctctcttgcagtagtgtccttcgcgtaactaagcctattttccgttaagctcagtcattgcttgtacttacacgagtgttaaatcccctcctggcatgtactttcatcagcactaaagtctgaaatttcttgtagtattagggtgtgtttgagaagaaggggattggggagattgggaagatacgcaaaacgatgtgggccattagcatatgattaattgagtattaactattttaaattgcaaaaatggattaatatgattttttagagcaactttcctatagaaattttttgcaaaaaacgcaccgtttagtagtttgggaagcgtgcgcacgaaaaacgatgagctttctcacccaatgtcactagaacgaacacagccttagtacaaaaccccaaaatccacactgaacttctctgaacttttatcacagggccattagcctgaagcctcgagcaggaggtaggagagagagagaggctggggaccaatacgccagcaaaagccacagnttcccacggnatcatgtgatcaagccaccgcccacgccccaccaccaccaccaaagccaccaaactcttctctgaagaaatttcagtactcagtgttgaagcctgaaccacccatccagaatcgcaggagcagcgagcgatctcggtttgatctcgtgcgagccgcgcttctcggtccatccgaaaaacgccaagcccaatccaattatccaaccctatcccagatcagaatatatcggatatggttgatttaatcccaactcattactgctatttcttcgcttgtttctcatgcgtgtttacaagaatcttccaacctaatccccccgtcttccaccacaatcacgcagtgacagcgaggaaattatagttgcctggtcaagtaaaactctgcttagtgagacattcctacttttccaagttataaaacaaacattctgaattttatccatggggttaatttcagctgttccaattgtaatctcactagctttattaatgaattttagctgttccaattatgaactcactaactttacatagaggttgatgaccaccggcgggaaggaatctgttcccgtttaatacgggttaacacgccgaaatttactcgaccctacgataaaagtacaaacgataagaggaatattcctttttatattttattttctctctctctctctcaacgtgctacagttcaacggtgtacggcaaatcgcaacacgtcccgtagaaggcaccccccgtctccgccggtttcgtcaccccagcttttgcgtggacgcggtccatggactgcaccgcgaccccggcttccgtcccggctcccgcccgcccgaggagggagccggtgcatggaccgggtccacgcaggggtgaacaggcggcgaaactgtaattgcaacgcgaactcgcaccaaaaaacgtggggcccacccgcccaaaatctttgcgtctcctcccctttctaatccactttttattttttgcgccattttttctttttctttttcgttttgttttttttttcgttaatttggcttaactaggggtgtccttgtctttcgccattttctctctcgctcggtttgctgctctcctcctcctcgtcgtcgtctccaactccgtcgcggcctcgcgctcaccgccgccggaatccggctgacctcctccgctcccgcatcgggcgctcgccccccgggtctaggtacttgcccttgcccccctgcccatgcccttcgtcccgattcgaacatgtcagatttggttggttgggtatcttggtggtgggttggttcgccaggcgccgaggcccaagttctttgtcctggaatggtggctagggagctttgtttcggggttctatctctgtgatttgggtgcggatgggaggaattcttcttggtttgggggaatttggggggttccggtgctgatttgagtgttttctggctggttcttggcgctccttcgggagaattttgtggagctctctgatgggagtggtctaggtcgggatctcagactggatggcctaatttgatcttatcaaggtgaattatgccttctcagtgaggatttaggtgactgtggttacaattgctggggtatttgacctaaaaacgaagatgggcgagcaaaaggggcctcctattgtcaaaattttagtcattgaaccagtagcacgagagcggtgttctcggtgtattctttgcgtgtagattggaggattggccgcaatggcgtagcaaaataccctttaatgtatcttttgagcttctgttgatgcttttaagctttttgattgttgtagtagtgattaacaattttgtaggaaatgatctactgcgagaaggtactgtagtaaggaaatttaattggcagtaaagcttcattttctgaactgtccttgtgcccattgataatgccattaacgtagaaaaaatagcatttcggatagcattttagttaaatcgtgagcacttatctagtcttgggccgtggccctttcatttctttgcttaaagttaacgaagaaagatgcttctcgggtaatatttaataatgcactattcagtggataaggtgcactttttagatggagaagaaagtgtttttgtcactgatttgagttgaaaatggtgaattttgaaccaatttgtggcataagaaaacccttttgccaacctccatccatgtgttagcaatcatggtaggaggatcaagattgaagtaaaacttaaagaagccctttgcttcaaatacctttcttgtgctggttacttagcatgttcttaaaggatggaatccttggcccaattgcagtatcaattgattctctctaattaaaaagttatgtgttgttccttgtttctctttaattctggtagatctgggaggggtcctgacatgctccatgtgggccactggttttccctttatctcttatctggctcttaggtgtgacttttttaatgggtattgtagatcacatctaatgtgcttcattgatttgattatttaaaagcctttggttgttgctattcgtttgtttatgttcctacccttctgtggttggatcccataaagtctacctgtgacttctgctgccttggttgcttgttagtcattgttgtggatcttaagtttgctgacttggtttaaggaggaaggctgctgcaagagtaaagctgcaattggttggtaatgttgctcatgagtttttcttgtataattgcaacaaccaaggaggatctttttg

SEQ ID NO: 46565 - DNA, 4451 bp, Oryza sativa
ccccacccccaccccccaaaaaaaagtcctcaacacattcttgacaaagttgattaatctttttcccttttgttttgctaaattgtaatataaagaattaaccttgtacatattttctctctttaatgaaattacactactaggcaaagcccttgtagttttcccagtcaaaaaaaaattgtaatctaaagaaggttaatttctgtgtttatcttgtattttaatatccttgcagatccctggcctgtttttgtttataagaaaacactgtatcaacaattcatgcaaatcacgttatggtttctttctggacaggtttccgaagaaatggcaagaagtgcaagggcaaggaggcatgtggctcgtcagcttagatccgcaccgtatcccatcccttcgtaccgctggaaagcaatgaaagaatcaaaccgaaagaaaactctgccagctgcacagaagatggactgggaagatgccaactgctctgtgtgcatggaatacccgcataatgctgttctcctcctttgttcttcgcatgataaaggttgtcgcccttacatgtgtggaactagccaccgccactcaaattgccttgatcaattcaagaaggcttacaccaagggtgcattgctagaggaacttcctgccaacactgttggcacgaacttggactcgacgccattgattgcaggtgaaaaaaatgagtctgttgatcttgcatgtccactgtgtcgtggcaaggtgaagggatggactatagtagaaccagctcgaagttatctcaatgggaaaaggaggacatgcatgcaggatggttgctcatttgtaggaacctacaaggaactccgcaagcatgtgaagtcagagcaccctcttgcaaagccaagggaagtcgatcccatccttgaacagaagtggagattgctagagattgaaagagagaggcaagatgcactcagtacgataacagcaactatggggagggcgattgttttcggtgattatgtgctagacttggaagatgaagatgatttagatgatgtagaaagtgatgaggatgacaatgccaacggacacgggacagataacactagacgaatgttaatgtttctaatgcgccaagttgctcggcatcatcaaaaccaaaggcttcagaatgcaattggtacaactggcggtgccgaggacaattatgcggtgagcagtggtgcaaatgcaaccacgccttaccattaccccttggaaggcgacgatgaggatgatttggttatggccggaggcggaagcaccggtatggttagaccagagaggcggcgtcggcgccgccgtagaaaccgcgagaggttgttcttaggtgctaattgagacaacaggggctttaccactggaggagtacattgcacaattggttctctggtgcatagcattcatcaatttcaacctcaatttacttgttcatgatcatgtaccaaagtagttgtcttaaccttttagctcattgtttcacttcaatgtatgccatctcacattcattgttgaaaaggaaaataccgcacccatcttgtgcggtttgtgtagcctttatttccagtttttcagaagctctgctaaatattaatccagtggggatcgattttagatctcaccagcttcagatattcagttgtgcttagtgctgactaaacatagatttgaacatttgctaaaccggaggtgttgactgacgatattacaacataagaagcagtaagatcttacaatgacctgagctcatgtttcaaccaaacatagaaactgtagaatacattatcattgagttcgacacttcatcgttgaagtgccctacactttatgacatcaacatacatgctctaaatgatttcccgtaacataacattacaattttgttcataactacattctacagagcatatattaatataatcatttacttgtatatacttgcaagaagaaagatttgtatctcttcacgacggtcgatgagcatttccacagcagatcttctagtaaaccgtcgatcgaaggcatctgccaattcacaccatcttgcctgatctacattcccagatggcgaatgaatatcacaaacatcacaagcacatgcgagctcgtgcaatgcggtgccaagaatgctcacttctgtcaaacgccatacaccatcatgtcatcgattgctcaatgcccagaaccaggaggcgcattggacacccaaaatctcccacttgagcacagggcagttactttttcctaatgatggtaggcacaccgtagcaaacgggagatccaccgatcataagaggaagcctgcaagcacgcctagcttcacttaaatatgaagctactcgcctgttgccacaagtgcaacgcttactacagttattcattcgttcggacttcttccctcgtgtgcctcttcgcctcggcctgccattaccctccacagcaatggtcatggattcaaattctcgtgttagctggcaacacttcgagcaatttttggccgctacaaaattctcttgcaaccatgaaccgagcaatgctttgctgaatcgatcaatatccttatctgacacatcccagagatttgcgataacagctggagaaccagcagataaatatgataaaggggctccttgaggagcataacaccctttgcaacgcaatgttccactactgcaacccataagaagagcagctgcgcaattatctaatttctcaatttcctttccagagacatactgagttcctgcaacatttcaagaccagttagaaaataactgtttagttctaataaatgaaaatggctgttctctgtattagtcaaaggctaccagaacagtgcccagtaagaacaaagatactcatgatcactaggttagttcttattcctaacagtccaatcaataggtaataaatacaattgaaaacttgaaagcatccattggcactgggccccctagaagcagttgttcttgttccaattgacacataacccactctgctatcacatgtggccggtttgtgtagttgactcaagggcaccatctaatgaattagcggttcaagctttagttatttttatataaaagctgggtttgagtattcatctaaagaaatttcacccaggtggccataatagaccaatcaacaatttaggtcatgttatcacccgttgaaaatagcaatccttaatgtatcgctgttgcagcaatcagtaaaaagaaaacaggttcagcaaataacttaactatggtactccctccatcccaaaatataacttctagtgttcaaaattttatcccgaaatgcaaaaacttctccacctactttcttatctcaatcaatcacaaccatctttcatttaatttctctacatattttctcatcttaatcgatgacaaccatccctcatttaatttcacctcttcttaattcccgtgaaaactctagaagtgcttatattttgaaatggatggagtattaccctactagacttaattctgaggaccgaaggcatcagggtttaacatgaatgggagaaaacgttaatatgtagatccagcaaaatgatgactacaatctttatatctatagggcttaccacttccatgaccaaaataaaggaaaagatcatgactgctcaaggccaacaccagctcttcagctgttggagcatacccagcctttccctgcatacaatcgttgcaacattcacaaatcacaaccgtttgttggtgcactatataggcatccaaattcatgctttaacatgcaacataaatgctccagcaagcctgcaaaagccctaagggttcatgtcctgttatctctatgacatatgttagacgctgtagttgattgatgcaatttattaaatttagttgcaaccaacagtagcaataagcagacaagctgagctagaggtatctagtgctagcctacaggtagacaagattttgcagccatttatatttctaaagtgaaaggagcagtaaatataaccacttttggtatggcaagcacatgtttacaagcacattgagatgccagaatataaccatttctcatctcccaacaagagcatttccacagttggtggaagcaattatttttcacaaatttagcactgagaaatggttgttagaacaaggactgttgttttatcatttctaaattgttgtcaaatcaatgttaccttccattcgtagttcttaaacatctgatcaaattcttcttgtgtactgctcaggtctccactaggattcaacagataaaatgcgttgaaagggtcaatgacaggaaaaggaggagctataacacgggcatctttccaataattattacttctagtcaaagctagaaagacacttccaattgatggcatgcgataaatttcttgattccttagtgcaggcaagttgggctgcaga

SEQ ID NO: 46566 - DNA, 985 bp, Oryza sativa
acatggtctgagatgggagtgtgtggaccagggtttacaattgcgacagacgcttccgtttcgggcaccggtggaattcggaatttcccgaaatccggtggaaaactggtaaattccgacaaatttcatataccaagatttgaatacaaattccctgagtttgccgacaagttcttgaaaaccgatcggttttggtgaaatcccgatcgagataatcaaaatttcgataagttatccggcccatctaagtgttttcctttttaattctttattcttttctttcctgatgtaagtttcagtaaatacacacaatatatcattttttttcaaaaaaattatatcccaataggttctatgaatatcatattatttataagattttatttgattttttccttttttatcaattcaaatttaaatttggatgaaactcttcgaaatctcagacggtttctacttttgagcctcatcgaaacgtcacaatttcgcgaaatccgacaggatttcatcggaatcgtaaaccctggcgtggacgatcgcgggatccgacgggagaacgcgcgaaccagacaggtggccgttgggcctattctctgttcaggctttgatccaaataatctgcaaatttgaatctgaatgtttgtcgccctatcgacttgaactccatgaagatcttatcttgaagtctgaggatgcagtccaatgatgcccttcacttcatgtttttattccttcttgttaagatttccccaggattcatctggactcgatggataatttttccttttttctcctcctaaatttgatgctccttttggctagggctcagaagtcaggacacaggagactggggtagcgagtattcagtgcaatccatcctgttaacaggtaatttttgcaccaaaagaagatcttttgttgttgcacataagcacattcctgtcagatttcaaaacgagtacaagatcctaaatttcagcatcta

SEQ ID NO: 46567 - DNA, 9856 bp, Oryza sativa
cagacataatattgattctcctgtgaaataccagaaaaaatcccaaactgtttatttgctaatggaatcaatgggaggccattcatgcatttgccgatattaccactgtccagatcagcaaggcaatattccaataatattagcttctgagatttttctaatgtaccaagattttcaaaatccttgaggaaatgtcgcactgtagcaggagttactattttgagcatatacttcgaatggaacttaggaaacatatcagcaatcgcacctggtagacgaacgacaggcatgcctaacatcacaagagcctcactgagatcatcacttcttgaaaatccctcgtcatgaagcaaactctcagctggtgttatccaagtcccacctttgatctccgagtgaaatactggagaggtgtaaataaatttacagatttgttccacgagaatactccagggctcctcgtacaaaccagttggccataaggaataatatgatattttggagtccaaaactgtacgcaactgtagcagcagttctctgaacaaaggagcaacaacatcttctaacaataacatattccagtcagagcgaagcttaccacccctgtccatatcagctccataccaaatgtcacgtcggttggatgatacttcaaagtaaccattcacatgcacagataatcctgtctttactggcaaaggaagaaaacagaatgcgcggccttgtctgagaataacttcctgcaaattcagtgattactaattaccatagagtaaccacagcaaatgctaaggtgtaaaaaacacactgaaatgatgcaccacgttctgaagaacgtctgatatagcatgaagtccattagataacataaatcaaacacacattttttaagtcaaaggtattataatcaattaagttatgcagtgtacaaagtttgttcaaccagaaaaaaaaatcacatcaataaccatggtcatattgttaatgattattttaaaaatattcagcatcagataacaataggcaacgccctactgttgctaaaaaattggtgataatagccataataaagagaactgcaaaacgaactagatattacctcaggtcccacgttggagatgcaagcagcaacagaagcccaaggtagtaggtgaagatcataatccttggcagcagttgttgcaaaaataccaattttacttaatgcagatgccattccctgtacaataaaataggtatagctcttcttctcaaacttctcacccaaaaatgactttgatacaaaatccattgaaaaggaatctatctttttctcagaggactcagcagcagtgccagaaaacctgacaagggcttgtcgatgccagcgcaaattgtcatgctgtgaccctatggagcaagagtacactatctttggttcactcataccagattcccatacatacatttcaagtgacagcacatttttaaggaaaagtaaattatatacagcttcttcgtaaagttgagcaaacagagataagatatcatcttctgtgtacacttgtctcgataaccgactaagagatgcttgctcagcagtccttaaaggaaagcgaaacaaagttccctgaaatggtgctttcatgtcacaaccaaatgcacaatagggtgaaagctggtcgttgtatagtgtaattgctgaagaactgacaaaatctatacgttttccaggatttgcagctgacacattcggaagataagcaccctggggatcaaacaggacaatgtacttgccactcacaaatgatggcaagtcagtcaagtggtacaccgagttaaaaccaaccctgcggaaacagaaatcgtgagttatcgctcacagcaaaactaaataaataaataaaatcatgcgctattacagggtgaacattaaacagtgaaacataaccagttaagaacaaaggtaagtatctgttgaatcattagtggcatgtctgacaattccagggtgcttgttcaaaataaacttaggagcctagacattgatatattcactacccaaacccatcaatacctaaaacattataacggggatgacatcagaacacaatagcatagatcaggaactaaataagcgggacaccacggcgacattgatatattctataccaaacccatcattaatacctaaaacattataactgggatggcatcagaacaacaaataagcgggacgtcgcagcgacattgatatattcactacccaaaaccatggatacctaaaacattataacggggaaggcatcagaacacaatagcattgatcaggaacaaataagcgggtcgtcacgccgattttactaccaatgaagcttagcattgcaaattacagctcgaacaagcttgagagagagaaggggggcgcacccgaagcggccggtcttccagacctgggacaccttcctgctgtccccgatgcgggagatactggcgaagtcctcgtcggtgaagacggcgtcgttgtaggcgagcaacgccgggccctgccattgcgcgagggcgggcgcgagcagcgagcctgcgccgtgcgcgcggcggtcgaggcagaggcggacgcgggacgcccccgcgtcgtcggcgttctggatgagctcccgcagcgcggtggtgccctccgggtagttggcgagcacctcgcggatgcgccgcgtgaggtccacccgctgcccgaagtcctcgagcagcatcccgccgggatccatgggcgaggaggcgatcgaagcgaagctaccgtgccattggaagcgcgaggaggggaggaggaggaggctagggtttgggaggggagtaggcgaggattttttgggcgagggagaaggggtgggaattcgcggatttgggcgtgagcgctcgtaattttgcctccgccctcgctgctgctgctgcggctgcgggcgttggttggagattttgactcctccgccttttcgcggaggcttcgtcgtcgactcgttcgctcgccttctccttcctcttcaagattgcgcgaaccggacgccggaagggactcccggcacctgccgctgtctctgccgtgtggggcccacgtttggtgcctcctttccataacatttttttgatttgggtgctgctctgttgggcctttaatagtgaaacggcccaatgttgagcgctaactgggcccacgattcatcgtagatatgggccgatatggggctgcccggctggtgcggcagagcagcccatttaggctgtgttcgtagctccatgttgataataactaatccctccgtaaatagggtggctcgttagagtataattaattaattattaactaaaacctcgaacaatataataatatatattttttcaagcaggtttactattcgagtatagattattgttgtttagaaagtttgtgcatgaaaaaagaagaaagcacaagttgagaaagagggaaaacaaactcagcctttcgccatagaggcctaaccaaagcaggtacagactataagctagctataaacacatattgagaagataaatgatgagagataagagcagcgagctgcagatttgtagccagttacggcacatactacaagacgtaatgtgtgtatgacatgtgggatctaatattacttatgtagtatatgtttataggaaactattatatgaatttgatattaaactaactatagatgatttgaagatagtagttggctatactatcaaacttgctctcacaccacggatgaactaaagagtagggtgattactccgattagttgtcctaactgctgaccatcagtcttatcttttggcttatgcttatgtttataagccaaaatttgaatttccagccttaaatttgtagtttattttgggattttttcatcgtagtttattttccaacctttgcttttagattactaagaacacatatatataaaagttttatttacaaaatattttctgtttgtaaatacgttgtttcgcttattccaccaataagcgaaatgatacagtcctatggcagacagccgtagcagcagcagtagccaaagcagtcgggtcatagcaatttttttgttaaaaaaatagttaaaacccagcctttatatgcaaagagatagatgtagctgagttgtagcaatagcagctgatggtttattttcaatttaattaagttggtccttgtatactcattttattccaatatatagttagctttagttttcaacacgagtattaagaatagatccaaaaagacttagtttccttgagtgggtgaaattatagagttatactagttgaagatataataaaacaaagagttaatatggtaagtataatttagtggggaaaatcaccttttactaataaagtttaaactctaagagttattatattttataaggtatggagtaaccatttatgtcaataatgctggtggattattcctatttaaaaccatttcagtaattatcgtatgaatggttggttttttttatgaaaagattagctcctactctcttttgtagaaaaaaagtggttttgcatttttttttaaagtcaataaaacgtagctttggtcatttcactcttttgcgtaaatataagatactcaggagcacgcaaaacgataaaactcattagcatatgattaattaagtattaattattataaatttaaaaatggattaatttgatttttaaaaaaacaacttctaaaaaaacttttttataaaaacacactatttaaccgtttgaaaatcgtgctaacagaaaataagtaagttgaagtttcgagttgagaaaaaagaactaggccttacacaagggctaacagcctcatcttttaacccatgcttatccttataagccaaaatgtgaattttcaatcttaaatttgaagttgattgtggagttttttttatcgtagtttatttttccagtctttgcttttatatcgctaaaaaaacgtatataaaatttttatttataaattattttctgtttgtaaaaatactactttacttattccgtcaataagtggaacgatagagtactaacactattatgaaagctttgattgtaacaaacctggttacgccattttttatgtccaagacatttactattccaaaaaccgtaactatggtcaaaatcaatttatattcactgcacggatttacagacgagatgtcaggcggagtatattccattccagggtccgtttattccattccacaagtcacaagttacagcttcgtgataattgttgttttcctgggcgcgagtagatgcagcctccgctggttgttggcgcgcggacgcggcgtgaccgcgtgagtcgcggcgttttcaagcccaatgatcgctgatgcgagcaatctgaccgtcttctgagttcagatatagaatcgccacaagtggagtagacgatggctcagacatgggcgccacgcacaactagcacacgtagcacaccacaccacacagcccataggtagatgtgatgtggctgcttctgccgtttgctttgctctgcaatcctgcatgctctcccaggccggatcgcgtgccatctgcaaagccaccaactttgcctttgcctgctgctagtactagttgtactactgtgatctgaacatggagctttgcactttttcttaagaagatatcaaatcatacagctagtgacaattaacaaatcagattgtgatttgtgcaatcgatccatatcgaggtcattaggaggccagagacgctgcaatttggtgcttgtagttggagaggaaatcaggaaactgaactggcacctaacagcggcactgatacagcagcagcagcatggatactgcaggcgatgaggcgtggctgcatgttttgcgaggaccgaacgaacgatatggattgcctcgtttcaatatccatcaaaaaaaaaaaaacaagatagcaaccattccatacctgtcgctccagacaaacagtggctaccaccaaacctgtcaaaactaaaatgataatgagaagtccgcaataacttcgtcaattttaacctgtgacaacacatcaagtatttgtaaaaatagagtgtgcgtgtttgtttataggatgagtatgcttgtgctgtgagcgcttacgtttacatcgtgttttttttaaaaaaaataatcgctctgttcttttcaaatttgcagcccgtgtcttttgtacgtcaggatcacatcagtaagtgaaactgggtagtagctgatgacaaaactctctgaaccaaagttgttgggaggatttcatcaaagaatggggccaccgttttctcctcatgttgcatcacctctcttaccttgacaaaggaaacaacgtcaccgtcttaagtgtgggtaggtagaacaagataaactgcattatgcgcctaaaagaaagatacttcctccgtatctagctagattcattaacattaatatgaatgtgagaaatgctagaatgacttacattgtgaaacggagagaagcatgtttcattattgacttggttcaggtaatccgatctaaattatatgtcgtgttgatgatcaccctctctcaatttgaggcaggaatcataacccctgatctgtttacagtgctctcgatgttgccagcggtgtagttgccagcaacctgtgcatctaacaaaatggacgaacggaaatggttaagtatagaagcaagggcgatgtgaattctaaatcaaccgcgttagcgaaaagccggaaaaaacggatttgtacatcatatgtgaggttgcttaattgaatgctaccttgtttggacgattagggaggtggagttttttttttgttttaaaaaggtattcaataatttggtaatcgatttgagcagttgtagacattatcaattcgctaacaggcttagtaaaacttagatcttttttagccagctgtataagagattaatatattttctatcggttataaatattctctatttataaaagaaagtcatgacagtaactaaattctttcgtgtattcttagcactaaacgaatcgactgttccactaataaaaaaacgaaaactttgctgggctacttgtaccacatctatatattcatcatccgtacttctaatccgtacctcaccttattccaaactgaatagaccacccgagcaaccttcatcgagtaaaattattttgtaccaccgatgatataatcatgctaattagttttaaaatgcggttaggataggaatggcgcgtgatgaaggaggacaagcaggctacggagatcggtctaaagagatgcaatggtagcggaggcccagaacgagcaaggtcagcaatatcatgacaagaagaacgggtcctgaaagaagggggtgatgaaaaaaaaaagacaatgatcacgatgaagtatatgccacggtaccgccgttatcaatagtcggagatagaaacgactcatcggagccaaggaaaaggggaaggcgaaggggagtataagagagagtgtaggacacaggaagatagagtgtagtgtattactaccatcttatataaaaaaggcaaaggtacattgagacaaatgcaacccaacagaatcgccataaaaagacatctgtcgatgaagaggagccacaccattatcaccaccaaacctcaaaggctcaacaagcttgagtgcaggacaccaactcgtcgtctcatggttcatgcttgacacccaacagtgtcacatttggaagcaaaatgacgctttcagcctctgccaatcctcggactggcacctaaccaccaaaacccaacgacggagagaagaaaagagagatcaaaggcgaagggcaaatcagaaaaaaacgtgcctcgtatgagctcatatatataatttttttctccgaagaaatcccatcattttctccgggggctatttaacgggctcatctggtcctccacattctccccctcctcctcctcctcttccacctccaccctaccactctccaccacccacccgcccgtccgcctccctccgctccgctgctgcagccagccaacccagccttgctgcctcgcgggcgaacaaaaacccccagaattctccgcgtcgatctcgccccgccgcgtcccggctcgacgcgggccggcgccgtgagggtggggatcgcatgtgaagcgcattggagcggataactcgtctctatttgggggaattttttttagttttttgtttggggtttccaatcctttttcttcggcggagccgcgagcgtaggtgcgtctatctgctccgtctccggtggttgttttgattttatccgatttcgaggggggttcttgtgggcggtgtgattaggcggggtgatctcggctcgatcgatcggaacatcatctgcaggggaagcggttggcctccccccctacgccctttgaggatttttttacccttggtgtgatgagatagatgtgtgctgttttggggattttggtaggtcgatcggatcatcggatgcgctatgccagcatattcttgtcgtgtttcctgatctgagcactaagcctcaggcagtgatgagagttcggtggagctcgttagtttagtcgatcgtgctgctcaccctagagcttttcccccttttgtttaatggagaaaaactcataagcatactgtttctgttgttagcttagctgtctattgggatttcttttggagagtttagatgcagcaacaagtagagtgctaggataggctattatttatcatttgtttatctgtggctgtgatcaatatggagcatcttcaccactacctgactgtaaataagtaattgatagtgttgactaattggaaacgtcactatcaattgatagtattgtcgatttctatgtatgttctccccttcaatctgaattaaacttaggctggcccgggtgaaaaagataatgctgaccaatctgtagaccctttgaccactgtgttttcatcaatacatatacaaatacttagatctcggcactactataaatgtatggcgcgaaatgaatcttacaatgtgttttttctttcacaaaacaaagcggctgaaattattgtcggtcaaatttgaacgagagaatcttctcgccaccgccgtgtaggcacattgtgtaactgaaatttgtttcttctgatatattcacgtgcaaagcttttgcgtttccgctaataaatttgaatgagagaatcaacggtatcagttattcgaaaacggacggaatatatttttttgtcgtcttctatgctcttttcagaaatatatatttcttaaatagcttcataccatttttagattagcttatttctaatcaaaagtacttcgactttgaccttgttatatgtttagtattgttgtaaagatataattaaagaaagtaaagccaaacattgtccaaattgcaagtaaaaatacagtgagtagtgtgttcatgacatggttgtttggcccgaactgcaaaaaattgtctttgaaacattctttttcatctacttgattagtttcccctcaatgtagcacgatatgctgcggcaacctgcaagcacctctggagatgttgatagaattgcaaacaggaagcatcgtcacatagtgcctaggcgttcaacagaaaagaagaaccctcataacatccagtttgtaagtactaacttggaaagagagatatggtgtagcgtgcattttttttggagaatttatttatcctttttttttctgttttgttattttgcaggaacgtcaagtagctgcgcttgaatacaggcaggaagaacagaggaagaggtacgctgatgtgctctaaaatcaatgtg

SEQ ID NO: 46568 - DNA, 1866 bp, Oryza sativa
cagacaaagcccctgataatgatttctcagtcaacaccttcagcaacgcgagtgtggacgtgaagcgaacttcacgaaagaaaagcaaaaagaaaaacaagaggcacaaaagagtgcatggcaaaaaagtatctgaggcatctgacacacagtctatgcagagcaagggtgcttctcattgcatcgatgttgctggtggtgaatccttgacactttcatccaaccatgtggctcatgctggatctgaaatgcggtgtagaaaggagacttttccttctatggctgatggaggtgaaactttgacactgcctccaaaccatgtggctgacaaattgtttggggatttgtcttctgattcttcagtgagagaagtttctgcggagagacctgatagtgaaactggtaacgatggttctttcataactctgatatcaagtacatcttgtagtgatgagatagaattgtctaggcatgcttcttattttgaatgctgtgagcaatctaacagcaataactccagatgtttggacagtgcctccacttccactcttactgattcctctttggatggccattacacagatagcagttggaacttcagtgatgataccgagaacttgttgattgacaaaaatgagtgccctccgtgtgttcagtcaaaagtgacagatctcaggggttctaaatgtggtggcagtgaaggttggctaaacaaagcaaatcatgataaattctcctgtttcagaaacagtgctgatgctagcagtggtacacaagaaatgcaatcatgcagtaatgctagtagcgatggtgatttcctcccagtaatttctagaaaaagagcccggaaaaatagaaaggtccaacctttggggggttgtaatgtggaacatatttgtggtgttgagcatggtcaaagtggaaaacaatccaaaatttcttctagaccaagtaattcttgcacacaagttgcatcaaaagattccactaaggatttcattcacccaattaaagttcgcacatggactccacatgaagttacactaaatgattacatgataggagcaaatatgaatcacctccaggatccaaaacaaaaccgtagggggaaaccacataagtactcttgtttgagtgaagtggcaaactgtggttttattgaagagaagagtgcctgtacagcgaaaatgcttcctggaattacacactcaacagaaacaggtgttggtcagatagcatcgagttcagcttctgatgtgacggtccgagagatatctgaggaaatttgtacaccaataggtcctgtgcagaaaggagggctgcagattttgcttcgagaagaaaatgttgttggcacaggttctcttgatgttttgaatcatgtttcttctgttgattccgaagaacagaagaaagtagataatgctgtaatgagcagatctcatggcatggaaggtcaccatctacaatcccaagattcaggttctcagttccctggatgcaccacagattactggaaaacttccaggcctactgaaagtggtttggaggttggctatcatggtgtatcagcttttgaagggcgctgtaacacgaaccagcaaagatctgttagttctaaattgcaattaggtgagatgatcaaggctgcaaatgatgcctgcaaagtgcaaggtgcatcagatgttcatctgatttctggtcacccccttgctgattttgagacttttatatattctgcaagtccagtcattgctaagacatcttgcatgaggaatggcaactgtttgcaggacccgcaagctggcagctcaccatatcaatatcagatatcggatgtctccttgagaaatgtgtgggaatggt

SEQ ID NO: 46569 - DNA, 41419 bp, Oryza sativa
ggatagtataggtttgtagccacaatttattattattactaatcacattcagcacggtactaaaagttcaatgtaaaacctcatcttcatctaacaaaagctttatgagtaaactttaattcttgtttttttttcttatttgactaatcaagttgtgacctcccataggtggcttgcttatatctctagtgcacttccccttttaagcttaatttaagacagtaagatatggtgttggacaaacgtcatcttcatcccatctgtctgtgaccaagttgattgtgcataggtggacaatccactatggaaaatcattgtattagtaaaggaatataaagttttctgttattataccagatggcggaaacctttgtgtactagaaaaaccttttagttttcttgctggtagtattttcatagatattttaatgctgaactcatccttatttatattttttgtttacagggagagcaatggtttcaactgagaaacccagagatcaagccaatgtcattagacgttggccccaaaactgatcgtgctgaagtcctgaaacagaggctgaagactttaagacatggtgcatcagttatgtcaagcatggtgatacccaaggccaacggggagaagtctatcaaccgtcatccagactatgaattcttcctatctcggtctaactgaatggttgcatgatctccacggcatcgaaatacatcatgttctctccattacctgtactgtatgggtcctagaaccagaagcacctccatagtcccaacattcagagtttcagactatgctctagcgcggtaccatcataccaaggctggaagttgatgagctttagctctttctagtagtagactggtagcagaacacccgaagggtttttttttttggttttttgaaagagcgactcggcccgtgggttttcgacttcagatgcttgcccctttaagtaaatcctttaagacttagagcgttgcttctgggtacctgcagatgggttcaaggcctgtagtgtatgctgttgcttgcttgaaatgggaatttttgtccatgcagatcgatcctccaggcggtttttatatgccagatagtagaagagttctgtagctaggatgggctcgtttgaatgttctcaatgttattttcgcgaggcaattttttttgccaccaggaggaatgtcggaatgtaggacagttgaatatatcccatatgtagaacaagagaaattttactgtctttgtggatacctagagagatcattttttttttattttggtttctcttaatagccgaggtattgtggatacctagagagatcaattttttaatgtagattttggtatctcttaatagccgaggtattaagagaagaggtataccaagtttcttaataaaaaaaggatacctcactgtacctgctaaagagtaaaatcactcaacaactaattaaatttccggttgttcaagttgcaatggaatcattgtagtttggaagcatcgtcaatagaatcaccatctttgtctagtttgaaagagttgccaatactcaatagcattatcatcttttttttgctcccaagtagactttgttttcgttaagaagaacatcttcttaaacttctttatcaaagaacacatcacccaccatcttcttaaactttatcaaaaagaaaaccaccaccttgaagtatgtttgctcaatcatatgcaggaccactaaacacaaggctcaaattgacgccatctgactaacaactacttcctccattcttttcttcaagaaactactccctctatcctatattagtctccaaaactaatctttgttttataatttctcatatatataataaggttgtagtaacaaaattataaccatatgaaaataaattcaaatattaatccaatgatataatttttagcaagtaaaattcaatttatattgtactaaatgatggtcaaaatgttttgaaggtggaatcttaaaatatgtggacgccttatattatgtgatggagagagtaacttctaattctgtatttgaacatagtctatatctaaatatatagtttgaagttttttttttttttttggtgggagggggtgtagtccatgaccagtgaaagatgcatacgttacaaggattacactgcgacagaggtgagcaggcgagttggattgactggaggaaacgacaacgcttcgtcgttctgaggacgcgcatgctggatctggggcgccgggccgcagttgatgacggtgagagcggaggcgagggcggtgttgggtggcgagtttatcggagacgacgacgatgaggcctcaccattccggccgatgagcgtgttgggacggccccgctgcggaggaggtgaggggatcggaggctctgagaggcgagtttaccggagataacgacgaggccgtcccattccggcggatgcgcctgccggagcgacgccgcggcggctgggacggagagatcgccgggggaagaagaagaagagagaggaggagtggcattaactgacaccgttggatcaaaacctcatggctgcgatcgcgtaagcacagggtgacttttgcaaaagagccctcagtttgttgttagtattttctttagagtccttgctcgacatggatcgctgcgacgctgcgcatcgttagcgaccgtacgggcctgtacggaaaccgtcggatccgaatcaagcggtcaggaactcaggatcaccgcggccgagtggaaactgtccgtagatcgctatcctgatggctcgtagtcgtacatacaccgttggattcgaatctcgcggccagggtggtgcggctctacgtcagccgcgccgtctccttcgccggaaatccagagccgcgtagctccgacaccattgccacttcgctcgagagctgaaagctggcacatctagtcgtcggctgatcactcctggtggcaacaaccaaaagaagtgatcgataattttattcttggctgctgatgaattcagtaaatcggcctggccggcatggtagatcgatgccgtgccatggcggagtcgatgtgcagttacactgaataaaaccagtgtgcagttgtgcatttggtctgcttagagcaggtgcaatagcaggctataagccagctataaacacatttcgaaaaaataaaaaaagagagagaatgacagcggggctacagatttataaccagttgcagcacagacttcaaggtgtatgtgtgtatgatagatgagaccaaatattaattatgtagtatatatttataggtaactattgtatgagttggctattaagttgattatagatgatttcaagccaacagttggctataggacacaacatttttctttttcttttttgaaaatgacacattttcctaagaacatgcacggagttctgcctgtctcaggagataaaggaaaccgaaactcatacagcaggattcacaggagagcaaggaaggtacttcggttctgatgcactggagatcgagtgcagatggtgctgtgaaagctcttgaacagcaggaaggtacagagatgtttggctcagctcaccttgaatatatatgcataatatctgggttgaccttccacaaatatccagatcaatggcacaaacgtgataaaattgattggaaaatcatttgcaacacaagatcacgcagtgtaactggagtggacttcatgtcgatccaagccgacacaattggtagttgacacaatgatcatcaaattctcaaaaaaaaaaaaagacaatgatcatcagacccaggcacccagcctttcattttttttctaatcttcccttaaaactacaagcatccaatcttcaactccattaccttaaaaaaaaaactaatcttcaactattattatattaccaattaaactattacacgcttgagttgcaaccatttctgcagtttcggctccacgacgtgcatggctcaaaccccgccaaaagctcacctcgtcgtcgtcgtcgtcgtatctctcctcctcgctacgtgcgaggcacatcgcgtgcgcccacgatgccacggccgcgcgccaccgtcctccacgtcgtcgatcatggcgaccttataaaactcctccgccgtgcgggcctctccctcaatccagtattccactaccgaggtcgagcaatggcggcgacgatgaacaagacgccggcaaccaccttcctgctgataccggcggcggcgtcgctggttctcctcctcgcggcggccgcgtcggtggaggcgtcggcgttcgactacgccggcgcgttcgacaagtgcctcctgttcttcgaggcgcagcgctccggcaagctccccgacgaccgcctcgtccggtggcgcggcgactccgccctcaccgacggcttctcccagggggtaatacatacatctccgccgcctccggttcaatcaaccaaatgctcgatagtggttacagtcgttagagtagtactttaaagtcctgagtttaaatctttatagaagtaaattttagattgtgttgtccacgggacaaagttctctattgcaatggccgtgtatatccagttggatgtaaaaggcaaggccgggtaaatgctcgatcgggttgagtaatgcggcgcgaattgaatcgaaggatggatgaatttgcaggtggatttggtgggcgggtactacgactccggcgaccacgtgaagttcgggctcccgatggcgtacgcggtgacgatgctgtcgtggggggtggtcgagttcgagaaggagatggtcgacggcaacaagctccaccgcgtcctcgacgccatccgctggggcaccaactacttcgtcaaggcccacacccagcacaacgccctctgggtccaggtacgcacgcactcaaggcccatctcaccaagagcccaacacggcccactagtgccctcaagaaaaattttctggattctttgattaggtgggtgacggcgacagcgaccacctgtgctgggagcgcgccgaggacatgtcgacgccgcgcacggcgttcaagatcgacatcaacaaccccgggtcggaggtcgccggcgagaccgccgccgctctcgccgccgccgccaaggccttcaagccctacgaccgcatgtactccgacctcctcctcctccactccaagcaggtacagagacacatgtggctgtgatcttcgtccatttttccaacccaccttcctcgtttttcgcacgcatgcttttcaaactattaaacggtatgatttataaaaaaaaagtgaattacgttttgggccacatcttattacctaagtttcactttagaccacctttaaacatatatttttactttggaccgaataaatttactattgttgtaatttggattaccacgaacgattttttttcagtacaaccaacgagcttaaacacatcaactctagtatgcggccgaactcctctatatatggttcatatgtttgccgaaagggaagttatacatgatgagaaaagttgtttatgatagtacaaaccgtaacagtggtaaatttacccagtctaaattaaaaagatagctttaagggtggtccaaattgaaacttgggaaataaaagagggaccaaagtgcaatttaatcttaaaaaaatatatattaaagttattttaaaaaatcatattaatccattttttttaaaaaaataattaatagttaattaattttataataatataagctttgttttgcgggacgggaggaggggctgtcgaacgcagccagcgtatgagagcaatcagcaaatgcagcagcaacattctgatgagttattttctcttttttttgggggggcagctgttcacgttcgcggacacgttcaggggcaagtacgacgactcgctgcagagcgccaagaagttctacccgtcggcgtccggctaccaggacgagctgctgtgggcggcggcgtggctgtacgaggcgaccggcgacgagcagtacctccgctacgtgtcccagaacgcggaggcgttcggcggcaccggctgggccgtcaccgagttctcctgggacaacaagtacgccggcctccaggtcctcctctccaaggtcctcttcgagcagggcggcagcgccgccggctacgccgacacgctgaagcagtatcaggccaaggccgagttcttcctctgcgcctgcctccagaagaacaacggccacaacgtcaagatgacccctggtaatccatcccatccttgctagcttcttcttcttccaaggatggaaaactcaaatcatccttaagaaaacatctcctcatttttgcatgatcataaaaaaaattagtaggatagatcactcttaataaatatacaaattcaaattcaattaatacaaataaaaacaaaaataataaatttgacaatgaatagaacgtgtaatttaaggttaaatttgttatttttgttttgaattgtataagttgaattttaactcgcatgtttacgaaagatgtcatatattaatctatcttgacaatttttttttaaaaaaaaattgataaaattttgagtgagatgtataaaacgaggggatgtcctcccgagggacaaaaatccacttcctcgaagaattggtaatagattttgcaatgtgattgttctgaattgtgtggattggattggttatccaggtggtctcatgtacgtgagcgactggagcaacatgcagtacgtgagctcgtcggcgttcctcctcaccgtctacgccgactacctcgccgagtcgcggggaacgctcaggtgcccggacggcgaggtgaagccggcggagatcctccggttcgcgaggtcgcaggtcgactacgtcctcggcaagaaccccaaggggatgagctacatggtcggatacggcagctactacccgacgcacgtccaccaccgcggcgcgtccatcccgtccatctacgccatgaacgccaccgtcgggtgcatggaaagcttcgacaagtactacaacagcaagaacgccgaccccaacgtcctccacggcgccctcgtcggcggccccgacgccaacgacgcctacgacgacgaccgctgcaactaccagcacgccgagcccaccctcgccggcaacgcccccatgtccggcgtcttcgcccgcctcgccgcctcgcccgccgataacacgccggagtacacgccggcgccaaatgccccctcgccatcaaatggtaattaattaaccaaatcaacaatgcaatcgaacttgtaccattgagatctcctccaagtgatcgtgcgtttctttgtcaggtgggtcgccgttggagttcacgcacacggtgacgaacacgtggaaggcaaacggcgtggactactaccggcacgtggtgacggcgaagaacacgtgcggccacgccatcacctacctgaagctgcagatcaaggagctctccggggagatctacggcgtctcccgcacgaacgccaaggacatgtacgagttcccgtcgtggatgacacggctcgacgccggcgcgcagctcaccatcgtctacatccagggcggccccgccgccaagatcgccgtcgtcgagtacaagacggcctgagaatggcacgacgacgacgactgatttctgcctttccttttttccattttagttttggtgtgtggttggctgctgcttttcagcaaacaggtggtgtgcaatctcgaagcaacgagtctgtgatgtcacctctgaccacgactgctttgagatgtggacatgcactgtttcttctgtacttggaatggcataggagatctctcagcttttcttttagctttcgtgatttctccattctttccgctgtgcacgcctgtgtgttttatatgttcaaattaagcagaaaactgtgacatgatgtttttgctattgtgcttaggtggtgtttggatccagtgacttaactttagtacttatatttagatactaatttagagtattaaatatatactacttccaaaactaattacataaatgaaagctaatttacgagataaattttttaagcataattaatctataattagagaatgtttactgtagcatcctaattatggattaattaggctcaatagattcgtctcgcaaattagttcagaattatggatgggttttattaatagtctacgtttaatatatataattagtgtccaaacattcgatgtgatagagattaagttttaagttttagtcccatctaaacagggtgctagtttgagatgaaattcaactgccaacgacttccttttctaattcttattttcttgcaaagctctttatcttctacaagaatagagaataaattgttgtaattagtcaaacaaatctgtaccttgtcttttcatcaaaaagaaaatctgcagtttgccaatgactctctgcattgctttgggtggaatatgacagattattccacactggttgtcttttcgatataatgttttttttttcagttttgtgtttaactggttcaagatggaattcagctgccaacgacagtgtttttctttgcaatttctttcgcttctagaagatatttaaggagatgaacagtttcagtttttttttgactggtcaccagagggagagctaccccacctaaattttcatttaaagagagatataatatattaagtcatactccctccgtctcaaaaaaaaataacagaggagaggatgcctctccttgtccagatttgtctcttatagtttgtctttttttgagattgagagaatatacatttgaacgaagaggagaagatagaatttgtttctaggattctgctacgatcctgtcggcacagttcaatctttatgcccagagagcaacatcctctatacacttggatgctaaacgatttagagcatgtataatagcagactattagtcagctataaacatattttagtgagataaaagataagagagaaaagcggcgggctacagatctgtagccagctacagcacgaactcctagatgaaatgtatgtatgataggtgggaccatatattaatagtatagtaagtaactgttatatgaattggctattaaatttgactatagatgaattggagctggtagtggactatactattaaacttgctcttagagcaggttcaatagtatagccaactactagctccaattcatttataactaatctaatagctcattcatacaatagttatatattgtattattaatacttggtcccacctgtcatatacacactgtgttttggaatccgtgctacagctgactataaatatatggcccgctggccttctctctttttatttattttcttaaaatatatttatagttggcttataacatgctgttgtaactgaaggagattctcctctgaaaactacatcatggtgatgattccaaagccccggagacagagcaggaatgaccagctgcagttggtctagccaatctgcaatttgcagtggtcagtcaaatatatcagcgttgctttgggtggattatgactagattatgcccacaccagccatcttttcgctccacggtagctttacagtttctagagagagaaaaaacggaaggccaagagggaaattccattgatgtcgtctgaatttcacgttcgcgagtacgcagaattgtaagaattgaaaggcggctggtgcatgtgttcaaatagaccagaagaaattttacacctacgatggtctgaaatttctatggagtatggacgaatgttttactagtataactgatgaagatgactgtccagccaataatctgaaataaaataagatgagtcagacatatactcctacatagaaaaggcactatttttttatcaggaaaaaaaccaattgctagactagaactaccaatgaaaacgatcgacgagctagacaatcttttcttcgccgggcacgagatagacattcttgactagcctgtttgcacattgcaattgactgaccaaattagacacatgcagtagcaactagcagattagatagctgcaaggagccaaggattggtgaagaacagtgctacatactccggtgtatttcttttctctgaagataatacactggtatgttcatctcctgcacggaactctgaaagcgacacatgcatacgagttgtcatagtggagtagcatgggagataggtagagtctcgtcggttgctcatatttcctaataaaacactgatttattaaataataaaattaatttttatataaaatttttatatatttttttagcgatttaaaagctaataataaaaaacaaaactatgttaaaaatatcttaaatttaatttcaaaatcaagtttaaaattttaatttttagcttttgctttgattaattaggtcaaccaataaggctcgtatagatatcgtgggttcgtgactcatcttttggaccgtacatacacatcgccagatcatggtaaggtattaatttgtcatgctgctgatctgtatcatatatccataagtcaagaacaaattaaatgaaaagtttcaagcttttgtacgttccgggtatatggaaacgggagtcttgtttttaccagttttaaaaaagtttaatactgcacatcagtagtttggaggtaccatcttctgtatcgtttgttaatctacagtgccagaaagacagaggtcctagatcatgtgatgcacatttgatgcaaatctatggggttgaagggggagtagtaaaaaaaaacatgctactgccaactactgccatctgttcatatatgatgaaaagtattttgattcgttctcttgtctcatctctgggttctccgaggtttggctgggatgctggatcgaagaaaatgaattatcttcaatctttctttttactgcggcatgaactagcatatgatgaggtatctccttcgccttataaaacactaatttagtatcgagtttaacacagtactccctccatattaaaataagtgcagttttatactattcatctccaacgtttaaccgttcattttatttaaaatttttttataattactatttttattgttattagatgataaaacataaatagtacttttaagtgtggctaaattttttaaaaaaaatcataaatttttcaaataaaacggacggttaaacgttggatacggatttctacggctgcacttattttgagacggaggtagtagtaagtttagattcacattattaatgtgttataatcgatacgtttgttttttctatctacttctgggactaaggaaggatacattccgtgtatccagattgcgcctgcaactgatcgtggccgtccccatcaaacgaagctgctgccaatttatatggataaatttctttttatttaaatggaagaccactgatttctttataaatgcaattggaaattagtactatatactgtactccatatattactactaaatccattcctccttatttgacatagttgaccagcgtaaatttcactcgctgttgccctatccttagccgttgatctcgatccaacgggcaggaatcaaggtgactgagattcggagaataagtcatctggtcaatagcaaactggttttatatcaccgcagcctcctcactcgctctttcctcgcctccactccaaccaccccgcgatagctggagtcaccggcgttcacacaggcgacagctcgtgctccggcgatcgacgcggcggccatggacaagctcggcgccaacccggccaactcgtgcgcgctcacgccgctgggcttcctggagcgcgccgccaccgtgttcggcgactgcccgtccgtcgtctaccacgacaccgtcttcacgtggtcgcagacccaccgccgctgcctccgcctcgcctccgcgctcgtctcctccctcggcatctcccgcggcgacgtcgtgagcatccatcgatcctttttccttccacggtcatttcgtcgaacaccttcctcgtgttgctaagctaagctggattgagtcaggtgtccgtgctcctgccgaacgtgccggcgatgtacgagatgcacttcgccgtgccgatgagcggcgccgtgctgaacagcatcaacacgcggctcgacgcgcgcacggtgtccgtcctgctccgccactccggctccaagctcatcttcgtcgacccggcgctgctccccgtcctccgcgacgcgctccgcctcctcccggcggggcacacggccccgcgcgtcgtcctcgtcgaggatccccatgagaaggagttccctcccgcccccgccgccgcgctgacgtacgagaggctcgtcgagaagggggacccggagttcgcgtgggtgcggccggcgagcgagtgggacccgatgatcctcaactacacctccggcaccacgtcggcgcccaagggggtggtgcactgccaccgggggatcttcctcatcaccgtcgactcgctggtcgactgggcggtgccgccgcggccgacgtacctgtggacgctccccatgttccacgccaatggctggagcttcccatgggggatggccgtggtgggcggcaccaacgtctgcctccgccgcgtcgacgccgccgaggtgttcgacacaatcgcgcgccgcggcgtcaaccacctgtgcggcgcgcccgtcgtgctcaacatgctggcgaacgcgcccgagggcgtgcggaagccgctcccggggaaggtgcggatcctcacggccggcgcgccgccgccggccgccgtgctgtaccgcacggaggcgatcggcttcgaggtcagccacgggtacgggctgacggagaccgcgggtctggtgctctcgtgcgcgtggaagggcgagtgggacaagctcccggcctccgagcgcgcgcggctcaaggcgaggcagggcgtgcgcacgccggggatggccgaggtggacgtcgtggacggcgagaccggccgcagcgtgccccgcgacgggtcgaccatgggcgagatcgtgctccgcggcggctgcatcacgctgggctacctcaacgacgaggcggcgacgaaggcggcgatccgggacaacgggtggttctacaccggcgacgtcggggtgatgcacccggacgggtacgtggagatccgggaccggtccaaggacgtgatcatcagcggcggggagaacatcagcagcgtggaggtggagtccgtgctgtacggccacccggcggtgaacgaggcggcggtggtggcgcggccggacgagttctggggggagacgccgtgcgcgttcgtcagcctcaagcagggcggcggcgcggtgacggcggcggacgtggtcgcgtggagccgggagcgcatgccgcggtacatggtcccaaagacggtgatcttccgcgacgagttaccgaagacgtccaccgggaagatccagaagtacgtgctccggaatatcgccaaggagatggggcccaccacgggcaccaacaccaaacgcaacagtaaaatgtagcggcatctagccagcagatgtggcacttgctttttagcgtcgtcgtcgtcttcttcactcggacagagtcacagagcagaaatgtctggtgcaggcagaggctgatgcattccgcattgtcatggcatggcatgtttctgtcgatatatcagcaccaccagccatggcctgtttgattgggggaagggggggggggggtgtttagatccaccgataaattttttttaaggcatgtacgaagtattaaatattagacgaaaaaaactaattacacagtttgtgtataaattgcgagacgaatcttttaaaccaaattgttccatgatttaacaatgtggtgttacagtaaatatttgctaatgatatattaattaggcttaataaattcatctcgcagtttacatgtggattatgtaatttattttgttattagactacgtttaatactttaaatatgtgtcagtatatctgatgtgacacgctaaaaattttcacccatttttgccagggtaattttttggttgccatgtgattttgcactacgtacgtgtccgtgtgacgatgtttcgtgaaattttgggcatttggtcgtcaaattccgggctcgtatctatcatcaagcggttgatttgccaaatttaaccgcgagctagtgctacgttgacgggaagacgatcaagagacgggggtgacactcgccgatagaagcggatcccgacggaaaagcccctatccctgccacgtggcactagcaaactgaacccaagtgaaactcatcagtgaccccacatgtcatcccctcgtagcggacaaccagtactactgacatgtggggcccagacgacaactcttaactccccggaaacacgcgcgccttcgccttcgcctccacacctcgcaaccgcgatcgatcgagagagagagcgagagcgagagctcaattcgcgggccatggcgaggagcgggagggagcgtagagatcaggaggaggaggcggcggtggtgtcggtggagcgggtgttcgaggggagggtggtgccggggtggaaggagcaggtgacgctgcgggcgctggcggtgagcgcgctgctgggcgccatgttcagcgtgatcgtgatgaagctgaacctgacgacggggatcatcccctcgctcaacgtctccgcggggctcctcggcttcttcctcctcacgtcgtggaccaagctcctcgacaaggccggcgtcgccagcgtccgccccttcacccgccaggagaacaccgtcgtccagacctgcgtcgtcgcctgctccggcatcgccttcagcggtacggtttccccgctgccattcttcgcactcgccgcggatcggatcgctcgctcgctgcacgattcagtgattgcgcgatgcaaattttgcgtcgaatcgaatggcgacggatcacttgtttgggccgtaaattaggcctcgatggcctcctttttggatgtatatcaaggcccacaggccacaattccatttcggtgtgtagcatgaattttgatcttaggttttttctggattctttttcttgttctgtgcttgcctttcttaaagttcaggtgtttgaatttccaaccaaaatgatgtttttagcacaccattggaaactggcctattgagcatacttcctccgtctaaaaaaagactaatgtccagattcattatattacgaaatgtcttatctaatattaggttgttttttggtgggacgaagggagtacacaacataggtgtacttctaattgccacgtaggacaaatacggtgcttagcaaaaaaaaatgattgctgcatttaaatacagaggataatgtagccaactagccatggcccatgggaaagcacctacaaagaaatgatttgattggagactcattcctcgtgttgtttcccctagcacttggtaatttgcatccttactaacaaaaaaaaacttatctttctttaagcaccttgttactataagcatacatgttccgttcttcacgtcctagacttttatcactgctctccctgttatcagtagtacatccacagagagcactgtgcactacgttctctgcttggtgtcagggtggtgatggtttcagatgctgatctatgcactggtggtacagggggttttggcagctacatattcgcgatgagcgacaggatcagcgaccagtcaggcgaggccagggacgagcacaacatcaagaaccccagcttgggctggatgattggattcctcttcattgtcagcttcctgggcctcttctcagttgtgccactcaggaaggtacttagtacatttcatcagctcagctgttacagtttctcctaaaattcagagatatatgatttctttgaaggacatagttaaattaattgaaccatgatgttaatttttctctgtcagataatgatcatcgattacaagctcatatacccgagtggcactgcaaccgcacatctcatcaacagcttccacactccccagggtgcaaagcttgccaagtacggtttttttttcagataagaaagtttgctaaagatatgtacatgtggtgaatacagagaacaaataagactcttgtctgaattctgaatcattttcctgcaggatgcaggtcaaaatgctgggcaaattcttcgtgatgagcttctcctggggcttcttccagtggttctacaccggcggcgacggttgcgggttcatgtcgttcccgacgctgggtctcgaggcctacagaaacaagtattgtctttgtttttttatacacgacgtcgttaatatttcgtataatacattatttaaaaatataagttaaagttacatttctttgatgataaaacaagtaataataaaataaacaataataatacaagtattttgaataaaagaaatagacaaatgtcatgctagcttgaaacatacagatgctcgccacactggacagtcaacaacagttaactgaattcttcagttggtttcttgctgcaggttcttcttcgatttctctgcgacgtacgtcggcgtcgggatgatctgcccttacctcgtcaacatctccgtgctcctcggaggcgtcatgtcgtggggaatcatgtggcctctcatcgagcacaagaagggtgactggtatcctgctgacctcaaacccagcagcctccgcggcatcgtcggctaccgggtagaacgagcttcttgcaaatgatcatctgttgcatgatcaatggagtaattgtgattcgatcgatgcaggtgttcatctccatttcactcatcctcggcgacgggctgtacaactttctgaaggtgatgacaagaaccacaacggcgctggtgatgcaggtgcgcgcgatgatgtctgagccgacgctgccggtctccggcggcggcgggcagacgccggaggagacgttcgacgacaagcggcggacggagctgttcctcaaggaccagatcccgaactggctggcgctgagcgcgtacgtggtgatcgcggtggtgtcgatcgcgacggtgccccgcatcttccaccagctgaggtggtaccacgtcgcggtgtcgtacgtggtggcgccggtgctggcgttctgcaacgcgtacgggtgcgggctgacggactggtcgctggcgacgacgtacggcaagctggccatcttcacggtgggggcgtgggcggacgcgtcggacggcggcatcatcgcggggctggcggcgtgcggcgtgatgatcgggatcgtgtcgacggcgtcggacctgacgcaggacttcaagaccgggtacatgacgctggcgtcgccgcggtccatgttcgtgagccaggtgatcggcaccgccatggggtgcgtgatcgcgccgtcggtgttctggctcttctacaaggcgttccacgacatcgggatgccggggtcggagtacccgtcgccgaacgcgctggtgtaccggaacatggccatcctcggggtgcagggcctcggctcgctgcccaagcactgcctcgacctctgcatcggcttcttcgtcgccgccatcgccgtcaacctcgccagggacctcgcggcgcccaaggtggcgaggttcctcccgctgccgatggccatggcgatccccttctacctcggcccctacttcggcatcgacatgtgcatcggcagcctcatccgcttcgtctgggaccgcctcgacggcgccagggccaaggcgttcgctccccccgtcgcgtcgggcctcatctgcggcgacggcatctggacgctgccgcagtcggtgctcgccctcgccggtgtcaagcctcccatctgcatgaaattcctctcccggaccaccaacatcaaggtcgacgcgttcatcgccaagctcccctcctcctagctaccatgcagctgatcgacgagctagccatctatctagctagctcatgaccactcactcaaccatgacaacttcatatatagctagcagtagcacatacattaatgtcgtagcctccttgtgtcttgcttccttttagaatcagatgcctttgctagtagcccgcatgcatgcatgtgacacatataaatagctactaggaaccgagcagcaatgcaagtactacattatttggactgtcaatattaccacaaccaacacagcagcaaccaaatctgatctacctgggctctcaacttttcaagtgcgtacctttctagcactacgacttatagtaggataacatgatcattttaccttttgggttgcacgcatgaaccagtacgtagtttctccctctcctcgcctttactttttgctaggtgagggcgagaatgatgaagtactcccactgtttcatattatgagtcttttgacttttttcggtcgaaaatttttaggttgaccaagtttataaaaaaattatttacgacacaaaattagttccattaaacttaatgttgaatatattttaatacaatgtttgttttgtattgaaaatgttactttattttgctacaaacttagtcaaactttttaaaaaataactaagaaaaaaaatcaaacgacttatgatatgaaactgaaaaaataattgattttatctaaatataactgtgtcgtattttgggacggaggtagcagtagcgagctagctaggtcaggttgatgtgtgtaggtaggagaatacagcgaggcgaatatctgtgggagatctggttggtcccctcggagggcaggaagggtctggatctgcacagcccagcgtgggtcaggcagggccagccagccagcccaggccggcctctccatcattgagagtcatgtgatccatataactgggaatggattctaatccctcgaggggattcgagggggataatatcccctcatatatctttttttttcaaattcgatacaaatagttataaaaaaatctgaaaaaaaattgacaatgtagagtataatgatacctactaatccaccaaaattcaagttcaaattcgatctacacatcgagaaacaaaaaagacaaatttagatataaacagtacgctactattcatatgttgaatttgtcttttttatatctcgacgtgtgagttgagtttggaattaagattttgtggagttgtatatatgtgttgtatgaatgttgttaaatttttccagaatttttcataaccgtttagatggtttttaggtaaacgagggaacatcccttcgagggattagaatagtttcccatataactctactatccaccatgctactacctcctagctagctaatcactccgacataacattgcatgaattcacttgaaaatatactgcagtaatctgcattcagagatcaggtagtaggagaagggttacaagtggagatcagcctgtagtaacagctgcagaattgcatagattaacatgtaattctgatggacacactgcatgcaattccgtgtactaattaagaaattagaggggatacagtaacagtaacatcgcgtggatcagggggaatttggatggaatgggcatcacaggcagctgcaaaattcagttcgctttgcccctcgagaagcgcgaaaaattccatcctccccctgattgctgccagtgcaggcccggattgggttgttgcactgcaggtgaggtgaggcaggcacaggcacaccagcagcagcaggaggatgcagtaattaatcgcgagacggatcatggatccatcgagtgagattttatggtttttttttcttttttgctgggagaatcacatgacttttatgtgggggttatgttagcttttggatggtagcatttggtaccatgagataccattttttctattataaatttgatacctcttggtatctaaatactataaggtaccatgagatactaatttttacactaaatttttagtacctcatagtatctactcaaggaccgtagagacggtgttttgcttttgctctctctctctctcttttcttttcgcctccttcagatctctttctgcacaagcgtgatttccacctgctcaggacagaacccccaccaccgccctggcggctctgcctctgcctccttcacttcacttcatttctctctctcttaattttttttactcagaaatggcagtttggaatacgataagtttaaaattttacatgaattttgtagtgttctaattaacttttttttttgccaaagtagggggaaagataaatgttgtgcagtgaactgacctagctctaattacagtggtgaagtactaatgaggacaagcagcaaaggctaaggtagctcgcctttctgtttgtttctttgtcagggatgtgaggctgggttgggggctactttggaaaagggcttttgtcgtaaatgctgcagtaattaggagagagcttgcatggtatgctaatttcgtgccggttttagaattggaaacccaagtgtcagtagcttccggtcgtgtggccaagtacgagctgtcggggctcggattctggcaaataacagagagatccaatgagaattgtgagtggtgaattttgaaatttaaacgcgttggttgtagtggtttcattttgaaattagggatacggatgcaaaagtagtttttgggatacatgatgaattctagatggactctgaaaacgccagtacgtttttcgttctgaattatcaaattctgaagattgcttcagtgaaataaaatctggaatttgcttcagccaaaccttctgagcgtacttctgatctgaattctctccaccggctgtcgcaccgttcagcaattccccgcagcatttgcttcatcaaacttccatgggcgtgtatgatctgaagatctttttcgctgaatccagatgctagctctctagtgtttcgtcaggcaattgtttcataagaacctgtgctgaattgaattttcataaacagtgtgttaaagaacaagtcaatgttagacaaactgttgaacccaaattctcctagagtagggaattcagtacatcagcagcaagagtaattgtaggatcgagcagaagaaacaaaacgaggaaaaccaagatccagagaaggcagacttccaagcaaggaaacctttgccgaattgcgcctgaccacacacatttaagaagggcgaaattcagaagagaagaaccatcctgttgctgaatttaaccaaagtaaatatgcagcataatgccatgggctttctcaagccacagaagtcaacaaacaccaagaattcaacaaaattctccgccgcaacggcggaattcaagtgagcaacaagtactggatggtccaagaacacccacacagagaattctcagagaattacgccccagagagccaaaaaccatccaaattcagaaccaaaaccacagaattcaacccccccagggatctgtgtggccggaattctccggatggcggaacgggaagcacacaaagacgcggcatggtttccatgggctttcttgaaccatcaacaggtagagacgaccaaagacagaacggggagctcgacaattcagctttcttttcagagaattggaggccaccgaccacaatcccaacatgagcacatacacccccacgagttcacagttcaagaaagcctgtggaaagcatgcccgcacatctttccccccacatcacaattctcacctcatcacatcatcaccaccaccaccaccacccaagaacagcaagaaaactatctagaaagagagagaggaagtagaagatgcagaggtggttgcaaggaggaagagatagagagagagagagatggatggagtgagaggggcaacggcccactgaggcggggggatataaatagcgggaggagataaccaaccgggaggatggtgtggcacgggccggtatatagtacggtgtcctgctctgctctgcacgcagcagcagcagccagccagccagccaggctgctcggctcggctcggcctcatggcgacgctgccccacgcaaacgcatcccctccttttccgtgcacctgccggcatcgcaccgggactcccggaattccatgctctgccaccaccacccaatctcagctctccccacacctactagttaaaaaaaaaaacaacacacacgccggctttggttgttagctcctgcttttccggtgagaattgcacgatcccggcgaacacacaaaaagattgcaggtcagtatattaagaaggtaaattacggtggacaaaagctactccaaaccgcgagaggggtcagaggacggaggagtgaagcataggtgatgacgcagtatgcagagacgcacgaactctcacctcactcaccggccaaggttattatgacgttggccatcgatcgatcgatcgacaaggcagggctaagctaggaggcctagttgccggccaccgatgcatgcacgcttggatggttggtctcactcgattcgatcggacagagacagcccctgcatctgcatctgcgtgcacgggctagctagctagagctcgatctcagctatggatccgatagatcaatcgatcaatcgccatgaattttttttccggtgacaggtggttcgatcgatggatgaatgagatcacggatatacgttgcattttgcttgcttgctgctgctgctgctgtcgctgctgctagctgcagccggagtcgtccaggacacttcacacatgctacttatcttccacacgacgcaaagattgatattgtggccttcgtgaatgaaatcggccaaatcttgttatctgcaactgcgaggcatcccatgcctgacgcacatttcccccctcatctccgtgatcgatcgatcgatgaattcttttatttcttccctcactttcttccttcctttccatgctcgatcaatcgatcagtcagaagatgtctccggccgggacaagcagatgcatcgatctcatcagatcatcgatcagtctgtggatgcagtaccaactggccgtcgcaagagctcaatgatcagctacagtttaccaatcggtgagtagcagctagtttgggactgaaacaaatcagctactcctatctagctataatacagtatattcaccagctaccaaccacgagctagcgatcgatcgaacgaacgagcagatagccagagagacgcagcaaccgaatatcatacacacattcttccaaaacagaagtcgagaaaactttcgcctccagttgtgcaaggaatttctttaaccatggcttgtcgtgcagattagtgtagcgatatgattcattgtcccttccatgtgctagcagcagctgcagctagtgatgaggcgttttttttgtttttttttttctaatccatcttccattgcttatgctatcgccatcacgtcatggccatgtgttcttctgcatatataatccactgtacatccggctgcatgcatatgcccctgataaataaactaattgggccaattagaggcaattgccaggctaatcctgtccctgatcgagttgatgcaagggcttttgtacgcactaacacattaaggaggatctggaccacatgtactgtcagagaaatggacaagccctgtttgtgagggccccaaaaaaaaaatgaaaattcacttggtcaggtcactgtttaaacctgatctttctctcatctcagtatgaggttaatctgatggacactgcagctcacgaattcttgcagtgacatggcaagtactactctgcgtcctatgatttatgaactttttttttctttcacggctaatttggcttagcttaattagctactcagattgttgtcggatgcagtcgctatcatgagcgtatgaaaacttgcagtgtacagtgtacacagcttttggcatatgattaaccaagcatgtagggggatatcattggggttgcagaaagatgtggatgatgcatggccaccactgttgcaacaaaaggagaaaagaatgtgcagccacacgagtaaaagctactacaagtctacaacatcaatcagcacgtactgaatgaattaatccctgatctctgatgaatctttctgaatgccaggccatgtggtagatgattatgcagagcagattaaaagacaatccaattcagataccagttaattaccttcttgatgacggattagctgcaggttaattgagcacggcaagagcacggcggcaacagcttgggcagtagcaaaaaagaccgatcaataaaagcagcggcgaacggcagcagcagagaggcaaacaagactcagaaaaggacgcgggaaacaggaaggaaaaggcggggaggatgaacggacggatcggggccccagcccggttcgtactcccgataggaggaagaaagagcggcgaattcacggtacaaaagcggatttctgttggatctgaggcctgaatcggcagctgtgagatcgatccatggagaattattgtttattcctttcttccgattgagattaatttcttattcttgcccttttctctcctgtggatggatgcagtgacggagctagaaagattttttttagtccagacaaacttcaatatcattagtactcatttcgttctataatataagggattttatgtggatgcgacgcatcctaataccatgaatctgtacagacgagtacattcattacagtaggatgtgtcgcatccactcaaatcctttatattatatgacggaagaagtatttgttataaaattttatcatcaatttacttatcaatactaaaatttaatggaattctcgccagcgaaccggatagatggatggatcatggaggaagatgggatgagcatgaggcgaggcagacaggcaggaggagcatgtggcaattggtgagtgaatctttgcgctgtaaagacaagcgggcctcctcctctgcaattcccctgtgcagcaacacgcacgtcaggttgatatgaaatgaaacgaaacgaaacgagagattgctttccctccatttccgctcgctgctcccccctctttagctgggccctgattgttggaactccgaaggataaaaaaacaaacatccttttccccttcataagttgagaattgttactactggttgacaattcaattcagtgatagcttcctcatacttgccaatgatgtaaaacaaaagacaaaatactccctatgtttttaaatgactgatagtggacactattcccttttgaatttagccactcgtcgttttactaaatatttacaaggactaaaaggaataatatgttattgaattgtattatattctaaacataaaacatgaaacttttattcaattactctaaccatttcagagtaattactagtcaatattcaaatagtaaagctaaagttatcagttatttaaagatggaggaaggcaccgaaacccgtcatgctgtaagcgggatggagtaatctatgtgcgagcaaagctcgtaataagcttgtcgtttgcttgcacccactccaattaagcaagcagagtctctgtagtatatttgcggctgccggtgagtgccgcggcacagcaacggtggaaaagcacatggcaacatggcgatcgatcgattgattcgacgaccggccagccagccttgccttggctttggccttagccttgcactgcactgtctctcctcccaccggccggacatagcaatggccggctttttcttttgccattttacatgttgactttgcagctgctgattggtctgtgtactcttcggtgatgaatatacaatgcatcgtatgcacaaatcatgctagcttgcccctgcatgtgcagctcagagcacaaaattccatcagaagtaatcaaataatgcgccattgtttaacctcgtaagtgtgtacggaatcgtagtgccacgtagcaatgggcagcttgcgtattgtgctgttgcagaagagagcatatgtatatggcatagcagtacatctgtacatgacatgtggctgcagagaaagaaaaaaaaagaaaggaaggaagaaagagagatggatgattaattcatgggaaagatgagatgagagaggtagcctgcttgctgctgggacaacggggcatgcaaatgcaatgcaaggacaggcaattaattgataaaattgcttgcgatcgaaggaaagcatgtgaaggaattaagatctgagagacatacatacctgcagttaacttagccgcattctctctctctctctctgaatttagagtgattttgtagttaacaatatgatcaatatctctccccgatccaacgtgaaattgcacggtagatccttgtcaagtggcatccgtacatgcagtggaagctgaagcaatttcttcagatctgcagttcaggaaagcccatgatcagaccattacaacaacatcaaatcatacgagcttgaaggttagaaaaaatgcaacaagccaacaagtaatactgaagcttatccttctaatcacaaaaaaggaaaagaaaaaggttcttactccaaggcaatcttgcatactccaaattccttccctcacaaaagaaaaggagaagaaagaaactgttgaagctgaaactgaagacaagtctgcctagccagcctccattcaaaggcggacaacgcaatcatcagtatataataatattaatataatgtactgttgctatgaaatgatgaaatcaatgcagcttggttagttgcatgtatggccagagtaaccatgtccatttgcatatatgttcagacgaaccattcaacaaactgacgcaggcagctcccataattccaaactttgatgatttcatgaaaggccatactccgtaaggaacaaaaatgaggtcaaatggttacaagggcagcagcaatattaattacgtgagctgtgtcccgttacaattgtcaggccaaaaagctcagttgaatgaattacataaaatctggacaaaaatggcaagaacacatggaacagtatatgacacgtttataagattaccgaccaatttaaggctagtttagtgtgtaaatagtacaaaagcagccgtggggttccttttcctatataccgtgttaatgtatcgacaacaaacaggtgtggtccaagcattttacaacaccgaaatcactgccagatttaatcttcacgttgatttctcctgcaacaccgaagcattagactgggatctttcacacagaacaagtactgatgatgctcacaattacggatagagcaatttatggcctcaaccatcagcacctcaagatcatccgtactctgtaggcaatgaatatattggaccacattgtatttcagcatctgctgaaattgcatccagtaaatcaatgtgagaacagttccagctcaagactaatgccgacagtataacttcccttcaaaatgaagtcctctaccagattgcgtggactattttgtgtaatgttatgttcacaactagcttcagttatgcaaactaactggctatgactgtcaatccactgttttagtgtcagcagcagaaccattatgtctgcaagaaggtccataaatgtttcttcaaatgataatatacacattctaccactgaaaacatgtaaatgaaacctctgctttagtccatgattacaatgattacaaaacatcatgaatgaattgcgtgcagtaaccaagcaggtggaataactaataacatcatctacaaccatcttacaatctgttagttggctccagtcctttttcattcaagtgagtaggctaaaattattttaaagaaaatcacgacgagaaattagtaatacctagatactaacattatgcatgattgcatgcttattcatttccttaagttgaaaaagtaaaaataaaactttgcagaaatataagtagttgaaaccagcaagatgaatcattatgaccaagccaaaggatttaagaggcaaggaaggtttagttaaggaccacattttttttactccaacaatacataatctatcgggaaggagttcataaaaaatggcttatgaaatgcatgaaccaacatatgaaatgaaagcagtgcttgaagacttgtgattatgtacctctaaagaagttttgaactcgaattgtcctgtaacttgccagtgtttgagtagcccgataatactctagaaactgagtaggggcacccaaaaaatcgaataaggttttgcaggcctctctcgccgtgcatgacattcagcgaacttaaacggttaaggtatgtatttccttcatatatataactaagttgctggaacaacagcacacctataccggcgttaactgatagactagcaaatgcaatatatactgtaacaagaccccttgctgacaagaagaatgcagagcttgccaaggtaccaataatctcaattagcatctttatataacccattgaacggtgagttgatgctagattttcaaaatctagtgggggccatatatgataacttgaataaatggtcataccagcagcataactacaactgatgaccacagaaataagaaaaaatacaaaagcacggtgatttgaagctcccacacagttcccaatctgcagttggacacagaaaaaggaaacaaaccaagtcaagtcaaataagtagagaggaataacggtattggaagttagttttagagttgtctgacttacaaatgggcaatgatgatccatgtctaacacacacattttgcaagatcggcagtgatgtgcccttgggggctttggtttactacagtatgtacagaaggtatagttttccaggtcattttcccaaccatgggatagctgccccaccgcatgtctgccggtgcaccagcagatttaaaagaggccaagcaataacttgtgatggtaaatacagctagtacacctgttaatatgcagtgaaagatgccacaaaatgtgctgatcgagaaaacaactggatataccgcccagaccccaccacctgtgagacaacaagtttagtcatgtggaacagcagcacaaattgcatgaataaacaaataaacatggagagatcaagatggaaagttttatctaaagcagatgacaatagactcggaacctacatatgacgaagagcatgaagaggatgagcacagtcacaaagaacctgtcccggaaattcctccaatgagaaaagcatacactgtcaggttttcgtgaagtttggttactttatgtgattgctccacaccagccacacttaaaaacaggagcataacttgcaaaaatgagacggagtccacatccccaacaagtggcctcatgatcttctggtatagatgttacacattgctctacctaaatggaaggacaattgcaattagcgcattactgtagagaatattagtccaacttaaaacaactcatcatatcattttccaatcagcaaactgtaactcacaaccttgacttgtttatcatttcagtcaagaaacttagggaatatcattcttgctactgagccaagagcacataattttattcaagagcaattctttataacagattttctcccgtgagattgtagcacagtaagcacagcttttagcagtcatatctaaatcaacaaaactgcaatcatgtattataaatgatgttcaatgtcaacacaatttactgattatgctgtgctaactgcctatctctgggttctttctgaacacaaattaaatttattttaagttgctagtacctgtttcagaagttttaccaacaaaaaagggtacattagtgattctcggagcacatagttgtaaaatatcatgtcagttaccacagataatatccgtgtttctgaattgcattacaacttaagatcatggtcatagactcgttgtctgggccgaccaacaaaattataaggctaaagccaaatcaccatccagaccaaagcgtatcaattataaggctacagcagggttactcgtcggatatcagttacttcccagagcatttggcactccaaataatccagatatcaagcatcagacgtctcctttaacaaaataacccaataattgaatgagtgataatagacaacccaagctcacaaaaggataaaccccaagctcatgatccaactggatgcgcagattacccaagaaacaaaacaaaacaaaacaaaaaaaacacctctacaatctacataacaagtagagggcgatgccccgacccattattaattatcctataggctagaaattccctcgcgtgttggcaacggagaccaaaaagatgggtgcgaaacttaggcaagaccgagagccgacggttgcaaatcaggcgcaatgatgctcccaatcatggacccaattcgacgcaagagcactagaacagcacggaacccctacaaggcgatgccgccaaagcacgcggcaaaagaaaaagggggagacgggcaaacctcgagcagcggctgctgctgctgctgctcctccatcgcggatccaccagaggagaccgggagcccgcggatcggaggagcggaggccggcttgagagagcggaggcggtggttgggaaattcgcagggttctctacacttcggaatagaggcggagacggagaagaggagagaatatgtttcgataagaacaggtttaagggaagatgacttgaggttagttagttttaaacggtacaaaagaccaaacaaaaagaattgcttcatggtggaggctcttaatcccttttctcttttataaaagagtacttcatgtagtgcttaccatgtcatatcatgtaggattattcattgtaggtgcttaacttcaaaaaaaaaaagttgtaggtaaacagagaggttcatgaagctcaaaaattgctatttaatcaagcattagtgtcattcttattcctatataataataagcagcttgactattctagttgaaaaaaaatatatggtactgtttccttgagcacatgtatgatgtatatacaaaaatacgcatgatctaaccccccgttaagttctagaccgggtcaagtgcgacactggtacaaggaaaacacttaaggttatgtttagtgcacctccacgtttaaagtttcaagttaaattatagtaatttagattttatatttgtagaaacaaaatgactcattaaaatattatcaattttgtcacaacttcaggtccaaataatttgtaaaaaaaacttagggtgtatttggtagtgctactagttgacggccttgcagcagcaggtatagtcccaccacaagaaagatgctagggaagcgtcagcgctgcggttgtacaaccgcagttcagcactaccgaacaacccttagttacagagtaatgtcaaacatgacgtgctaggggacgcactcgtgacgttagtgtagcgttgcattggtaatagtgtgtgtacatctctaccatgtaatcgcaaaatacaactctggtttttttagaacaaaggtattttacatgatttttttcatataaattagttcaatttcaaagaaggcctactttggtgatatcctgtatctcggacaagggacctgttcactttgatgctaaaaaaaaccttaccaaattttggtaatgacaaaattttggcaactataccggtaggatttcttatatagttacaaaatttggtagcaaactaaatgtagccatttttttgtcaactttactaaaatttggtaaggttaaaaatgacatcaaaatgaaccggcccaaaacgtcgcgaatgataaattatctcctttttgtcgctagtctgtgtgcacttctaaagtacagagaactgttcctgttttggaccctatgctcctgctaacaagtcgtattcaggtttcaagcataggatgcttagtactgtgttattactactacgttgttattgtgtacatacagttgatacaagtgggttacatgccgcagagataagtttatatttgcagtttgcactttcagggatcacgaacatgccatttgtttgtctttttttaaaaaacaaaccacacaaaatactgcgaacatacgtttttttttattaacgaactgcacaagatagtactaggtcttatattatttatatataacagaaaaacaaacaaaacaacagcaataaaaggctataatcaggaaaaagtaacaccaccaccaccacgccgcacgcagcagataagaacacaacatcccactgcattgaaactaacatgccatttgttaaggggtcactgtcttgcaagatcagcagagagcagcgacgtgcgatttgagatttgacagtttcacaatgaaacaacagtgcagtattttctcagttacatatatcatcaaaacagaacgcataggcgagtcacactcacacctgaaacctgggaaccagaaagtggtgataactagcagggggattgagatccatttgtattttcatccaatggtccagatttgttgctacaaaacacgtgaaacagtaatttctgctacagtatacaggtgctagaaccattaatttgttatcatgtggtgctagtgcaactgcttaagttgcagttaccctagcaactgcactggatcccaatccctagcagggactacagcaatggtcctcttctttccatctactatcacacccatacttggtcagcaacttcaacattctaacgaacgaacaaattaaagaagccaattcctatctgctgctgttgccgatgttcccttctatcatcacatgtcagccgcaaggaagttgccaggtagggcaatctgccaatcagagaacagtgagttgtttcttaaaaacaagttcaactggcatcttgggtgttctcatgaatcaagaatttagggtcaggagagataattaccttctcgcctggcttgaatgctggtagacctctgtatgggcaagtaccacatcgaaatgcatcgcccaacccacactgcaattatcatttcacaggatgaaactatggattttcacagggagaggaccaaaggcaaaaaataaaacacttaattaaaaagcagtcatgctcacattgccacaagcggactgagggttattgatctgttctgatgtgagatttagcttctccaccttctcctcagcctcagcccggccacaagtacagttcttgcatgccttccttgtggctcccacctcacaatccccaactggtaaaacataagcaaaccttcaggatctacatattaaatttatagacgttgaacaaagctgaagggttctataaaacagtaccaactggaagttctggtttcttcaagtcgtcttcagtcaagaggctgtcttcatcaatcagttcagaatcatcatcaatctgaatctttggaagaccctttgtggctttcttgagggggaaggaagagcccaagctccaagagaccttctttgccttaatctgcatgtgattcagttagcactagaaagtatgacggcacagaagcattaacacatattgtggcactagatcactcacagtaacagaatgctcgctatcctgggaacttgcagcagaagcttgcacgtcaacaaatcctcctaacagtagcttgcgctgaatagagttattgggctgatgaagagaagatcagaagatcagggagtgcaaattaagcattacaaaataaagtatattggcaaaacagtacatacatcctgatcagagggggaactctgtataagcaccatgcctccagctttaagaaccctgcttatttcagttatgaacagatcgcccaagttttccactttcttaatgacagcaagaacagaaccaactgatgcatcatcaaaaggtaacttcccacctgaaccatgccaacatggaatgttcaaaacgagcttatgacaaaccaaaatgtatactacaaggataaggtatactaaagcataacagaaatcgaaactgaacatatagcagagcaaaacagtgtgtcggttgtagggtccaaattttggaacatactccaattttggagtagtagtcatgggtgagaattgaatattgccactaatgaatctagataatcaatacaaaacatatagggagatgatctccaaaattttctcctcatgattgatgtgagaatatgaaactcttttctttccttcgtcaaccaatagcactgtctcataacctatttggtcccatatatggtgaaatgaatctatataggaattagcatatgaagcatcataaggggagtcgtcggaaactaaaggaatggtgagctccaaactgtttttcgaagaactctaccatgaatcgattgaaatcgattgaactgttgcgatttgttgagttggaactgatcctaaccagcaaagaacaaacgctcgtaacagggttaggcacagttccatattattgaatctaaacacgaaaaatcctaatcgatatcggagtctcatatgatagcaggaaaaagggaagcaaggagacgaggagaagctcaccaagcgaggcgcactgcgtgatgaccaccacctcctcccgcgagacccccgcggcggccgccagatcccccaccgcgcgaagcggcaaggccagttcgtccgtcaccgcgagcgcctccgccaccgtcgccgccatggattcaaatcgaccgcaccacctgcaaccgcgcaagcgaaaaccaaaacaaaccctcaccctcaaaactcgatcaaaggcaggaaccagatcgaaacaaccagccagaagattgaaccccgcgtacggattttatacctgatctgacgtcgagggcggtggtggagacgaagaatccgcggcgccgcaagagcaatttttttttggggggggggggggggggaagcgaatttgggttttggcttttcgtacgtagaggaaggaggaggaggcggtaattagaggaggagaaatcagaaatgctcgcggtttcgtgcgtctcccgaagcttcctgattaaactaatcacgtgtcgcctttccaattctcgccggcggcggcgacgcggaggcgagacgagacgatgccgccgcgaggggactcgagatgggccgcgcgtcctccgcttcgctggcccaatacagaaagagacgcgggcttcgatgttgtctcggcccatggacaggcctgacgacgggatgggcttcgctgccgcgtgtgagttgcagctgcagagcatgtgagaggccgtcgccggcggcggcggcgagaggatggcgacgcgagggcgtgcgtgcgtgcgtgccgcccacatcacgccggcggcgtggcgttggactgatcggctggggtggggtggggggcggcggatccgtgacttggtttacgcgggcacgcgcggcgacctgcagaccccagtagtgcccatcgccattcctctgcaggcggatctcgtttacctcgtgaggtgaactcctttgctcgtttcaccttcccattcatggcggcttttggctttctcccgtacatttacttgatcattcatctttttcaaatgctcacgccattggatttttggactgaacattcttcaacatgcagggagagaaaagctgataaaaatgtggcgctccgcgcttcggttcagaaacaaccacagattgtgtacaaagttcagatacttctactagatcgtcaactctgaacaacgtaagtctttctccctctagtcaagcatccaaaaaaattagaagtaggtagtagcaattaacctctgcaattaggttctcttcactaactgaattgatggcgatgagaggaagaacggtggccgttaagtgagtacggcatttctttatcatctttggtctctcttgcactcgtgagcaacaccggcaggtgatgccgtggcgtccagggagaggagaatcaatcgcttatccgttttcagttggtgagtgggcgccaagagaacattcatctccacttcccaacacccgtattttagccatcgccaacctatggttgtctcccgaaaccctctcccgtgatccatccgcgggaataattgccgcgatatgtggatatctgttagacatatgtttcttgacacaggttgctggctgctactgttcttgattttgattgctattggttgtagattaacctgtcaagataccgaaaaaacaggtgccgcagtagcatatgtttttttaatcagttcagctgaaagataggccaaccgaaattttgagagtagcatacattgtagtagcatttctttgacgtgttaatcctgtggtttaaagttttgtaagtacaatgtgtcgaattcgcattcctcgaatgcgatgttcaaatatgtagtttttttggtccgaaacagtcaaaaccaattcagagccaggtttgtctgatcaaacacgaactgaccatactcttctactccctaggtggttaatttctacagtaccacattggatgtacttgatggtggtattaacactgcacatgttggagttgctgcgagcctgatgataaactaacacgagtggcatttcttctggcacttgtgagcgggattccttagctagtcgtactgctgctccctgctgttctcgccgtgctagattggatgcatatgcagcaatatcttatcacggtattcgtcttgaccctctgaatttctgtccataagattataatagtggactatgctgtacctacctttcaattgatttgtcccttagttaactcatgtgtttatatcagtatatcagctaacctgatattagacatcctaaacatctgaacatgaaaaactaaacgcttggcaaatcttcccacgcttacctctattagtatggccggcggacagctcagcctgaactagaagaagttgttgttttgcgtgtttgttcttcttcttgtttgaaggttcttgagctacatccattaatatgtcaccaaaaaggtagtagcaatggtccatactccatcctcctcatcttttcatatgaacactttatgttacagataatttaagcatgaaagagggctcctctccaactcccacatggaatatgataagcctgtgactgtgagcaccagtaaaactccaaagcccatttcttagggagaagacaataccaaagccttgagtggcctaagccatatcaaattgccaatatgacagccctggcataataggtttttggagcgatggagccactgcaattgcaccagctcctgacagagcacacatgcctgaacaaatgtcacgacctctctctctctctctctctctctgattagttaattgaatacattgtaagggccatgtgtcctgatgtcctctcaactctctaagcttgtttttcagcacaggattttcaacagtactatagccatagaatgtctggatagtatagggactagggagcaaaaagaaggggaaaacttttaacagtgcttgtaacagctacaagttcatctttcatcctgcaaaagttggtcgttgcctagccacagaatttttactgcactttgacaaatatgcacagcatgaactggagtaatactacaggataagggtgcatagctacagtttgttgcgtgctctgatgtcaagttggtgacatgttgccaatcaattccagccaggcgcactagcaatcttagcatccagatgctgaatcatctccttgagcagtgcaaacactcaatccatagtggccatgaacaagatctctctgttcctctgtttttttcctctctttttttctttattttcatatgagatctctctgttttagaatagaacaaggggacgtttttgtttgtttgctctcgtgcctttggaaggcaggggtgcttttttttccctttcattctttgaactgcatgcagagcccatcagcccagcattgaagagtgaagagttcagagaacctgttgcctacccagaccaaaacttgcttttgttttcttctcagggatcatgaggtgttcctccatatctctccacaggacacatgcactcaagcaatgtggtactactagtctactacactgtgagcttgtgagctgtgactgtatctgccttgaggtcccaagtaactgaactgaggcagcaaccaagcaaccaaatcttcccaattctcacttgctcctagatactattaaactccattctctgcagtgccattgcctccatttctctctctctccctccctttctctttctctctcgagccatgaatgagctctgcgacctcaaggtgcacatcaatggccatcacacgcttcttcttcatcaggtacgtgcgacctgcgtaaatctttgaaatcggttcacgtaatcaagaatcatctattcttacaagtgattggtgttgtttcatgtgcagagcgtcatgtgtgcgttctcggggaggttgaggacaatggtgacgcaggagaagaagaagaggaagacgagccgggcggagagcctgtccgtcaagctcgccgacttccccggcggcggcgaggggttcgagctcgtggccaggttctgctacaacaatggccgcgtcccgctctgcccgtccaacctcccgctcctgcactgcgccgccgtgttcttggagatgaccgaggaggtgtgcacctgcaacctcctgacccaagcagaggcattcgtggacggcctctactactggacatgggccgacgtcctcgccgccgtcaagagctgcgagccattcgccgcggcggccgacgcctccggcctcctcgagaggctcatctccgcgctgttctccaagatcaccgccaatccggagacgcccgtcgccgcgggggcagtcgggacgccgaaccgctcgtcgtcgtcgtgctcgtcgtcgccggacacgctcgggttcggccggtcgtcgtccaccaagacgcccgagtcgatgaagccgtgcttcgccagggagtggtggttcgacgacatgacgtcgctgtgcccgcagaccatcgagaaggcgatgagggtgctcggctgctacggcatcgagaacaagaacctgatcctgacgcggttcctgctgcactacctccgcgccgccacgcgcaggccggcgctgtgcagggagggcggcggcggactcgccggactcgccgacacggccgtgcacggcgtggcgctcgtcggcggcaccgcgttctcgtgccggggcctcttctgggtgctccggatcgtgtcggccgtggggctgagcaaggagtgcaggcacaaactggagaggctcatggggctgatgctggaccaggccacgctcgacgacctcctcgtctccggcgacgacggtggcgtgtacgacgtgaacctggtcatgcggctggtcagggtgttcgtcggctccgaggaggaggccgacttgccgtcgcagaggatgaggaaggttggaaggctggtcgacaagtacctcggtgagatctcgccggaccatggcctgagggtgtccaagttcctcgccgtcgccgagagcctgccggactcggctcgggaatgctacgacggcgtgtacagggcattggatatctaccttgaggtaattaaagagatcaccttctatgaaatctatatttcatatttttcagcaaaaaaaaatgttattttcggtggtagtgtttggctcagtgaacaaaatatatgttaatttcgtcctaatagtaatacctgtttatgaataataggatagtactacctctgtttcaattcatgattgggaacatgattgataggctgttcaaaaagcttgatgctattgagtggctaattataggggcagtaccagtctagtcttttctcctatcttaatgaaattggccggccatcctttggccgtcccggcaaaaaaaaaagtaccagtctagtcttggattagtaggagcagtggtaaaattctttgcctgccaaggtaaagtttaccgttgtgcatgggacaagacggcattttggtcgtctagtaagcatccagattttacattttggaaaattcgacgtgaatcctgtatttctctgtacccccttagctggattttgaggtttacttgttctgctctgagcttctgacttcgtgaatgattgatcatgactgggtagaaacagacttgtaggtagtttagggcaccgggaatttcacctgacactgacagtgaataggagcattctctcacgctatgattggagccatgatgagttcctggaggtggcaataggcagttagaatgttgataaacactggcaagaactgtgataggaaggttaatagttggagagatattaggtagtagtctggtagtacgcttttgctgtacctgaaggtcaccttcgtaatggctatgatttcaacatttacatttttgtcagttctgtcttcaatacagcttctttgattggaacttctgtcatggatataccattcctccaggactctgcatatctttccaatctttctttgcaacaactttgtttcgaactgtttttttcttagccactgcataattcctgtgtgttggcctgttcttgcctggtcttttacaaaggactgaataaagtttgatagtactatcatgggacgctaatgatggacagagagatcgcctagtactttgtgttatgggtagaacaattcatttgtccaatttccataattccattgcctttaacccttttgcactgtgcagtgtgagcttttcgttcgtcagatctgaaaccttgtcacttggccaccatacattcctctgtcctaccagtcctatccactgaagtctgatcccatttcaacaaaaatgctaactttaagttgtttcaaaatcataagttgataatttcaacttactgaaactcgctatgtcttgatcacatacttacctcaggaatccatgcagcatttctgcacttctgcatcacatttttttttctgtggactgtggtcctttgtttcttcacagttgcagagttggcaacccttggatagatacaactgcttttttctgacatagtcgttcaagctttatttgcatgcatgcagacgtaaactttaacctttttccctgtctgcgtttcacttttgatccatgacactgtcgttagcccatcacattggtgaccatttcgtcttggccaaccgatcatttttgcaactgagatctcgccaatttgtttatcagcaatgaaacctagggaggctttaacaagtgcccggtctgcccagattttgcctttatcctggcttcggtgctttctatgtgcaaatggcctttctttaatcctctcctacatgtttgtgcttcctgtttcccatcgcatccactgcctttctctcaagcgtggtaaagcgcgcgcaaaaaggaactaaacaattctttaattctctctgcgatgtacttactttgtttcacaatgtaagtcattct

SEQ ID NO: 46570 - DNA, 9609 bp, Oryza sativa
tgctagaatgacttacattgtgaaacggagggagtagttctcttcttttcgtgctgctccttgacactatctaatgtgattagctgcatgcatgattgggcctaattaattgtgctacaattaacagcgagtaccattgatcaaggcattagtttgctgatgaaactttgctgaattttctgcaaattaaataactaggctgcaagagagtgttgctgaatgctgatgaaacttagctgaactttgtgcaaatttgactgaagtttattctatgtctgcatgcagtctcacccgacgctgaccatcgaggagcggacgacgctatgccggtgcctcaactacgagaagctgacgctggaggcgtgcaaggacctggccaagaaccggaggatcccgccggggatcgccgtgcaggcgctagcctcgcagcagtccaagctccagatcagacccgccgccgccgcggcgaagggcaccggcggctgcaggcctgacccgtcgcagacgccgaggaagatcatcgtcagcggcagccgcgcccggagcgtggacctggacgccatggacgagaaggagctgctcaagctgaacctgcagaagatgcagaatcgggtggtggagctggagagagcgtgcaaggagatgcgagggcagatgtccaagatggccaagggcggcaggccgtcgtcgtcgttcggcgccgccgcctgccatcaaaccggcggtagaggcttgcctaggctgtgctaatgatggatcaagcagtaatacgtcttcttcttctttgaattcttctttttgttggtcaagatttgccaccacatcacataggggcatttaactacatagctcgccttaatttttcacctgtaaattaagttgatgatctactgcattgattgggctctcccttttgttttttcgttttgtgtcttgcgttggcggtgtgagtaagatagatgaagatgagcaagattgacaggggatgtaaatttcttttttcaccattgtccctttgctgcatgctttctttcttctgttcttttgctgtaactttaaggtgatttggtccataattacagtgcagcttttggacgtactacctactactagtaccatttggtctcagttttttttacttctgccgttcgttttgggatacgcaccaatctgcagttctctctcttcagaggtggtgtagccgtgtaccagcaactcagcaaggaggtttcaggtacctttgcctcagccactggcaacaaggggcctgccaaataattttgattctgatccagtatgaggttctaattttgcttttgcacatgcaactatgcaaggatagttgtaccttgtgctgcaaaaagaggatgggcaacacatctcacggaaaatataattttatttatttcagacaatattatgatatgttttcttctgtccatagcgaagtaccggcattcagctagtattacacataaaaatgtaattaactcatctacactattgttaaagggaacatcaacattgcaagcttagttgctatgctaagttaaagagaattactagtttttttaggtatcaatagcataactcttgctattattcttgaaagggaagagctaatactaacgtagacaaagtgaaaaccaagttcagacatctttcatgcaaaatgtaccgatctaaaagtctaaacactgctccttttgggatcagggcatggtataattccccagttcctcctcacttcatccaaatcttcatgaaaatgcttctcatagtacacagacataagatctgtgcacttaagacctgcttttgaagcccatgggaaataatgctgaaaaaacagtgtcctttgtttctcattgaacctcgcagagcccccaacgactgaaagcatgcacattggaaggaacatctgttcaaactcaatgaccttaagggcagtctctccaatcaggttcgtaggaaggccgaacagcacatgccaaaagtcatggacttcacgggcgcgggtcgcaacatacgcaagctcatctgtatccatgaaacggacaggtgggcggtcatccggtgagaagttccttgatcccatgaactgagcatatgctgcaccaaatgtgttctgaggcatgtcccaggcatgagaaacttgtgtggatataactcgaggacgctccaggagaacatcctgtaggaatagtatcttagttaagtcaattgggaaagaagtccacagtgttgagtacacattttcagctggcatgtgttgctattgcatggcagtgatgtaacaagaaggaaaaaatcatcaaagtatagcaattgcaggtttaaatttattgaatgggtaagtctagactgcagccaaacaaggaagatattttggagagttaaatgcataaataacaaatgaacaacaaaaaaaatggacagcttatgaaaagacctacactattccatttttcagtataacattgctccctgaaacaaccaagtaaaaaggataatgctacttcacacaaaaaaatctacttcgtagtattggtgtataatcatcatatgctccttagcatttgttggcagagaaattgttactgtttcagaagctgagtatatatgtatactatttacagaatatgctagtaataaaggctatatataaagagatggtcaagcacaacaaatggatgcatcgacataacgtcctgcacttttaggggatatagggtagcatgagtttaccctgccttcagcactgttcctcatccgctgaagcacacgctgaaatgctggcttcccagtagtctccccaagagcagctatcagatcagctcttctagggtcaagcaaggccccaaatgcagaaccgaatgcaacagcagcctgttgccaccccttcagattaacacgcgccccctgcatgactctacaaaccaaaaagaaatcagaaagaacaatgaaccattaagccacttgcattcttgttcaatactttgtatggtaaaaatcattatacgacattcaccagtaatctaatgatccaatgatcctatcgcatgcaaatcgatggtgataggtacattagcaaaggggaacaaatcgtgcgaataaatgtatagatatattggcgtggaaagatgcttttatcaggcatttcatcgaacagctagagagcatcactcctaacaggctaacaccagcgagtcaacacagaaagatgtgcaagaatcgcctaaatcgattagcaccgatagttgcaacatactagcaggcgacaaacaaatcaagcagatcaacaaactagcaggtgacagaaaaatcaagaaaatttgggaacactgtcgaggcttcgttgcgacctagagttgaaggggatctgcacacgcgtacctcgccgtcgagcgctccccctcgacgcttggtcgcgcctctgaacgtgagggagatcagagatgggtcgtcgctgcctccgagctgatccgcgtcacgtggtcctagccgtcgccgtcgccgccgccgccgacgacgactcaccgagctgggttcgccgccgctcccttccgcgatagccacaggtccgaaactctgaatggctaggtattgggcctagttgcagtataatgggccgagccttcatgggccgcacatcctccctaaccgtatttaggcccactaaagttgggctcgctagagacaggctttcgtaaggcccaccaaaaacatgggtcggtattgagatcagaatatccggtttggctcgtggacccggaaaatgtccgcggaaatttgcaaagaaaccctttaaaaaacgtattattactttactccacctccgtgtccccccgcctcatcagagttcgtcggcggcgatggcggcagcggctgcaaccgccttctcctgctccttcgcctccccgcgccaccgccggagtcccacgacggcgagagcttcgggggcggcggtggagattcgggtctgcaccaaccgcacgtgcgcgcgccagggcgggcgcgaggtcctggcggcgctcgaggggctcgcgccgccgcgcgtcgacgtggcctcctgcggttgcctcggccgctgcggggcgggcccaaacttcggcgcctccgtctccggcggcggcgccgcggtgttcggccacgtgggcaccgccgcgcgcgccgcgcagctcctggagcacctgctcggcgactccggattcgacgcggcggcggggctcgccgcgctcgcggcgcgtgagaaggcggaggccgccctcgagaagggtggcgccgccgaagcggaagccctcctgactgaggtctctgcagaggattcaccccattcttaccaagcaaagtgtgcttgccaatttgttttttcttttctcttgaaaatggcgtcaaggaagctgcatctcccgtgctacaggtactatcatgtagtgttcctgttccaatttctaacttgttgcttgcttgtatgcactgcaggctatcgagatgaatgctggtggcggtctccacttggcgtacagaagcaggtcctttctgtagctttgattatgagaacgagtgtttgggattgggagtatgtgtgatagcttaatttttcacaatttatgtttttctcttaggaaatgctgccttcgttgcactattgggaagtgagaatgagagtttgcgttaactgaaatgaatgcttgatgctaagtgcaggtctagggctagattgtcaatggggaatatcactggtgcgcttgctgatgccgaggaagcaacaaagattgctccgaaatttcctcaggtaaacacctgccctgtaaattgaatttatcatcttcttgttactactcgtccacagccaagccatactgttgattgctacaatacaaatattttttttccttatcacattggtgtttcttaacttgtttgctgcggactgttgtgtatgccacaaacatttgcaaatgcatacagattacctacctggctacctagtagtttatgcagagaggaaaggttgctacaatgatcaataaaaccaaacagtatggctgggcatgattgccaaactaaatagtagtgaacagtgattgcagaatttagatcattggatggcatgacagtgaaatgcttaattttcaattcaacggggcacaagtgccctcagccttcatatggaccaatggggcacaaagcgcctccccgctgccgttacttcatgtggctcgtggctcatcgtcgttgctggactgcagatcgacggaggccccgaggattgccccacccggcgaggtgtgtgctttgtgaccaacaagaagaaacaatagaccacatcctgatttcctgcccggaatccgcgcaattctggtggattgtaatgaataccattgggcgtccggacctcttccccgcctctcagaattccttcatctcttggtggtcggcatccaggaagggagtggcaaagcaactccgccgtggtttcgatacagtggtggtcctaggcgcttggtccatatggaaagaaaggaacaatagggtcttcaaccagaagcagcgatcgtgggaggaggttgctagggcagcagcagaggaggccgccctctggagactagcaggtcttctcccatagtagatcatggctgtcgtggtcgcaaaattgatgtcacgagattatagcttagcctccttttcttacctttctttttcggtttctatttcagttgctttgtaaagatgtcacaatttctccccaatcttaataaaaaagatgcgcagctcttttgcgcattctcaaaaaaaagatgacgggcgatagcaagtatagttctattgatttatatgtctctgacatatagcttacgttcgcacatggtgttcaatgaaattcacttgtataatgtagatggagcctccccctgcctaacagaaagtctgaaacaccataacgttctattctatgcactgataaaatggagtttcttagagagccagtctttaaattcactatctgtttttttttttccatgggcctatttgtcatggctgtgctgctctatgcaggctcacttgtcacgaggcgatgctctgtttgcaatggaagagtaccgagctgcagaggatgcttatgctgatgccctggaccttgatccatccattcgccggaccaagtcgttcagggttagtgttttctgtgtctgtatcacacgcacggcaattgtaacactgtgaactctccattttgacacactcaaccccccctgtttcaggctcgtgtacaaaagctacgggagaaggttgccaatgctgatgtttcatcatcatcatagtccatccaaataggaggaagtttcacacggcaagaaatgtatatctgacgggcggatgggaaaattctgaatagtgaatagtttagtgaaacaatggaaatattcctgtctagttagttttactcattctatatggaggccgggaaaatgctcttccatcatctttaaagaaaagtccttaatcattcttagcagtgtacagtgtgtattaggtcctgtgtggagagtttaagattctgagaatctgttggttgataaccagcttccgaaaatccgagttttcatcttctggtttctagatcattttattgattttataacttcatattcttataatctgagtgacagtctacattatttgaagagctggagattatgcgagaagctacggctgctaaaaactttcccaaatagaccctcaaactgtcatacataataactatgcatacgactcccgtacaagtgtacaaccacaagttcataactagctctgaaaaatctggactcacatgaaggtaatccaagctacgtgattagtctgatgatgaggtaagacgtacgctagtcgctagtcgtatgtatgagttactcgtacgtataacacttctcaccagtatatattgtattgtctctttttcgctatcatatgtcattgatttttcgttgaagacgtcgtccaatttccaacggtgcgcgtgaggcaaactagaacgggccgcacgctgcacgtgggccggagtcccgttccggcctactaattcggccccgcactaaggcccaaccatcgtatagcttccgccagaagcttttcacacgcaaaacacactccctccatctctcgccgccggccgccgcgcgatttggggagcagctccccgccggaggctgccgcttctcgccgcgagtctctccagccgcgaggtgcgggtgagctctactggagtttggggacatctccggggcggagccggagccggagaaggaggctctcgatcgggcagcagcgcgtaatgtacggattccccccctcccctttcaccccgagttttctctatctatgcgtgtatgctcgtgcttagcttgcgtacggatgcgcgtgcggttttttctagggtaacgaattcgacaactcgtgagctttcggtaaccgctcagacttttgggtttggtacattgacatggagattggaagatggcatttcgtgtcccatttgttaaggctctgattccattggtttgtagcgcgcctcaactctcaagctcagtgttgctggtcttgtacgcctcaagttcatctgtgtggtttggcgtgcatctgtttactgttttgtatgtattggttgatgaattcatcgtttcgaaaaccacatgatatatagttcagcgtttatgtatccttttcaaggattttacaggagttgagcacgtagcagtgtctagttatatcaggaggattcaccagaatagagatttctgtagtcctcaaacatttctttcgaatcccgtatgttattttaaatctacctgagactgctaatgtttgattttctttatggtgttctatacggagtttcatttcagaaatagatatcaaacacccctgatactcttagcgcagtaaaatattcttccatacgaatgatgatgtactctaccagcatatgggcggttgttcctgttaggctctctcagagctcttccaggattccatcatgattttgttcttgactattttattcactaatgcatgcaccatttcaattttccttgtaaacccattagcttcccgaaaatattgttattttctttgtacctcccttaaatatgaacaggaaatcatcattttggtgagctatacagcttgaatccccttaatgcgaaaggtatgaaatatctaatggagaacattgatgaaaactcactcattcttcttctgattattatttatactattcaatgttatcttcttcctttttttttgttcatggacaaattatacacttaaccacagcttttaagcttacacatactctcttagattttattcataattgaataaactgcttaataattcccagagggtgatatctcaaaaaagggatgatatgatgtttcaccagttcccgaatgaatcagaaacttgcatattatcatatcctgccagttacatttgagtttcacccgaaggactgcattctgtatatattgtagactgatttcctgttcaaggtttattttataatgattggagcaaacccatcaaccaagacggatagggtcaagtttctgttactttactttttttttttgaacgactcgcacgagacagtgcgaagttctattgatagagcaggaaaaaattacaagattacaaccctagagggtcgtaaacaggaaaaaggaaaaaataccaccacccacacaccgacatcgccaacacacaagcccaggagaaggctagcatcggaccggccgccgctaagcgtgaccggctgccactagaccaacaaagggacaaccgagattgccccctaggggatgccaaaacgacgtcttcaagaagagaagcgacagaaaaactgccaccgccgtccgtcgaaactcaaaggagccaagactgagctttcgtccggcaatcacccttgaggggtaagatccacagctgacacaccgatgctccaccaccacacaagctctaccgacatgtgggacccctgcaccggcgtccctcgccggccagccttcgtgcgccgaagaccgcgctacacccaccagcagctcctcctcacacctaagtcgcctccttcaccgccggccgcgcctctcgcgccaagccggcctctaactccgccgcccgcgcctctcgcactagccggcctccactgccatcggctgcgcctctttgcgccaagccggtctccgacctttccaccagacgatgctgcgccggccaaatgcagccgtctcccacgccctcggctagccgtccaaggccgccatgcctctggtgaccgctgtcgcgaccaccagccaccgtctccgcgagccaccgccactgctagcggccacttcactgttgccctccgccacgccgccgccaagtcctccgccggcgtcgtcggccgacgtcgccgccgccaactgccgcaaccacccgtcgccgccgttgccaactgccgtcaccagctgtcgcaagtcgaccgccgtcgccgaccaccacagccgaccaccctctaaatccggtcgagaggcgcggatctggggaggcaccgccgtcatc

SEQ ID NO: 46571 - DNA, 14116 bp, Oryza sativa
tccagcgaggaggttgccagattcggtgacgtccgcgccgccggacccgccctgtccctgctgccagctccacccccgtcctgtcgccaccgtcgccagcgcctcctccgccccgtcggccgccgccagcgccgcctcgtccgccccgtcgccgccgccgcctcgtccgccccgtcgccgccaccttctctgccccgccgccgtcgcctccccagccccggatctggccgcctccgccgccacgggcgccgggatgccccgccgccgccgtccttgcgcccggccggctttccggtgggccactcgggcggcggcgaggcgaaggggagggggaaggcgcggcggcggccggcgcgtgtgggggcgctcgcatcgcccctggggctggagcgacacgagcctatgtggggaactttcgccccagtgttcaacgtttctgttactttacactatcatgaccaattcatttgcatgataggtcacagaatgacggttgctgcagtcaaccaaagactttatggattgatggttctgtttcaccgtaacgtttgtcagttgaaactgagcctgagtgaagcggatatttgtatcaggattcagggagatcctaccatcttatttcttttgaagatgctaactgcatatcacaatttcaacaatgaggtaatttagttagctaaatattctatggaggattttttttttttttggaaaagttgttgaacatattacatatctacctctttcttttcgtctgtgtattccagagttctagatgaactcgtttgaaagctaacaactaatgggaaaatgacagggcttgatggcttgagtagaaatttcagtggatggcaatgctccacacttctacatgtcaaaaatcaaaacatttccttctgttattggatgtaattaactaccttgctgacatgttcatcatttcatccctttgggttcctaacaaacagatgccatgcaaggtaagcatacgtttcatgcattaacctcacaaatgcttaaattgtcgatatcattaatcacaactttcctctcaatcagtactgatatgctaagagaaataactcaatctgtggtttatgtaccctttttcaatatcttttgaaatccatttacattttacggtctgcgtacattcttcttctgaagttagtgacaaagagtgaaagaggtgcccattggagaggtactacctctgttatcaaaaggatgacatcctagagaacacattcaaatctcgatatgataatcattaaaaattaaaaaaaaaggttaagatgtgaaaatgacattgatagatttgtcatgaaaaacacattcacatggttatatttttaataagttttatacatatataactagaaaaagtaatgatgagagtatgagacatatacattggagattgtgtcaatgtccaaaacgacaagtaaaaaagaacataggtagtaatattttagcatgtgtttgattgtgctttattaaatagactcctttcttgtgttgtgtacttctctctcttacatatgttgcttgtgtacctgtaaagtgggacttgaatatggttttagcctttggtagttattttgtatagcggcagctttttttaatctcaagtgtgcactccaataatcaaagaaggtgcttttgagtgttacaaaaattttaatgggtgccttgtccgttgaactaaagaaaacatatcatgatattcagaccatggttcagaacttagtttcctcagcttatttactgtatatttgctagcagttgcaagctcatcctatggaactcgagtttggtagcatctgattgagctggaagaggcattcactttttttgtgttgactggttttgtggaagcacaaacttactgctatttcctcattgagtagctttgctgttttccacctacagtaagtattttctttttattgtccttgtcgtttttaagctcaggtattgaccgacagctcacattttcctaccttctgtttgctattattttgatattgacagaacaatggttggtttgtaagttgagaaatgtgtgccagttaatcagacatttctctgaattctgaacatacacaatggaaagaggcaacaagtaaaatgactaaaataatgtatgattgggccatcacttatgaactaacacatttattagatttagtagccaagcatttcccaataacagtcatcactgtttttattttccaagacttaatttatgttagatacattacatttggcatgctacttccttttatctttcttttttttttggtaaaccatggtgttttctcccttttttttgtcaaggaagataagtttgttcttatcttatgtctgagtttcaaccaccatggactccatgtgtgccctacctaatcaaaacagatcgtttgctcccctattttgcgggaagttcaggtatttttgtcgcctgagtgggttcacatatgacccacaacgctgaagtctgaatttgcaattccggtcttcagagctgaccgggccaatccggcaacagctttccaccttgctgaaattccacaccagattagcgatagggaagatgctttctttcgtgccacaacagattactcttaaagtttgatattgtggggccaccacctggattggtttgagcacatgcaagatgataagaacattcctagcatactctacctaattaaaaaaattgaaaaaacaggaaatattagctgtgttgattgtgatgtttagctgatttgcttcctgtgtgatacagtgtgtggaaggagaactcttttagtttatatggatagctttgttgatctggtactccttcattgtgtgccaacattgatctggcaaataaataaataccatatcctgtcctagacattctattgcctatgacgcactaatgcaaggttttctgaaaatgctcatatcatttatcacactaaatcccccgtgtttttcagtcatatgttacagttgtagacaggacttatgagttgccacatagtcatggctcatgagatcattttaagcacatcaaagcatcaaagtggaacgagaaccaaatgtgtgtgctgatctgcaggttcttttttcatacttctaaagttctaattttgattttatcttcttctttcactctgagtaatacattgttttttctcctcaagtatcaaggcatatgttacatgcaaaatgcctcttttttttctatttgctatatactccggtgttaaataggcatttatttattttcatatttaggtccagaaacgttgaattcacaattttcctagcttgccagtttgctagtttatactttatgtatgccaatctttagagtttccctagtttgccagattgctatagtttatactttatgtatgccaaactttaggaatttccctagcttgccagattgctatagtttatactttatacaagccaaactttggaattttcactagcttgctagatcgctatagtttatactttatgtatgccaaactttagatgtacctatcccacttgtacatcattcttttcaagatcaacggggccaagtcggccatctgaacctacaatacacgtcaattcaaaagggtctgcgtcaacggctccttaatttcaggtttataaagtttttcaaattaccattatcgctcattatccatatgttgtgtgcagatcaagttttcagcaggtcaaagtcgatggcccgaacctggttttcaaaaaacagccaatgggcgaagaataaaacgggcgcccacgtttctctcctaccgtttcggatgcgtggagccaaagcgaagctagggtggtggcaactgtagcactggaccccgtctcatggtaaatttttcttcgccatcacctgttgctgttgctgttgccacccccaacgagtctatcaggacacaggagaggtatcaggaggtatggcctttgctacttctgctaatctgatgatgtcggtattgcattgcatatgatacagaagtgaagtgtgctgtttgtagcgttgcgtcatgcagaatgggggcgtaacagaacatgggaacatacccattacacgtgtgcgcgacaccctcaaagacggggtggttcgttgcacgggtaaaatatctgtatcttccctgcaagtgatgtacggtttgttgtgtggcatccacggtaagtaaagtaaaatggctcggcaaaaatcagaaaatgacgtggtatgggcacagacacacaccccaaagaaaaatcacgataaaatgggcgtgctgttcacgctggactcgtcataacctaggctaggctactttgtgattcgatcagcttttgggtgtgtgtttagttcacgacaaaactaaaggtttgattgaaattgtaacgatgtgacggaaaagttgaaagtttgtacgtgtagacaagttatgatgtgatagaaaagttgaaagtttgaagaaaaagttaggaactaaaccacatttgcctggcattggaatcgatttgatcaaatgtcataaagatgatttttgtaactgtttcctatgaaattttcgttacgactttaatcgcagaagcacattctagtagaacttgcatatcggaggagattttttttttctttgatcaatatgtacccagagaaaatattatggccccatccttacctattagcccgtacattttcttgtttataagcctagctgatcgagtcggcacatatgccatctgacagtaacttactagtccagtgtgaactgcagaagagtgcaagccttgcacttgtagttgtacgatgatgtaggatgcgatgtcaccagtggaaacgcgcggccctgcacggagcttgagtgcctggagattgtaagatcaaatgtcataaagatgaaagctctattagtgggggtaataagccagtgatcccagtctagttattaatgcccttaatggtacgataaggaaaaaaaatatctttaaggtttagccaaacgttccagtatgttctgctcgtatatctttagcccgcaaggtaggagaagaaattattacgtgtatgtgttcattccagtctgccaagtacctacggtgtgctgttgtgcaattacaagatcgctaaaacaagaagggaaaaaaaagaatcgatcccaatgttcagaaagaaaacgtcatgccaaggtaaaaagtagatgacgccacgcgcatactcgaagtaaaagtatatatatgtggtggattgcgcatacttgaagtaaaagtatatatatgtggtggattaccgataatctcgattaagtccagtattaaaatggacaagtagagagctaaccctaattagattctgaattttctttttcccctctcgatcgataccaaaaggagagacgagagggacacatgtcgtctgcagtactgcgttatctcaattgagacgagagaggcgtggaggagtgaaaaggcgaattcttattcagaagtgtttccgatacgcgtcttacgcggcgggcccacgctgccgccctcccatcatcttcacagccgagagagagagagaggccatctcccccttcccggaaacgcattcttgccggggacaaaagcctcacgtcccgtcaccttcaccttcgccaccgttcacaccccccgcgacgccaccgccacctttatatccttctccccgccacatcctcgctcctcgtctccgccgcgagcttcacctgaatccgatccgatcacccttagcaacccagatgttcctcaccgacaagtaccacgcgcttctccctttccacgccagcggcggcggcgtgaaggatcaccggcggaggccgggcaaggcggtgcccggggcggcgggtggtggtcccgggtccgcccggttcggcgccgcgctgtccgcgaggctcgggagtttgctgccgctgccggcgtcgccgttggctgcgttggcgcggctcgcggatctcctcgcgcttgccctcgctgacgctgttcccgcgttggctggtgagggggacgcggccgccgtcgccgcgcacctcgacgccggggtcgcgctgctcgacgcctgcaacgggatcaccgcgcgcctcgaccggctccgccgccgccgcctgctgtcccggttcgcgctccacctcctctcgtcgtcgtcaccaccgctgccttcctcggtccgccgcgcgcgcgccgcgctcgccgaccgtgacgagcgggccccggcgtcgcctcccccgccgctcccttctctcccgttcgaccagccccgcgaccgcgtctccggcgccgcgaccgtcctcctcgccgtcgacgccgtctcctcgctcgcagcggcggccgcgtccgccgtcctctgcggcgacgccctccaccagatcgccttccccctggtctccggcgaattcccgtggaccgaggccttcaacgccgtgtccatccagctcgccgccctcgccaccaaacccagcgaggtggacgccgtcgacgaggccgtcggcaagctcaaatccgtgctcgacaacggcgacggcgacctcgacgaggcggcgctgcgggcggcggtgcaggaggtggagaggcggacggaggagctgacggcgccgttggaccggctgtccgacgccgtcaacggcgtgttccgggcggcgctgtgcctccgcaacgcggagctcgggagcatcatggtgggacccgccgaaaagacgccgtgtaaatagccgtttccaccgtgtgtcgtccgtagccatactggtatgtcactgtataaatacaagtataattctggaagtagtacagttctacaggtacagggcaacatggggtggtgtctcagccaaatgcagtggtttggtgctttttctaccagctgttactactatctgtgtgtcaaggttgccacatatgagaacacagtgcaattcgcacccttttgcagatgtggaatccagtaaaaacttgggaaaaccgtggcaactgttcacctacctatgtaattttgcggcttcatacatactgtatgtataccatgaggaactttgtgaagaaaatctctcttaccgacttcaccagttgaaacagacacattaatgaaacaatcagcttattatggctcagattttttttttttggcgagcgaaatgaaacaaaacattaatgcacgaataattaagtattatctttgttgtaaaatataataacatttgattatctaggtagacaaacccttgtatagagccggatgtgttaatgtattactccttccgtcccataatataagagattttaaggtttagcttgcactgtttgacttctcgtcttatttaaaaaaatttagaattattttttgtcacttactttattatctaaagtattttaagcacaactttttgttttttatatttgcacaaattttttgaataagacaagtggtcaaaagatgtaaaaaaaactcaaaatctcttatattataggatggagggagtacaaacttgaaattttagattcatttatttttctaaaaaaaacttttatataaaaagtattttgtataaatcgcatcatttaatactttagaagatgtggttacgatgaatgggggaatcatagctagggagtagcttagccgagccgtacaaacaaccagcgtgagagaacgagcaacctggcaccaacggcgatcgaaccgcggccgcacgtacggcgaaaatgtcagcggcgcggcccgcatgggccaccacggcgtgggcgcgagccgcgaggttggcttgccgagaggcgcaaggaggcgctggccttggcgacgacgatgacgacgaggacgccgtggcgcactcaaccgcgcaggcgatcgaggtcaagcaccacccgcccacgcccacgcgcgcgcacgcacagtacagtagtcgcgcacacatcgcccatgtgtgcggtggtcggagccgtcacgcaagcgatctcgcgggcacgcacatgcggcgcggggcacacaggtttgccgtcgcggcaagcggaagaaggtcgcgccggggcagggtcaggtgaaggtcaggtcggccgctgctgtcgcggtagcccgcccggccccgacagagcacggcgcttgccgatacacttccgctactcccgatggggacgccatgctttgtccttggtgtcaccacactgtccctccttggtgcgagatagggtaggagtactacaatacgggagtcgcgtgcttgctcggattctcgaacgtactagggctacagtatctttttacacgcatccggtgccagcgaggagggctcggtgcatctcacaccgttggatccgatacgatcgtactgcctgccaggctgccactggccagtgcatcgtctacatacaacggctgtgtacgggctccatctcaaaatacaacaatataagattagatgagacatttcctagtcctatagctcgtccatatttatggtactaagaattatctcatctgattttatattcttatattttaggatggagggagtagtagttcttcagaatgtgtttgttttagctttctccagaagccgggtaatcaatatttagcctgttataaaaaagaaaactagttcttgttcgctttgctctgcgttctgcactgggccgttggctagtagggccgcaacttccactacaacaattaggcccaggatacgcccatcagctcagagcctgagaagtgagaaccaagttagcagttggcagttgattggcacgtcggtcaaacgaggcaaccaatcgccgagtcatactagacatgcaagaatgcaagattgcagctacgccaatgcggcccacgtagtcgcaatctccactattccctccctggctgaagactccaaaaccgccgccgcctcctcctcctgggacctgggctcctggcttgccgctcgaccatccgcgctctttacctgctattaattcgctctccgccctctgcattgcaccatctcgcgatcggtaatgacgacgacgaaccacctcgtctcccccgcgctgctgctgcttctcgccctcctcggcgcatcggtccggcgtgccggcgccaccaccttcgaggtcggtggggaacacggctgggccgtgccgccggccaaagacgccggcgtgtacaacgactgggcgtccaagaaccgcttcctcgtcggcgacagcgtccgtaagatcactcgatcgatcgatcaatctccatttcgaataattctgtcggcaatgaacagggaaagtgatttcatctctagaggggatattcatcgtttcgtgcatgccacctaaatagtcatcgaaaaatttaaaaaattttgacaaaatatattaatatgaaatatattacatcataaacatttaagtttaaattcaacttctaccggttgtaataaaaataacaagtacgcgacattgatttgcatttgatgcagatttcaagtacgcgaaggactcggtgatggtagtgacggaagacgactacaacaagtgcaaggcggagcacccgatcttcttctccaacaacggcgacacggaggtggggctggaccggcagggcctcttctacttcatcagcggcgtcgccggccactgcgagcgtgggcagaggatggtcatcaaggtcatcggccacgacgcgcctccgccggccagcccgccgccgccgccgtcgaacgctccccctacaccgcctcaccccagcggcgccgcctccgcgctaggcgccggcggactcgccgtcgcggccatgctgctgccggtcttcgtgtacggtgtctgatggtcaccgtagctgcatgcacctgcgtgcatgcccgatcgaattgatatcgtcttgtagattgtcaggtctttgcgagtgttatgcttagtgatttttgacgtgctcgttcattgcaatctcgtgtaattcttacttagattttttttttgtatttggaattgactttggataatttatttgtgactttgctgaatgttgcatcccaaaccttcagtttgcactcgcatttttctcccgtggaaaaccgcgcctctcgttgattaaactataaactataaaccatctttagcggaccatcctttgtattgaactctttgcgatattataaaaataataatttggaaaattacaattattcgattgaactatcactttgctataacttcgacgtggtattttacaaaaccaaaacaacaaatggtttttatcaaagaaatataactctatctactatgtgaatgatatataggtctgacttcaaaaaaaataacatgagggatatatatgtggagtcaaatttgttagacaaatcttaactaaaagattcggatttttcctttcgtcaccaatttgtcgtccgtacgctttttcgtccgtacgcgcagtttacacagatccgatttttcgtccgtacgcgcttttgtgtgtgatcattgcccagtaggccacatctgtccacaggcccacaagcaagcccgggtccaagcgacaagcccataaagcctaacccacaagtccaggtgcaccacaagcccacaaggccacaaaccgcaagtcctccgttttccttttcttctgttatttctaccgctattttttagcgctcacactaacacgattttacagatttctctcgcaggggaaaaatacacatacacgaatacaatcacaggcaagacatacatatagaaataatagaaacacacaagaaaatacaaaaatacaaatcacgaggctcttcctcgggggtcaagccacttccacgttatcattaaactgaaccctgaatgcagttacaattccattaggtttatatataactcaagaaattctaatgcagttacaattccattaggtttatatataactcaagaatttctaatgcagttctactccattacggtaacacattgaggtaacaaaattaatatgagatcatatcatagtagcatgaaattaatgatttgatttaatctgcaatttttgaaccaccgtgtcatattgattggaaaattcacagtaacaccttgaggtaataaaattcacagtacttgaatgtttgcaaatatcaatatgaacagtatcatttatcatttagaggttgagtttcctactttagctgttaagcttcaagactaaattcaaactactgaaaactaaccaattcaattaagattggtaatttcatgacaaaaaccttaccaatttccgaccagcggcggtgaaaacatgaacccagtttctcctccactcccgaagttggaaaatagatttctacaggaattgacatagaaaaatgagtagtttagatacttctggtaatccatagagccagacatgataatttttagctgattaaccttcaaggctaaattcagagaatatgaaaagtaaccaattcaataaataatcaaacacaaatccataacaatagctgcccagtatcatgagaacatccctcaacacgggaatcgaatgcatgatctattgtataaccctgacagcaaaatcatagtagaattcttagtcaatttgaacacttgccttagtgctcattataactaatataatcgacaccatacaattatcatacgaatataatctgaattaattggatttttctgaattgttgagcaccaaaccggttttgttgggcgtcctaagattttggagatcaagctagcagcaatggtctcatttatcaagatgatcaactggtaattaataatggcatttgtagtcacaagatgtatcattgcattttaagggggcaaaaaaaaaaggaaaacaagcagttcagtccaggaattaagctgcctgacaaattttctcacttacagactagcatatgtatatgtatgtttagaatttcagaatggaaataattccattcttttgttcactatagtatttatcgactagattcttgcactaggaagctacatgataacataatcataaaaacacaatttgccctcctacttaagaaatactactaaaattttagtagtaaattctggaacattgctatcgtccacgagccccaccgagaagaacgcatcaagattcgaccaatatagagtaacaggacaagtttttaatgaatacacttctccacctagacatatgctcttggttgatccactcaaaccaaacaaatcaaataaactatttgtccaatctaattattctgacaaagaaaaacatagcaaagctcatatcagcttaaaaaaactcaccggttcagacacctcgactgcagcattcgagacaacctccgatgacatcaccactccatcctaaccaccatctctgcctcgaatccactcaacaatccgctcctcccctacaacatagagcagatggacagtgtgttacctaactaacatgttcccaacctcggactgatcaacatgttccagaatttactattttcacatacgcttgagtataatgattacaaaacatattattttgtcaaaacatgtgtgacctaatcaaggatgctgaaatactacacatttttcccaaattcaattcttcaagcaatatatgtctaaaagattaaaatatctgtataacagcttaatcaatcctgaagatgttggtctcacaaacaaagaacacaaattccgaaagaagaaaagtgaacatgaactactccacagacatgatatgctcaaattaatttttagaatcactgactttgtaacaagatatgaccttgtgtggcaactaatgaggtatattcagtataaaaacttcagatccatatagtttaaatgagttcaataatggttgaccaataattctagatgcgaaaaatggataaaaagtttgcatgtgaaaatagcagaacagctcctacaaagtctaagtaatcatacacaggtacacacaaacaggatcatcaaagagtttgtagtcctataatcctatattaaggacaaaactaaccccaatctatggcagccataggacttaagcacttagataaactgaatcagatatgctttacaggagaaaaaaatttactatgtttagatatctgataagtttacaccaatacccccaacaagcaaaaaaaaaaaacacccatccatatccctcggacccccacatgcacatacacagacaaaatcatgtctaaccgtgtaatcaaaaagctaggaaaatgttaatcaaccgagaacgcacctgaaatcatgaagaaacgcccactatcttcagtgccaccactcggctgcgctctcctcggtccaccttcgtctgcaagcttgaaccctcctctccggccggccggacagctagcggggagtccgttgagtgatggtgatggaacgagtggggatcgggggagctcaagagcaatgtacatcttcttggcgctatcggcggctttggtgatggagaccatgagacgcatacggtctcatcatggacatcggcacctcttgaaaccaattgccgtcgtcaccctaggggaggccgccgggtccgccctcccgtcgtcgctggcggcagatccgtgcgagaggggggcggagagacgacgagaatcgtgtgagaggggaagagatcgccggatccgcacctcccatcaccacccacgaaggatccgcgcgacagtggggaggagagacgacaggatccaagcgaggaggagtgaagccgcccacgggatccgtgcaggaggggaaggggtcgccggatccgcccctcccgtcgccgacgatggcggatctgcgcgagaaggaggcagagaaactatgggatccaggcgaggaggggtgaatccgtctcaatacggaaatgcactatcgaagaagctaaatgcaatagcaggtggtggcatggtggatctggttggcaacgacggctttgagcaggagtggctgctggcgatatatgaggaggtggagaaagacacaggaaaacagggagaaatagagagaacgagagagagagagagtggtgtgtaagtgtaacagctctcattttctctgacctcctcgagctatctagaaagtgagagctggcagctggtcaggttggtggtgtgcaacagctcatcacctcctc

SEQ ID NO: 46572 - DNA, 1826 bp, Oryza sativa
agattaccagaaaattccatttattttttattaaacttacctacttaaaaaatatcaatatttatgttcatcacataaatttccatccgtcgccttctgcgcaaacacaattgtaatgttcttccaaacgttcttccatcgctacaaccatccgaaccacatgtcagaggcatcatccacatccctgttgacagaaaacacgaggcctgggagatctgcttaactccagtacaggtccaaagctcgcattcgggtgtgctagcgtgccagttgatttgatcctgtaatcaacaagaaatagaagcaaagaaaccgcagttaaatctataaatgatagtcaatcggctaggtgccgatgacatatcaattatctttgagccgatgtcatatatgcatcgatcggcagtcattaataaataagaagggactaaatctactcgatcaactgcagatattaacaatatataatctttatatcgatatatacttaaattaagtgattgggatagatcggtcgctatgccgagacagtataaatcacttagatcgaaatatatattaataatgagactatatacgttcatagtataaccgatcagatagatctagcatgtatcggctaatactctgataccaccttatattaagatatcaaagcaagtagaatatactaaacaacagcctaacatacttaaatgcagcaagatcttaacgtaaagggcagatttaacatgtcaatcaagcatataggataaaaagtagttaaatcaagtaagatcggctgaaactccgatgctaccctaatcagcaaccgagaagtagtagagattgagattctaatcacgactcataagatcaaacttaactgatgcagctataagtatgaaaagaaggacaatatctagacaatcaagccgtcggatgtgtcatagagtggtagatatcctatataatctaagtcagcatcggtatttaacttaatcggctgccttctattgacggatgttagccgattgtaggttagatatcaatattgccagggattatgtaggatatatgataactcggcgaattacataaacaagattagagtgtcataaagatggaatcactaatcccgagaacgcaagccgtcataacaagttttacctcttgttgaagatcgaaaccgatgcagctcaactcgaaagcaataactcgtcgaaataaaactaaagcaaaaagggtggcgatgcgccaagattgtattgaacgtgtgttcttttagttacatagggctcggggtctatttatacccgagaattataagatatgtccataccggacacgactattatctctaacaaactctaagatatcataagtctttgcggcagacttttgccctaagcatatctctaaggaaattacgtaaaacatcctaattaatagatacaattgccttctcaggactctatccatgtgcggcaatcatcttgaagcatatatgttgtacaccaagtcgtattgccggaatcggctgtatcacctaacccagtctgattcagatttagtcgattttagtcgtagccgatctggactccagccgattcttactctgttcccgcaacaatccttatttccgactccgcttcgatcccatcttcacctccgacgctgatactaccaaattcggttgctaacaatcccgcacatgtagggaaaattaattgtctagaaacaaacacgacttcttagtcatcgaacatatctctgattcttatgattatggttgggtgctttaataaatcgttaaaatcctacttcaatcactctgcattacacag

SEQ ID NO: 46573 - DNA, 21560 bp, Oryza sativa
  unsure (1)..(21560): unsure at all n locations
nnnnnnnnnnnnnnnnnnnnnnnnnnnnnnnnnnnnnnnnattatgcaatcaataatgtttgtcttccttgaattatacataaaaaattcagacctaaatactattgaacaatttttgcctgaaaacaaatatcttaagtgctgcctgactttgaaatttctctgcacacatcaaatttttaaaatgtgttttttagaaagaaaaggtatagccacttttaaggaaataataattgtatacatgaaccagattacaaaagaaccaaagcaaatagtgtgcaatcattaggttacggtgacaattctgaattccactaagcgatcagtatcacaaaccctataaccaggatgttacaactgggatttgggatccagaaagcaagcagaaaataaatctagcgacaaaaaattacatagatgaccaattggggtcttggggaacaactatcctgacaaatttcgtacactagtaccattcatcatcagttataatcgtaccctcctctatcaagtagcatcggccaactggccaaggatatatttatatgcgggatccttgtagtgcagtttgtttaaatatcaattactcattggatggaaataatgtagtgcaggaagccaggaagttaaaaaccatttcacaaatagcatgcaatattaccaacggtctaatagatgccgctctggcccagatgtatcctgcccatttgcttcgagcatgttccttagttcagcagttgacacatgcttcttaagttcatccttcaatttccaaagtgtgtcactctgctctttaagcttttcttgaagatcagaagaattagcattggaatcatgtgatacaacagctttccctttatcttctgctgtgccttctgatatactcctgattatcttgggagctttgcagtcgtgtatatcattctgattattcttgcgcttggaacccttagaagatgtttgtccttgagaaacaacaatacaaaatatcaagtcagattacgaagtggcgcgaagaaaatttgatgcccatgtttcattacctgagctgggggcatctttcttaacaagatcaagaacagctcttttatcctcatgcgacaggatctcccagcctgagaaattctcaacagttgcagctggggacatctccagaaaacagctggcgtgataccaaccttgcccttcaagcttagatgaaacacgaacctagacaaacaaataataatactattacagaaacaacttagagtgaagacaaagaccatgtttttacattacaagttgccatatcacagttacaattcatatgttttcaaaacatacattattagctaagtgcatgactaatagtacttctggatcatcaaacattttcctgtatataattctccacggtaattattgtaattcattaggagtactcaactaggagtgtggatgaataagaaatatgaacataataaatactcttccaattaatacatttgcaggttacttcatttgataaagtaaacttaacacaaaattcagagttctaatgcttgctagtggcacgtagcagagtaactacaaaataaatgggaaactgtggcctttaggctttctggtcacttggaattccagtgcaaaagcttgggcattatatgcaacatgatgcaggccacagggaatagggtacagaaaagaacctatggtgtccctgcgtatcagaaccatacatttcccagatgcaagttcagaaaataaaagaacatgccaatggcatagtggtagggaagctatttaacctccccagctacaagtgttcaagtgctaggaccaagtcgggtatccatttcatccttagtgagcgctaaagttcatgttctaaataaataaagtatagaacaacaaagtaacatgcagaattttggacaatacagtatttttcccagggagtaactataaggaataggaaacatgttatgattaattattcttacatgctgcatcaaggttcattcaagaatgtgaaacttctgattatctatgattgttagctgaatgctcatataagactgtaaggtgttaatcatcaagaggaggttattttcatgactataatttgaaaagcaacaaagtacaaacataaaattttcatggcataaaacttcctatcctcaagggacgaattagaaagcatataaaaaattaatagatcaaaagatacagaccgttcccttttttatcttttcaccacaccgtctacaggaagtacgggcagatttagcaacctcaatggtgcatttatctgaaatagcagctgcagaacttgcagtagctggtgcacttccaacataatttcttatcttctcttggtcatcccatctgagtgtgtctattccttcaacatcatcaacactaatttgaaatgaagaatcgacactttgagttaggtcagatttccaatagatgcaataaagattaataaaccataatactatagcgtgaaactcatgcaaacagtaaaagataaagttgcatacgattttatctggtttttcttactgaggatgcaactggcatggttccacatctgaaaaagagaaaagggcactaaaattaattggaagtggtcaattcgtaaaattgatatggaaagatatgtcatataaccatcgagttttctcttctgcaccatcgagaatctaccatgaccaaaaaaaagttccaaacagttatagttcttgaataaaacaattactataaacatagaaaaggtacaacgttataaacactccatattaaagaacatggtcaggtaaaaaataagggccatcacagaaaataaaaagatatggtcaggtgaaaaatggcatgcagatccaaaagtaccccctaagttgccctaaacgatcctacatttcccagtgaaataatttgagtgtctagtccacataaccacatgagtactgagttgatccgaccaaaagaaataaagattcattatccaaatgtgcaatataaaaaatgaaaaatagaataaggactcccctccaagttttatcttgcctaatacaggtaagcacttataatacacatgcacccacaaaacaattacaagaggcaaactagaaaataaagcgggcaaacgaatacctagattataatttgcaaactacacatcagataagaacaaaaacagattagcgaacacactagattactaacattgtcattggtatgccccattgccatgctaaaagcctaaaacagcacaaccaactggcaggtccgcataataactaatatatcaaacaacttaggagaaataccagttaaattgcatatgtcaaagttggtgcccacaaaagcacctctatctattcttgcgttacacatatagattgcataatggattagaaacagcaataaacccaatgctggaattgacggatcatcgacaaatcgacagagcaccaaaccaaatgcatcaagaactccgcattcgaagaagattggttcgatcataccccacaaaatcatgcgaaattaccctcagaaacatatttttttcgggcatcaagatttaaaaccaaccacccaccaaagcagaagattcttatggcaaatgcccgcaaaacccacattagcaatgcacatcaagatgaaaaccaaccacccatgaaagcagaagattcttgtggcagatgaccacaaaacccacacccgcaatgcaaatcaggatgaaaaccgatcacccatcaatccagaaaattctcagaatccaaaccaacctacaaaaaaccctcaagaacacgatgcctgccacaccaaaaccctaccctcccagaccctaaagatcaaagcaagattcatcaactgaacggagaaagatcgtcggcgaggagagcgggtggagggagaggatacggacgggcattaatccgtcgaactgcgtggcctggaccatcttgccgagccggagctggtccttcccgatgggggacctgcacgacttgcacgaggaccgcccggacttggcgtactccgccttccaggccttgggcggcgccgccattccgccggccggtgcggctggtgccctcttcctcccttcccctccgccgcttcttggcttgtcctagggcctagaaagaacccacacaacgagaaaggagaaagggaagggaaaggcctgatgatgatgaggtgtaaaaacgttaaaaaggaaaaaaaaaatctcccctcgaaaatttggggcgagttgagttaatttgatggtttttcttttaaaaccctgtgccatatcctccccgaatgtgtattctcatatgccatttttcttacgggctttacggactgtttggatgggttaactgtatgatttctcacgttttgccacgaaaattactaagtatttctcaatatttttttcgacaattaagctaaaagtaaaagaaaaaaaataataaaacattagagtttatcagtacttatcataaaacaaacagatgatacctgcgttttaatgtgaaacatattgataactatatgtttaatactataaaaatgatagatagatttgtgagaggtgataactggatatgattgcatgttgatttgtagaattaaataaattgtaaatgatgttgtatatttgcatgaggttgaatatgtaatttttggtagtgggtaatgatgtggcgtggtagcatgttgaacttagtggactataactttaactttataaaaagtatagattggatccatatcatcgtaaattttctatattagaaaaataccactactattcgtgatattggctgggtgccactgaaattttgtaaaattagatctatgacatcaccgtcacatttttctaattcacatagaaggatgacaactcgtagatccgttttgcattcgctgatctaattacgaaaatgaaatactctctccatcccgttttgtttttgccgttcctggtgaacaccgcaactgtcgacttggagtcgccggcgcaagccgattggggtatctccacacaagatgtgtcgtatcgttccagacagggacaggcaaaagagcaagccatcacgcactagcagtcggcctccacgctcgtcttgtggcctcgtcgttcgcgagacacaagcccgtgcgagctcatcccatcatggtcgagtgcaccttcgtgcatcgagccatcggtcgtcacgctgtcattggccgaccgagccactttttggcatcagccatggagggagagagaagaaaagaaagaaggaagaaagaagaaagaaggaagaagaagaagaagaagaagaaaggaaaggagctatggcttgtagttgcggctgcacccgtgccgttcgcaatgcatgcgtcaagtccgtcgttcaacgcggcaaattcatgttggcagctacgcccattatgcgtcgacatcactgccccttccactagttttggtaaatatacgtatgcaggccatttacggataaaaatgcacccgacatgcgataaaatgaacctcctgctaatcatacatgtgtacaaggattggaaggtgttgatgtgaaaaacacacactggcgaggtttgctttactctagtgcaggtccaaagatttgccttcaggttcagggcgtgctagttagtttgatcctgcaaccaacaagaaacaaagaatccaaagttaaatccataaacgatagcccatcggctggactgccgatgacatatcatttagcaccaagccgatgtaacgcaggtcagatcggcaatgaagtaagtaacgagaaaagagttagatccactcgatcggctgtagatatcaatgatatataatctatattccaagaatatatttaagctaagcgattgggatagatcgggcagtgtgccgagacagtataaattacttgcgcttaaaagtgctttggagtaaagattatacatattcatagcatagctgatagggtaaatctaatgcgtatcgactaatactccgataccactcgttactcattagaataaaccaacaaatttaatatatttcattcaaaagagatcttaatataaagggtagattcagtatgtcgagtaagcatataagtaacgagacaactaaatcaggcaagatcggctgaaaccccaatagtatctctagtagcagtcatgaaacaagctagatattacgattccaggtaatgctttaatggatcaaacttaactgatacaacattaaacatagaaagaagcataaaatttaaacaagtcgatggcaaccttttgaagatggtagatgcactatgtaatctaattcgaagtcagtatctaaccatgtcgactgttttcgatgatagaggctagccgctgaggttaggtagcaagatcgacctagattacatagcatatatgataactcgacgatttatataaacaggattagagtgtcatgaagatgtaagcactaatcccgagaacgcaagccgctataacaagctttacctttttgtcgaaacaagattttggcaatactaaaagggggtggctatcaagctagaaaagtggatgggttcagagacaagggattttatacaggttcaggccttcttaatcaagaagtaataccctactcctgtccggggattgatccgccgagtgtattattgatcgtatgatctgggagaaaatcgtgcccctagaggcacccggacccctccttatataggggaaggggtccgtattacaaagtacaaaccatatccctaacggaataggtaattacagataaaatacaatcgtaaccgactaggatcccgggtatttccttgacatacaagtttggtaattaacccgagtccttttaaagatattctatctatacatgacaccccatacccagtcggatatacatgccgtgtaggaatggggtatccataatctccacagtagcccctgagacctttacagtcgacggaataatcttctctcataatccgaaaagacaatccgagtgctttagcttcatctgttttgatctcccgagtaatataatcaaagactgtgaagggctgaaaaatagaaaaaatcaggtgcatcgactagatgcacctaattaggtgtagccctcgactatatggttagttgaacaaactaagcatatagtcaaggaataaataatccaaccaaccgagtggtttttgataattgttatcaaccaagtgacttgatatcaatatatagcatatgcagtgtgaatcccccaaataatatgatccaagtgatataccgactgctttgcagaatatgatgcgtgcaacctaaagttgacaacatttttggaaattcacatagcaaaacagctataaagaagagcttgatgttgtgaataaagaaatttccaaagtattgggcatacaccatgagcacacttctttaacagatgtgcttaagtccctaaaagacacatgatttcaccacacctgaaaatatatggcatatgtggtgtaacatccgagtaaataaactcgtaaacgatttaccaaccgcctggaaaatgaccacaatatataatcagccaaagccataatattagttaataaaaatgcacacttacgtggcaaaaagcaatgatattatatccaatcaactgctttataaacccaaacaacaccttgactatataaaaaagtcagtagggcagctatgtaaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgataggccacacctgaaaatatgggctgcagacatattaggcctaggccaaaaaatatgccttcgacaccctttaaaggattccaggataaatatctcaaggccaagcatatgcagcatctggtaaacctcccgccgactgctttaatgtgccaaagaaatataaagaaaaacccaagtgagaagcactccaaaggttcataaatcagcacagatgataaaagtccgagtaaaaactctcaaaagacctatcaaatgtggcataaaatctgataaaagacgagtctaaatagcctaggctatgactcatgacataatcaaaataagcatataacatgccgagtggatgactgtattaaaaccagtcatctcaagaaaacccaaacaacctttgcagcctaaaaaggcctacaaaattagtataacacttttatgttatgcacctttttatttgcatcgtagtaattccaaagaattatctaactgcgtcaaaaaggattttaacagcattgggctatactgttgtgagcaagtgttgacgaaacaaaaacaaatgcctaagtccctatggatcacaacttaatcacgctgatagcaaaactgggctgaagtactgtttaggcctaggcccattagtactcccgataccctagcgaaataaacgccaaaatcggagcgtcgtttcgtcttccccgccgagactctcgccactttccccatttcccgctacagtgcaaaaccacaccggcggaagcaagcacaccggcggaagcaagggttaacaaatccactccaatccatcctcctgagctccacaaaaaccctccacgcaaccaccgcaccgaatccccatccatttccagccatatctcggaccaaatcggcatgggacgactggatgttttcttcttcggattggtttgccttggttgtttcccggtcacctctttattgccagattttctagcattatcgccttcatcatcactcagaaccaatttcctcttgcgggagtccgactgactgattgatttcgaggtgtttgtttgagtgtcagactgaatttttggtcctccactcgcctgaccagttcgccagcggggtgatcggcgttgagcaattggaggatccgacttcatcaaagcgaattcctgggtataacatttcgagttttcaattagcttaacagtagataaaggcatgcttttgagaaaggctgaaatgtttgaatacataccggtggagaaggattgaaggcgttgtatggcaccactggcagcaagtgcgaataactgactacaattgcattcgagaagattttatacattctttccttcataaccttgaattcaagagattcaggatcttcacggttggtgtcatgtttgccatcaaatttgaaggctgtacaggatctctctttaattggagctagccggctcttgataaaatgccgggtgatctgttctccttgcagaccttgctccttcagcttcagcatacggtccatcagggcaagcgcctgagcggcttcctctcccattggaagtgagttccaagagtcctgataaactggagggagacaggagtactcggggagtgcaggctcggggttttgtacatagaaccaatttgcatgccagcctttgtttgaggttttgaagggcatggagaaatacttttggctcagagttcccctcaattgaaatccagcccccccaactacgcatggtttactcttgtttggttggggcttgaggaagaagatgcgacggaataaggcaaaatgtggcctgacgtccaaaaaagcttcgcaggcgtgtatgaagttggcgatgtgaactatggagttcgggtttaagtgatgcaaactaatcccatagaaatcaaaaatcccccggaagaatctcgaggttggaagagaaaatccgccatagaagaaatgagaaaataccacgacttcatgtgtgtcgggggtcgggaatgcttcgccgaatgctggacgccatccaatgatctccttcgccagaagaacgccgtgcgccaccatctctttcaaattctcctctgttacatcggagggcgcccactgactctcgaagctttctctctcttccgtcatgaatacgaactggatggtgtgatttggtccaagatatggctggaaatggatggggattcggtgcggtggttgcgtggagggtttttgtggagctcaggaggatggattggagtggatttgttaaccctagcttccgccggtgtggttttgcactgtagcgggaaatggggaaagtggcgagagtctcggcggggaagacgaaacgacgctccgatttgtactgatagcataactcaaactcgtaggaagccatctgacatagatctttctggaaaagactctgaaccgactgacatggagacgggttcttcaaaagaagatcacccgactgcagaagatcacccgagtgacaatcaaccggcgaccgacaatgtagaacccagcaacgagcccccgactgggaaccagtcggccgaaactggggttggtgctaatcaggagcccccgactggaaaccagtcgggtacagaaccaaacaaagatattcctgaagtagaaactcaagctgacagccctcctaaaaaggatgccagcgtcgatctagggtccggctctcttgttaaattacaagggcctactcgtccccgaccggaaataatcacaagtaaacacatcctccgaacccattttgatctgacagactttcttcaattgtttcacctttattcataaatgcctaaggcccaatggtcggcgacgaagaagaagtcctccggatacagtcagctgaggattctcgtccacctattttagtcaaatggtgggacgatgatatgcaaccttagggaatcgtgataaacaagcaaaaggaagatgaggaagtatgcttgctgaaaaaggcactcagccaggctactcgcatcgtaaatataagtctccttatacatagcttcaactatcctgtttcccactttgctcaaatgccgataaattcgcattgcagagaatccatctcaggaacgaggcgaagaccgcgactcttgagaatttagttcctcatcttggaacccttgagaccaccagaaaccagctgcacaaggctaaggagcttgccaggaaaactgagcatgatctgagggatcggatcgccgagcttcaagaatccaactttgaactgagcggttcgtcaaaaggtaaatacaatctatgtctaacttacttatgctgccatccttgtaatatcaattaatcaagaagcaatacagtgcaagccgccaagatatctgaactagaaaagcggatccaaactctggagaatgacaaggccaaattggcgaaacagagggattcggctctgaaagatgttgaaggtactggtgactaatacctcttatctttatgcctactcgttgatataaatctatttacgcagatcgcaaaatcaagtctcaggctcaattcgatgtcttggtcaataaaatcaaaaggcttgaaggggctagggatgaagtcgccaacgctgctaccccactcgtccaagccatgttcttcaataacaatggtccgagtacatttgatgcttccgaaatcttcgacaagctgagaatcgctccggatacatactttaagaatatcaaagaggccggaagtatgggagcaagcctggcgttggcaatgaccaagtctttataaccgaagattgatgttgacaccattgatggatttgcagacgggacgagcgaagaagccgcccttgacctcatcaacgatgcgtagaaagccgccgacaagatagccattgatgtagttgagagattccaggacaacgacctccggccgactggatctaataattccgatgatgagaaaactgatactgattgatattatactgtaacagtgattctgatgatgatgatgatgatggaggcacaatttgtacaatactgatgaatttatgttgtgcttgatatttcaaacttagctcccgatttcttaaaagtttttgtcaaacctttttgagcctaaaacccacaaaagttgttaaaaaactttcagtcctcattgactaagccaaaaaatcaaacaaggcaatgataaatcaagtaagcaaattgaattgataaaagtcacactccattattattatagtagcccccgactgataactcaaggaaaagcttgatgttagcagtcaaagctgaagatacaaaagtaatgcctaagcataaaaacgacgaagatgttcaatattccaagagttgtcgatatgagtaccgtcctcacgcttgagtcgataagaacctggccgagtgacttcagaaattatgaacggtccttcccacaagggagataacttgtgccgatcccgtgtagtttgaatttttctcagaactaggtcgccgactaaaaaagctcgtgagcgaacattgcgattgtgataatgacgcaccccttgcaagtaccgagccgactgaattaaggctgcttcacgggcctcttccagtcggttgatatcatctactcggtcttctccgtagcgctcctcgctgaagttgcgaaatcgtagagattcaaattccacctcactcggaaacattgcttctgctccatagactaggaaaaacggcgactggcccgtagctcgactgggagtggtgcgcagggaccaaagtacggacgacagctgttctacccacttgccggcataaggatgcagtcggtcgaaaactcgcgcttttattccttgaagtaccataccattggcacgttcgacctgtccattgctcatggggtgcgctacggaggcataacaaattttaatgccgaagtcttcacaaaagtctttaaatactccgccggtgaattaagtgccattatcagtgatgatacgattaggtaccccaaaccggtgcacaatgttgatgaagaaatctctagccttgtctgccatgattgtaatgaccggtttagcttcaatccacttggaaaatttgtcaacagccacaaagaggtgagtataaccaccgactgcctttttgaatgggccgaccatgtcaagcccccaaaccgcaaacggccaagacaacaggatggtttgcaactcctgagctggtaaatgagtttgtcgggcgaaaaattgacaaccctcacatgttcacacaattttgtcagtgtcggacacagctgtgggccagaaaaaaccctgccgataagccttgccaacgatggttcgtgcagcagcgtgattaccacagatgcctgaatgtatatcttttagcaattgccttccctcctccaaagacacacagcgttgcaggattcctgatggacttttcttgtacaactcggtctcatgaataacatagagtttgctgcgcctggaaatccgctcggcttcatctttatcttgggggagttcttgtttgatcagaaatcttatgaggggctctctctagtcggcttcaatcatacttacgtcttgagtatccgtggctttaattgtttctttccttggcacggttggttcgtaaagatgttcaacgaacacgtcggaaggagctacttctcgttttgaaccaaaattagccagtctgtcggctgcctcgttattgtgccgaagaacatgagtgagttcaagtctatcgaatttgtcttccaacttacgtacctcctgccgataagcggtcatgttatcatcaaggcaggaccactctttcatgacttgatcaacaaccaactgagaatctccacgaactatcagacgccgaatgcccaaggagatcgcgatccttaatccgtgaagcagcgactcatattctgccacgttatgggacgcggaaaaatgtatccacaatacgtagctcaatcttttctccagtcggggagattaaaacaaccccggctccagtgcctgaaagcctcttcgacctgtcaaaatgcatggtccaatactccatcttctcctcgggcatgtcttcttggcactcagtccactcggcgacaaattcggctaaagcttgggacttgatcgaagttcgcggcttgaaggatatatctaaagacatcaattctaaggcccactttgcgattcatccatttgcttcgcgattatgaagtatatccccgagtggaaacgatgtgaccaccgtgaccgagtgaccttagaagtagtgagataatttccggacggtaattaaaacaccatataatagcttctgaacccgaggatatcttgtcttggaattagccaaaacctcgctaacgaagtagattggtcgttggactttttgaacatggccttcttcttcacgctcaacaaccaggactgtgcttacaacctgggaagttgccgacatgtataacaacagcggctcttgcggatgtggtgaagctaggactggtggagtagtgagaagttttttgaagtcttcaaaggctttctgtgcttcgagtccccactggaaattgtctgtcttcttcaacagcttgaaaaagggcatcccccgctcgtcgagtcgcgaaacaaacctgctaagcgccgccatgcaaccagtcagcttttggacatctttttgtgagctcggcggtttcatgttgaggatggcgttgattttctccgggttggcttgtatgcctctatgggacaccataaatccaagcagcttccctgacggtactccgaagatgcactttttagggtttagtttcatcctgaaggcgcggatgcttgcaaaggtctcttctagatccgcgatcaaatcatccttctgtttggtcttcacgattacatcatccacataagcttcatcattgcggccgatctgagttgaaaaacatctctggatcatgcgttgataagttgctcctgcgttctttaatccaaagggcatggtgatgtagcagtaggccccgaagggcgtaatgaatgaagtcttcaagcagtaggattcttttagtcggatctgatgatatcctgagtagcaatccaaaaaaactgagtagctcgcagccggccgttgagtcaactacctggtcaatgcgaggtaacccaaaagggtctttgggactagacttgttgaggtcggtataatcgacacacatgcgccattgccccgtcttcttccgaaccaggactgggttagccagccagtcgggatgaaggacttctttgatgaagcccgctgctaacagcttagtcaattcttccttgatcgcatccttcctatcctgtgcgaaacggtggagttgttgcttgataggtttagcgtcttccttaacatgtaaagagtgctcaatcacctctctgggaataccaggcatatcagatggtttccacgcaaagatatctttattattttgaagaaaggtgatgagcgcgctttcctatttacaatctaactcagcgcctattacagcagtcttagtaggatcagagggatctagaggaattttcttggtcttggcgtcgctttctccgctctttggcaccttggttgcaggcacttctccttcgcttgctgtggacgcagccagtcggatttcttctcgagcgagggtgatctcgcgggtctgggccatcttgcagctttccttgtcgcatgtgacggcttatttaatgtcgctccgcagggatatgactcctcgaggaccaggcatcttcatcatcatgtaggtatagtgcgggacagccataaacttggctaacgccgggcgtccgagtatggcatgagacgctgtctcgaaatcagcaacttcaaaacaaacgttttctgtgcggaagttctcccgagtgccgaaagtaaccggaagagtgatctggccaagtggtgtagcagatagccctgggatgactccgtgaaagggcgcattactcggttttaattccgtgcgagggatctgcatgttgtccagagtcttggcgaaaaggatgctgagcgcactgccaccatcgatgagggatctgcgaagcttgacgttgcgaaccacagggtctagtaccagggggtaccgccccgggtggaccactcggtcaggatgatccgagcggtcaaacttgattgtcgtctctgaccaccgaagatattggggcgtgtcgggctggacagcattgatctcccgttcagtcaacttttgctttctcttggattcataagccaggggtccgccaaagatgtggtttagttccttgcgatggtcttgaaaaccagtcggggcatcgtcttcatcatccttcttctttgacgtgctttgatctccgtcagcggtcttgcgtgcgttcttggcgtattgctctgcaaactgtttgtagacgaagcaatctttggccgcgtgattggaatttggatgatgcggatattgggagttcatgatcttatcaaaagtattgacgcgcgaacgttgtcgggaggatggtgtagtggttgccacaagttcctcgggcttacgcttgcgatccttgtgattggtacttccactcccccctgtgttcggcatatttttcttcagcttccaagtggtgcccgactgcttggacgcggtaatagcatcttcggctttggcatactcgttggctttctcgaacatctgcttgaccgtcctgggaggcttgcgcccgaacttgccgactaggtcgtcgtggcgaatgcccttggtgaaggcggcgatgatgacgtcgtcggtgatgtcggagatcttgttgcgttgctcggaaaaacgccggatgtaatctcgaagggattctccggacttctggacaacgttgtagagatcgtctgagtgccagggcgttcaaaggtgccctggaaattggcaatgaagtggtcgcgaagttccgcccaagatccgattgtgccacggggtagcctgtgaagctaggaccgggcagaatctgctagggccataggcaaataattcatcatggctttgctacctcctcctgctgcgcggattgcgagaccgtagacggtgagccaagactccgggttagtggtgccgtcatacttctcgattccactcggcttgaagccggctggccaatccactcgacgcaggttggtcgtgaaggcagcaactccatccacgtcgtcgtcgtagcggtctggtgaatggttgggagcacagcctcttgccgcgcggcgctggttgatggtatcgcgaagatcgatggggtgcctgcgaggtcgttcaactcgacgctccctgtgtcgttcgggaggcgaatggacagatcgctcgtcgtgacccctgctcctgcgactggatcccgcgccgatgacgctgaggcttggttggtgatagtcttgagatcgaagagggggaactcggctgccagtcggcgtgcgggtgcttgcggagttagccgggaccgaggcggcgatcatggtctttgtctggtttaagatgttgacgacgtgatcagcctgattgagcgcgtcttccttgaggagggtgtcgaggagggtgatcgctgcaaccgcgttctgttagggtgtgcggaaaaccgctgtcccgtcgacgacttgttgcccgatgagatctcgtgctcgtcgcccggattccaaggcgcgctgtcgtcgatcctcagcctcctttgcagcccgttcgcgatcttgttgttcacgctgtagtcgttctcgctcttgtcgttgtcattcttcctccagtcggcgacattcagcttcttgtcgtgtgcgttcttcttccgcttctcgggctcagcactgttctgccgtctcgttgttggccatgaatacaccgaaaaagagaggcgtgtagtcgtcctcgtagctgtcgtcgaagttaccgtagtcgtagcgatagccgaagtcgtcgtactcgaggatctccgttggtcgagaactgacgccgggggagctgaggtagcaatccaattcttccgtcgagaccgtcccgagaggctgaaatataacgcctacctccctagaactagattggatcgaagccgaagccggatcccgtctaggtcttcgggtgggagatgccttggtcgtgaagacagcagccagatcatcgggaagtctcatcaggattgggggataggacccatcatcttgatctggtcgtgtccgagtagattggatctcgtacgagtggtttgaagccaactcggcagagatgatcttggggtagacctcggccgagttcggggtaccgaacggggcggagatctgacctcttcccgactggttcgaatccgagtcgaggagagaaatcttgccgaagtcgttggtgatgaagtcgaggctgccgaaccggaacgcctgtccgggagggaagacgaagtcgtcgatgccggagacggaacccatcacactagtcggcgaagaacttgacgctgcccctacctggcgcgccaactgtcgaaacaagatttcggcaatactaaaagggggtggctatcaagctggaaaagtggatgggttcagagacaagagattttatacaggttcaggccttcttaaccaagaagtaataccctactcctgtccggggattgatccgcagagtgtattattgatcgtatgatctgggagaaaatcgtgcccctagaggcacccggacccctccttatataggggaaggggtccgtattacaaagtacaaaccatatccctaacggaatagataattacagataaaatacaatcgtaaccgactaggatcccgggtatttccttgacatacaagtttggtaattaacccgagtccttttaaagatattctatctatacagggcaccccatacccagtcggatatacatgccgtgtaggtatggggtatccataatctccacacttttcgtcggagatcgaaaactatgcagcccaactcgaaagcaagaactcgtcgaaacaatgaaaaaagggtggcgatgcgccgaaagtgttatcgaactgatgttgtttgtttacagggtcctgggttatatttatacccaaaatacatgatatgtccttgccgaacacgactctatctctattacaactcaaaaatacgaacaagtcctgcggactcttaccgaaaatatctataaggaaactattagaatatcctaattaataggtacaattgccttctccggactcaatccacacttggcaatactggtgtagcacttgaaccgatctagacaacaatctcctgatcgccttgccgggatcagttatatcggctcctccttgcccgatttggtagcagccgatgcaacccgtagctgatgtgggttctgtttctgaggctacagatttccaccaaatccactttggttctgacttcggatccaatctttgatttaccaattttgatcattaacacatgcccctcaagtccgtgatatttgcgatgttgcggatgtgctcgattttgtttccgcttgcatctagggtttcttttctgtttcggccgtcaacgcgcccttttaaatagtgtcaaccaccttgaaaatttcacggcgtctcccccgcttcaattgccttggccaaaaacttcccccaatcactccagtaattcgctcagcgactctgcaggcgatcccttgtttcggcggcggcccgacttcggcaatgtcttctgccaatccctcaagcgctccggtggtcgagttccccgaggtaagcaccatcggctaggccctttctgtctctttaccactttgtgctcccttccctgatctcttcttcattctattgtagcacctatcccgtcaagttgcagttcctagcttgcaaaaccagcaccaattctttttggacccaatcagtgacacagatcctactcagtttatcaatgccaagaccaacaaagtcctctttagacggactaaccctattttaggccattggactggtaccttcaagacttggccttcctccaatgtcaaaacttgaccggattggtataggaggatattggctagcgaacagactcactgggatgagcttgggatttcacaatgcctagcccctcaccatagccgatatgaaaaatgatgagcccatgctgtaggcagccgcttacttctggtccaataccttgaatgccttcttgttcggccagggaccgatgactccaactctcttggacgttgtcatgattacgagtttggatgtcacgtcgtcagccaacccaatcagtttgagcaccaaaagctagttttcctataaaaccaagagcattggaggctggtctggctttgttacttcgaacatggggtctggtcttgtaacccctagggaacatgtggccttcctgatgatgtggttacaaaagttcctgttttgtggtccaagttgtgggcctacctccaactggcagcatctggtgtggctctagtggacaagaagcaacttcctttgggcaagtacctcctggtggctctgtatcaaactcttggttctgcatcagctaagactgttgtcgataccgtcatcggcactggtggtccctggtggcttttcgaagtttgtttgaatttgcataccatcaaggtatcaaaaaggtcagccctgactgaagcaagatttccttctgccgacgatccaactgaagatgatgacggaaataaagtttccaccagtcgatgcatgtcctttggagaggcggcatcttatgctggatcacagttgtcggctgagcttttttctgatcggttcggtaatttttgtgatgggtatccaagggactccagaatatggtttgcttatgatcattccgaaaattttgagcttccggctaattttagatttgacaaaatcaatcatgaagttcttacagcagccatttccccctgcatactccctgtcggcatccatcaaggcaggaatatttaggtttcatacgagttctatcatccaacgagcgctgccaggcagcttggaataggccaattgccgattagcttattttttgtagacaagatccaaaccagcggggaaattacatcagctctcatgatggacatgctcttgagcatcccaggaccccctttaggctgtatcaatgatatcgagctagctctgatgaggagctgtcacatcctgattttcgtttcaggttttataaattatttaataaattattttcagaatttatattaaatgttcattaatttacaagtgaatttaaatgtgagaaataaaatttcctaaatataaagcatggctggatttaatttttattaaactctttgtggttaattatactctctagaattttctcgggattttcaggatttttcttgaaattatgttgtagctaggggtcaccaccgttcctctctatttggcccaaaacactgtagaggaagagattgggtaagattgagtttttattctaagtatccgagtggcaaatggtcattcgaacaaggaaacggtaaaatgttgttcgagttggaaaacactattcgagtcggaaaataccgttcgagtgagtccttgtcactaagtctcattatccgttttgagtttttcatgagttaataacaggtcagctatcggataagtcggaaagggtggtcgagatggtaaagactatttgccatggaaaagacccatagtggtggaaaagacccttggtcgaggagaagatccatgttggtgaaaaagactcttggccatgaagaag

SEQ ID NO: 46574 - DNA, 1431 bp, Oryza sativa
atggctcaaataatggagaaggaaaagggaaaagacaatgagaaaacactcgtggaggaagaaataactgggggcaatctggaagaggccgaggacaatggtggaattctggcagaggtagaggatgatggttgaataatgatagaagcggaggaaaagagtatcagcctaatcatagcaagttttgtcaagcacatggtctaggtggtcattctacggaagaatgctatagcaagttttgccaaatccatggtctaggaggccattccactgaagaatgtaggcacatggcttacttagtggaaaagcatgtcggtcgatatgagaacaagcattagggggcttgagatcagcgagggaaaaatgccatagaagcaccacaagtcatgaaaatagaagaaattgaagaagctccaaaaagagtgataaatgccataacaggaggctcttctttgggaattgagtcaaaaagacaaagaaaagcatatgtgagacaagtaaatcatgtagggacaagctatcagtcaaatccaccagttcattcgaagacagtaatttcctttgggcctgaagatgcggaaggaatacttttcccccaccaggaccctttggtgatctcagtggaaatagtacaatgcgaagttcaaagagtcttggttgatggaggaagctcagcggatgtgctattctacgatgctttcaaaaagatgcaaatacccgaagacagattgacaaatgcaggagtgcctctacaaggttttggcggacaacaagtacatgcaattgggaaaatacctttgcaagtggtttttggaaaaggcaacaatgcaagaaaagagaaaatagtgtttgatgtggtaggtacgccgtatcagtataatgcaatactcggaagatcagcaattaatatcttcgaggcaataatacatcacaattatatatgtatgaaacttcctggaccacgaggagtgataacagtccgaggtggccagttggcggcgagaaagtttgagcttcagggaacgccaaatgtcaaaggagtccatgccgttgatcaaaaacatggagaatactttaagttgcaggaaccagttcctgaagggaaaagtaggaaagtatagttagatgatgatgatcctagaaaatacattttgctaggagagaatctggaaaagcatgttgaggaggaaatcttgaaagtagtgaaaagcaatatggatgtctttgctggtcaccagaagaactagaagggggtagatagaagcctgatcgaacataacttggcaatcaagcaaggctgcaagccaaaaaagcaaaagttaagaagaatgtcaacagacaggcagcaagcagcaaaagtggagctcgagaagttgctcaaagcaaaagttataagagaggtgatgcatcgtgaatggttggctaatccag

SEQ ID NO: 46575 - DNA, 1202 bp, Oryza sativa
gggttttgcctttcatccctttcggctgccccgtttgtctacgggtgtgcaaccgatgcgaactcgatttcaagttttagcccctcgcacatttcattggacttctcggagtcaaaccgcttgttattgccggtaatgaactctttcggaacactgaatcggcagaaaatgtttttccgaacagatttttacactagtgccgaaggtactgccttagcccatcgaaggcggcttgacactcaggtgtccaattgagtttgccggccccttggaccatcttgaaaaatgataaatctctttcggctactcttgggagcaactccttatctcattttcgcccccagcccttgtcgccgtaactcgctggtactgtggcgaagggcgtgggtgtggcgaaacctgttcgcccacagcccttaatgccataccttattggcattatggcgaagggcgtgggtgtggcgaaaccacttcgcccgcagccctttacgccgtgcctcattagcactatggcgaagggcgtgggtgggcgaaacctcttcgcccgctgcccctgacgccgtaccttattggcactatggcgaaagacgtgggtgggcgaaacctgtgcgcccgcagcccttgatgccgtaccttattggtactatggcgaagggcttggcatgtggcgaaacctcttcgcccgtaacccttgacgccgtgccttatgggcactatggcgaagggcgtgggtgtggcgaaacctcttcgcccacagcccttgacgccgtaccttattggtactatggcgaagggcgtgggtgtggcgaaacctcttcgcccgcagcccttggcaccgtaccttattggtaccatggcaaagggcgtgggtgggcgaaacctcttcgcccgcagcccctgacgccgtaccttattggcactatggcgaaaggcgtgggtgggcgaaacctgttcgcccgcagcccttgacgtcgtaccttattggtactctggcgaagggcgtggcgtgtagcgaaaggtgtccagaggcttgggcggcttcgtagccccccagcttggacttaacatactttcgcccccagcccttgtcgccgtacctcgcgggtactgtggcgaagggtgtgagtgtggcgaaaggtgtccagaggcttgggcggcctcatagcccccccagcttggacttaactcactttcgcccccag

SEQ ID NO: 46576 - DNA, 859 bp, Oryza sativa
aagttgcttggtttcttagtatctaagagaggcatagaagcaaatcctgacaagatcgcagcgattcaccaaatggagccaccaaaaaacacaagggaaatgcaaaggctgacaggaagaatggcttctttgagcagattcctttctaaatctgaagagcagggtttgccatttttcaaaaccctaagaggagcaaacacatttgagtggacggccgagtaccagaaggcttttgatgatttgaagatgtagttacagaatatgccaactttagcaagtccacagaaaggtcaacctttactaacgtatgtagcagcgacaccagggacagtaagtgcagcattagtgcaagagaaagaaaacaagcaaatgctagtttacttcgtattagaagctttacaagggccaaagacaaggtacacagaagtggaaatgttgatttatgcaattgtgatggcctcaagaaagttgagacattatttaatatcagatgacataacgatactgtcagcatacccgataggagaggtattgacaaataaggaggtagcaagaaggattgcaaaatgggcaatggaacttctaccatttgatttgaagtatacctcgagaacagctataaagtctcaagttctggcagatttttttggcagaatggactcccaatgaggtggaggaaaaggaagaagatgaaaaactatggataatatactctgatggagcatgcaatgccactggcgtaggggcagcagtggttgtaaaaacgccgatgaagcaaacactaaaatattttgcaaagctagttttcccatcaacaaacaacacggcagaatatgaaggggttttattagccatgaga

SEQ ID NO: 46577 - DNA, 5579 bp, Oryza sativa
tgaaaatggtggtagaaatacatgaagggctgtgcggagcccatcaagcaccaagatcagttgcatcgaaggtgataagacaatgagtatattggcctacgatcatcaaagacatagagaagtacattaagacatgtaaggcatgccaaaaatttggtgcaacgtcaaaagcaccaccaagagagttgcaaccaattccaccagtttggccaattccaccaagagcaaaaggagatttacgttttgtcattgtggcaattgagtatttcacaaggtggattgaagcagaggcagtagcacgaatcacatctgcttcggtacaaagattcgtttggaagaatatcatatgccgatttggaatacccaaggataatggaaaacgatccgagtcaggaaagttcaaagatatgtgtaaatgtcttaacctgcaaatcaactttgcttctgtgggtcatcctcgaacaaatggtgccgttgaaagagcaaatgagaaatagtagaagccataaagaaaaggctggaaggttctgccaaaggaaaatggccagaagatctgttgtcaatcctttgggctttaagaacaacagttgttcgatcaactggcatgactccattcaggctaatatatggagatgaggcaatgacaccaagcgaggtgggagcgaattcacctcgaattgtgtttgatcaaaaagacgaagaaggaagggaaatcaccttggaaatgttgcacgagataagagtggaagcattagacaaaatggcaaaaaacacagaagaaaccaaaagctattacaacaaaaaagtgaaaatcaggcaaatagaagaaggtgatttggccctcaagaaaacactaaatgaagtggctgttggaaggaccattcatagtaaaaagaaagttaaaacaggagcatacaagctggcacacctcgatggagaagaattaaagcatacttgggaatgctgtttccttgaagaagttctatgtgtaaaaaataagaaaaggaggaggaaaaaaaggagaaaaaaaaagggggaaacatgttgctcgaaatgtacaataccgaaccaccttgtaaaatctcttttcttctcggtgttatacatataaacaggacgtagggtgtatcaataatggatggtatatggtgttgcgaatcaagaaaatcctccgcacgcttcggagaagaaaagccaactcgataacaaatcgagaaaatactccgcacgctacggagaggaaaatccaacttgataacaaatcgagaaaatcatccgcacgcttcggagaagaaaagccaactcgataacaaatcgagaaaatcctccgcacgctttggagaggaaaatccaactagataacaaatcgagaaaatcctccgcacgcttcggagaggaaaatccaacacgataacaaatcgagaaaatcctccgcacgcttcggagaagaaaagccaacttgacaacaggtcaaaaagcactccacgcagttcgacaagttttaccttcgcccaaaaacctaacgataaaacgctcgaacacccttatccgattcgagcaaacagtggaaaattccacgcgatgaggtaaagcgtgatttcgacctcgtcactccttcgaaaggtaagaaggacggcggttttcgaacaagttttaccttcgtccaaaaacctaacgataaagcgttcgaacacccttatctgattcgagcaaaaagtggaaaattccacgcaacgaggtaaagcgtgattttaacctcgtcgctccttcgaaaggtaaggaggacggcggttttcgaacaagttttaccttcgtccaaaaacctagcgataaagcgctcgaacactcatatccgattcgagcggaaagtggaaaattccacgcgacgaggtaaagcgtgatttcgacctcgtcgctccttcgaaaggtaaggaggacggcggttttcgaacaagttttaccttcgtccaaaaacctaacgatgaagtgcttaaacactcatatccgattcgagcggaaagtggaaaattccacgcaacgaggtaaaacgtgatttcgacctcgtcgctccttcgaaaggtaaggaggacggcggttttcgaacaagttttaccttcgtccaaaaacctaatgataaagcgcccgaacactcatatccgattcgagtggaaagtggaaaattccatgcgacgaggtaaagtgcgatttcgacctcgtcactccttcgaaaggtaaggaggacggcggttttcgaacaagttttaccatcgtccaaaaaccaaaaaaacgatgaaacactcaaacactcataaccgattcgagcagaaagtggaaattccatgcgacaagataaagtgcgatttcgacctcgtcactccttcgaaaggaaagggggacggcggttttcaaaaaccaaagctaaacgctcgaattcttttctgattcgagtctttgcggaataaaaggaaaagaaaaaggaaaaatgacattgagaggagaaggcattcccgtgtaagggacaattgagtagcgccttttccatattctaagttgacgctcagatggtctaaaagtttgccaaaagttaatgctgctcgaagcattattcgaacgctgttttctaaactcgacaacgaagtcacgcaaactaccatctcgatgttctctttgccattggaaaaattttaaagaaaaaatacaagtgtcatcgtaatgtatttccttctcttcatcatcacatttagttgctttagaaaagagcaacttctcgtgtgttcgaaatgcaacgagcttcatgtttcgagttgaatgatacttgttgcgtcgaaccacaacttttcggttcaaataaacctgcttccccgacaaaaacgaaatgatgatgaagcacaggcatacagagaaaatagcaaatggtacccaaccacagaaaatatacataattaagttcccaaccacaataggttcgacggagcaaaagaacaagcgttttcgaccatatccaaaaagttttccaagttagttttccctaaaataacttcacacctgtgaatcagatttgtgagcgtcaccaccgttgtctggttgactcgaagaggattgtgcggtgtgtgagctcgaagccaacgatgcttagagagaagcaagggtatcttcatagcctttctttttccagtaccaaacttgaaaagctttgactacagatcaaactgccgcatggtgttgagcaaactttgacataaatgtgcatattcaatacataaagaatatgtatacatataacaatatatatatatatatatatataataaacaaataaatgcataatgactgacaagaataaccgctttcgaacttcaaaattttctatcctagtgtttttcgactgaataggaggacggcggttctcccctagcttttgattcgaacacggtttcggccgaaaacacacttcgcccttacccgtgaggggcttgttgtagctaggggtcaccaccgttcctctctattcggcccaaaacactgtagaggaagagattgggtaagattgagtttttattctaagtatccgagtggcaaatggtcattcgaacaaggaaatggtaaaatgttgttcgagttggaaaacactattcgagtcggaaaataccgttcgagtgagtccttgtcactaagtctcattatccgttttgcgtatttcctgagttaataacaggtcagctgtcacgcccagaaattaactagcaatttccgaacttatttgtgcattaaatcctcgtccaggaatcagccgaggtacacaaactgacaattaatatacagattcatcataataataacgtaaatacttacaaaagaaaagaaaaatagcagcggaattacagtctagcgaagctccggctccactcccacaggcagctcaactgaggtataagccaaacgtcttctccttcgcaacttgtcttcaactgaggtttgattgattattgcaaggtgagcatatgacatactcagcaagccacacagcaaatatgcaagtgcacaaggataccaaaggatggcataatatagggttcatttgcaaaagcagcatttagaaaatatttaagaattgtaaaacagtagagtaattaatcatcaatattaatcaacactgaacagcacacccatgctgcacaggcccaaccatcctgaacaaccatacccggctgcacagatctatctccaaaccaggaatgtaccattccaaaccaggagctaaattaattaccatcaattaccacattattattaatgagtagtgtaggactaatcacgaaagacattgttcgacccgcccataaccgcgggcacggctattcgaatagttttactctggccagaggtgtaccactgtacccacaagacacaactccacaatatgtcaccatatcatcatgtgcccatgctaaacatgtcaccatttgtgtagttgtgacaagacccctcgcatatgtcaactcaaagcagtgcaccgttcctagatcgtagtcaccccctcaaaaaccagaggcatggactccccagcgacccccgtgggcttatctccgccacttctcagtctggcactccacgatgagccttgctatgcaaagtgtccagccgttgcccattctggcttgtggttgacacggttaatgtttcacaaccgaaactcgtgaaccggtccttaattgtcatgagcactaccatcaaaaccatgtgctcacaacccaccattatcaagttttagttggcacattaattaattcaccaatcacgattaaccatcgtgagctatcattaaatctctaccattaagtaatagtgaaacattagttatcccaattatgtgctaatgtttctaagcatggctaagcaattatatctaacatctagctgaaccaatatataaagctcaactagtcaaattataataacccaatgtatcaaggaatagtgtaatcaatgcaaattggccatacaaaggaataagttcacaccacccggtgacattcgaaaataaatgcacagttgaaataaataaagaatttaaatatacgatcaacatggtcaaaggaattgtgtttgggatctgtgtgacttgccttgcaataacgggtcttcaattagtcttcttgaacacttccggcgcactcgagaaccttcgaaacgacggaaacgacaagctaacacgcaaaacgaggaaaaagactaataaaaaccaaataaacaatacataagaagtaaacaaacatgtagataatagttttagatgaattaggagacttgaacggcctcactctgacttcatatgaattaattatgaattttacaagatttaatctaattaaagcccatttaaaaaaattaaataaatttaattcaatttatggataattttaatatgtagatctttattttatacaacttttgcaacttgaaccacattaaactgagttacaatgaattagttatgaatttttaaagattaaaccggattaaagcatttatatagattttaattgaattatgacgcaataatgaattatttttgaaaa

SEQ ID NO: 46578 - DNA, 19542 bp, Oryza sativa
ccgagatctaatctaaacaaaatggacggccaagatcgatctaatccaccacgggtctacggctgacgtcgacgatgacgtcatcgccggtggcggctcggcacctcgtgctcgccggcaatcgatggcgcggcgacgcaaacggagggcaccaacgggtagagggcgacgcggcgaactcaccgagctcttggatgacggcaaacgacgacggatgacgacggcggcgaggtcgaagcggcggcgatgattgggtcaacgacgacggcggtgttccagcgatcttcggcggaaacggaggggtggacgaggtgctgctcctcctcgcgatcccgacggtggcgacgacgaccgaaggtggtggctggaccaacggcgcggcgtggctggaccaacggcagcggtggagagcttcggggcgacggagtcggcggcgctccgatgatctgcggcggaaacggaggacgggacaaggacggcggcgaccttgcgaacctggcgacggccttcccgagtgacggcggcgactagagcagcggcgcggcacggccggactcacggcgacgacggcgacacacgagctaacgcggaggcggcgctacaagcgttggcgggctaaggcgaaggtgacggtggattgaggaggtctcagggatccttttataggggctaggaggcggcgacggaggcccacggcgaccggcagcgagatggaaggttttagggtttggaaagagatgctaaccaaatcggcattgaatccgacgatttccaaacgaattagctcgggtttcctaaagagaaaaggaagaggagatcgaggagattatttcccctcaattgatttggccggagaaggaaggaggcggccggatttggaaggagatcggcggcggcttgcggctacagtcggcggttggtggctggaggaggaagacgacctgacaggtgggtcccacctgtcagcggctgagagagaggagggagggcgcggcggactgggccgaacgggccgggcacgcgcaggccgggggaagggagagagagacttgggccgactttcggcccaaagccaaaagggagattttaaaacctttttctatttaaattattcatgaaatgatattccattgattaaaaatacttccttggctcaaataaattccagaaaaatctaggaactatagaagcaagagaagtatttaacaaaattttatctagcccacttttatattgagatttaacaaattaaaattagatcttctcttttaggcttttaagatcatttctaataattccttttaaacaacaatttataatttaaggatttttaaacaagaaaagcacttaacataattataattagatcattaattgattaactaattactgaactgttctttgtatcatttaggaattgagctctgaaaaatccgagaaaatttcagagggtataattaatcatggagaatttaataaaaattaaatccagccatgctttatatttaggaaattttatttcccacatttaacttcacttgtaaattaatgaacatttaatataaattctaataataatttattaaataatttataaatcctgaaacggaaatcaggctgtgacatcagctaccggataagtcggaaatggtggtcgagatggaaaagactatttgccatggaaaagacccgtagtggtggaaaagacccttagtcgaggagaagatccatgttggtggaaaagactcttggccatgaagaaggcgacttggacaataaagatgccaagagaatattcccagggaccactcaaccactccatctagctggcaccaaaagactataatgacccccataatgtaccaaaatgcccttagggtctgttgatatgcaggggcacgattgtaatttcatgtgggcccaacaaagagcacaattgtaatctcacatgtaaagctgtgtactatatagagcagacaaaagcctgtagcagacaggacatcttggaatactaaaaatcttgtcactcagggtgtgatcatttggtattcgggctcatttctcaggataggcaggaaaagggtgttttcctgtctatccccaatcttgtccgtgaccttgtgtcacgacaaattattttcaggatttttcttgaaattatttgagcattgtaattatttttaacaattcaaagatcatttccatgattaatttaaatggaaaagtaaataaaattcccttttccttttcgggccagtcttcagcccattcttcctctttgcctgcttactgtctccttctttcccgaagaagtctatttcttgtccctcgcctcttttcttttagcccagacaaaagtctgtttcaccttcctatcgctacagtactccttctatctctggacagaacccgagctcctgtgcccactgcccatgcaactcgacgcccccgcttcctctgtagaatccgttgcatcccgtgactcgtttcccaaattggttgaagggatttcttcccttatcctcctctttctttcccctcaagaatcggagcaaatcccatcgtatatcgcttggattcgaagcggagttcatctcctattttcccggcgaaccttaaccaatccgccgccaaatcctcacgggtccgagcctatttcctccacctttgcctataaatagcagtatcaatacctcctcttccgtttctatctttttccagagcttttccctaaccttagccgcctgcccgcgctcgtctcctcgctccgccgccggccgccgctccagtcggtcgtagccgtcgactccgacatctccggtcagcgccgtcgcctccaatgggaccaaagcgaagagtggaagaccggccaccatctgcccgaagccgaagaccccgggaagcccttcgtcgccgttaaggccgagttcgccgtcgcgttttgatcttcggcgaagccccgctgctcctcccgtcgtcgcccagcttcgtcgccacctccgttgggttcgaaaggaggagctgcaccccggccacccctccgttgccgccgctcgttgtcggaaagccgccgtcgccgccgtcccgatctcatcgccgcctctacctcgccgccggccgtcttccgttgtcgttcgtcgtcgtgccgcccctcggtgagctcccgtcgtcgtgctctttcttccggtatcctcgatttgcgccgccgagccctagatcgccggcgatcgttggaagccgagccgcctgtccgtgatgacatcatcgctgacgtcagcgcccgttttccttttctaagataaatcgtaaatccttttctgtatataaggctaaaatcagattaatcttgtaaaattcataactaaatcatatgaagtcagaataaggctgtttaagtctctaaattcatctaaaatcatgatctacatgtttatttagtttatatgtactgtttatttggagtttcttagtctttttcctcgttttgtgtattagctcatcgtttccgttgttgcgaagattcgtgagtgcgtcggaagtgttcaagaagattaattgaagaccgattattgcaaggcaagtcacatagatcccaaacacaactcctttgagcatgttgatcctatatttaaattctctatttatttcaactgtgtatttattttcgaatgtcaccggtggtgtgaacttatacctttgctacggccaatttgcattgattaccttattccttgataccttgggatacaatttgactagttggcctcatataatggttcaattagatatattagtatagttacttagatatgcttagaaacattagtgtggctgtgtttgcaaccccatgttcccagcccctctccatcgttttccgttttccgagcgcacgtttttcaaactactaaacaatgtgttttttgcaaaaagtttctatacgaaagttgcttaaaaaaatcaaattaatccatttttgaaaaaaaatagctaatacttaattaatcatacgctaatggatcgctccattttccgtgcggaggcactatgttcccaagctgaacatgcgaacacagcctaaagcttcactattacctaaagctggatatttaaaggtagctcacgatgatgaatcgtgttatgataatcaattgataattaaaacttgataatggtgggttgtgagcgtatagttttgatggtcgtgctcatgacaattaaggatcggttcgcgagctactgttgtgaaacattaaccatgccaaccacaagctagcatgggtaacggcatttccttttgtatagtataattcattatggggcgccagactgtgaagtggcgagaagtccgtgggggtcgctggggagtccatgcctctggtaattgagggggtgattatgatccaggaacggtgcgttgtggtggattgtgttatgcgaggggtactgtcacagctcctttccgagatatcgtggtggtattgaggcgcatggcaacgtgttgtggggctgtcttgtgggtacagtgatacattgatacatctctggccagagtaaaactattcgaatagccttgcccgtagttatgggcgggtctaacaatgttttcgtgattagtctcacactgatgctataactggtaataatttgcttagatcctggtttggaatggtacattcctggtttggagttagatctgtacagccgggtatggttgttcaggatggttgggcctgtgcagcatgggtgtgctgtacagtgttgattaatattgatgattaattactctactgttttactattctcaaatatttgctaaatgctgcttttgcaaataagccctatattatgccatcctttggtatccttgtgcacttgcatatttgctgtgtggcatgcggagtattccatgtactcaccttgcaataatcaatcaaacctcaattgaggaagttgcgaaggagaagacgtttggcttataccccagttgagctgcctgtgggagtggagctaaagccatcgctagaccgttaatccgctgctgttttcttttcttttgtaagtatgtaatgttattattacgatggatttgtatattaaattatcagtttgtgcacgtcagctgattcctatacgaggattttatgcacaaataagtttagaaattactagtgaattttcgggcgtgacaggagcacactcttcgatcgatggtgggctgagtggaagaagcatttattccatctatcagcctcaatgttcttcacgataatcttcccggactcgatgcctcaggtacacttttctttttgaaaaattctaaccttgagcaaatgtttaatcgatacttgatctcttttccttgttcgcagaccacagactcctcactgccttacactagccaaagtgggaagccgattaactatgctgcagggattatcccaaatggtggtggactagctccttcagtgatcggctatattgcccccaagacaactaatttactatatggacaaactcatgaaccgattccagttgaaacttgtaaaaggaaaagcactaagcaatcggatgtcaagccatcggctgctaaacctcctgccgcctcgaaaaaggtagcaaagaagcaaaagtttgctgccgatgatctacctcctttggatcgtgatgtagaggaggtcctggagaatgaagaaatagaggaggccattgataatgctgctgctggcatgagtgacaccagggccttatccgcaagccctacgggtcgagctgggacacctccagctggtacaccaagtcccaacaagacgccagatgctccaacaccggcccctaaaagtggtggtatgcatctttcttcacattatcatccgattaagtgtgcatcatatgaatttattgccatttttccagcagacgaagaagccaagggctgctaagaagaagaaatccactccgcctccattggtaaccttaaacttgtgttcttactcctattagttgccacaaaaacttaatctcctcccctttttgcctcagcctcctcgatctccatctcctcgtcggctagcatctagtgagcacaccccgtcggctgtggacagtcatcacttgggaacaccagaacatccacctcttgttgtgcctgttagtactattaaatcttctcatatcggctgcgatattttctttgccaataatcccgatttatcttttctccaggtcttggccaatatgttttcctttgacgttaaacagttcctagatgaagaagaagaggaaaccaccagtggagccttggtccctcttgatgatgatctcaagaccaaactcatggatattgctcaacggctagggagttccttggattccttggttactggctgcgggtcaatcagggccaggtttgaagagatccaccaccagatcccagaagatgaagccgacatcatttccctggctgtatatctagagcaacatcgtttcaagctggaaagggcacaacaaagaatagcagacatgcgcgagagagctaaactggaagcaacaatcgaagctaatcggctcttcattaatgaaaaaaaagtcaagcttgatgagatgatcgtcgggctaggctctactcaagtgaacatagatcggctaaaaaccagggaggccgaactagtagctgagcttgaagcgtgccgatttccctagggctattgaagaacaaacgtctaaattgaggaaatccgtcaagcatctctctgaattgagcaagtccttgaaggtgattcctagtgtcacgcccggaaattcactaataatttccgaacttatttgtacaaaaaaccttcgtctaggaatcagccgaggtacacaaactgacaatttaatatacaaatccatcataataataacgttacatacttacaaaagaaaagaaaacagtagcggaattaatggtctagcgatggcttcagctccactcccacaggcagctcaactggggtataagccaaacgtcttctccttcgcaacttgtcttcaactgaggtttgattgattattgtaaagtgagtacatggaatactccgcaagccacacagcaaatatgcaagtgcacaaggataccaaatgatggcataatatagggctcatttgcaaaagcagcatttagcaaacatttaggggtattaaaacagaagagtaattaatcaataacttttaatcaacactgaacagcacacccatgctgctcaggcccaaccatcctgaacaaccatacctggctatacagatctatctccaaaccaggaatgtaccattccaaaccaggagctaatcaaattattaccagttatagcatcatttattatagtgagaagtgtgagactaatcacgaaagacattgttagacccgcccataaccgcgggcacggctattcgaatagttttactctggccagaggtataccactgtacccacaagacacagccccacaacatgtcaccatgcgcctcaataccaccatggtacctcggaaaggagctgtgacagtacccttcgcacaacacaatccaccacagcgcaccattcctggatcataatcacccccttataaacaaggcatggacttcccagcgacccccgtgggcttatctccgtcacttctcagtctggtgccccgcaatgaaccatgctatacaaaggtaaagtcgttgcccatgctggcttgtggttggtacggttaatgtttcacaaccgaaattcgtgaaccggtccttaattgtcatgagcacgaccatcaaaaccatgtgctcacaacccaccattatcaagttttatttggcagttaattaattcacaatcacgattgaccatcgtgagctagcattaaatatccatcattaagtaatagtgaaacattagttatcccaattgtgtgctaatgtttctaagcatggctaagcaattatatctaatatctagctgaacaaatatataagtccaactagtcaaattatcacccaaggtatcaaagaatagagtaagcaatgcagagtggtcataaaaaaggaataggttcacaccacccggtgacattccaaaataaatgcacagttgaaataaatagagaatttaaatataggatcaacatgctcaaaggaattgtgtttaggatctgtgtgacttgccttgcaataatcggtcttcaattaatcttcttggacacttccgacgcactcgcgaacctttgaaacgacggaaacgacaagctaacacgcaaaatgaggaaaaagactaataaaaaccaaataaatagtacataaaagtaaacaaacgtgtagatcataattttagatgaattatgagacttggacggcctcattctgacttcatatgaattagttatgaattttacaagatttaattccaattaaacctattaaacggagactattccaaattaattaaatcatttacaaatgatttataacggagataaaagattaaagcaacctccggaaaagattggatcatatttggtagatgatatatattaaaaagaaataatatgccactgaaaagaggagaggatttatattgattttggacagctgagattaatcttgaccgagtcgactaagatcggatggcttggattgatctggcaagcgagcctcacgagataccgactcaacgagtcaactccacgtgacacgagatcacccaaatgatcaaccgaaaccggcgaacagaaccggcggctctgaacggctctaaactaaaggacgactcaacacagacgaatgaacgaagcacggggaacacctcgttcgaacgaacgagcgaacgactcaacaacggctgcggctaaaccggtcggctagacacgattcacggtaaagccctagtacgacaaacgataggccggtaggaacctagggttgcacctacggctacacaactcgactaaaagcagcggctaagtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagtgatgcatgatagcagcgcggtgacggactgcggctgcgctaagtctaggcctctagggcaacaacgcggcaaagcggcaagcagctgcagctaagcggcttagccggcacacgcgcagcagcggcatggcaagcagctgcggggcaacgcggcaaggcgcgacgccgtagcgactaagcagcggtggctaagaggctcggtagagcgacggcaaaccgcaaccgcacggcgtgcagcagctacgacacagcgacgacgacacacacgtggcttacataaacatctaccctaggaatcggaggaggcctcaccgggaaacggtagcgaacggagaggaagaggtgacggctacgtccgacgacaacacacggagacgatgacgacgctagagccaaacaagattagattagatggaattaagaccttagggataaactacaccggtgaacgacataggagcggcggttactggcgaaccacggcacaataatgcaaacggagggcaccgggaggtagagaaggcgacggcgattcttaccaacacttacacgatgacgggcagcgacggaagatggccagcgatgagctccgaagggcggcgaggtactgatcaacggtggcgacggcgtttcagcgacgggagacaactgaggggtggacgggcttcaccttgctcctgcgaacccaatggagtcgacggcgaccgaaggcgacgacggacgacgacgaacagtgcggctggagacacggcgacgacggcggcgctcgggttcacgacgacgggcaacctccggtgggatttggcgcaaaaaaaccggtggccgaggtagctctcacccttgcgaagccgagggaggcgacggctcaaggcggcactgaccaaaggggcggcgcggctcggctggagatggtggcggcggtggagagagaagacaagcgtggggagagcgattccggcgaccgcggaggacgggacttgaggggataggtagaggacgacgagggggtcctttatataggcacgggagctcgggatcaagcccacatcgacgggaaaaactcgggaaagtttaggatcctcgccggaaaaaggaaagattgatccgcgaaattggaaaggatttccatagaaacttttggggatttcttagggaaattatagaggagattgagaggattccattcccgcaactaatttggaaagaggagcaacgaggaggccggatttggaaggaggagcggcacggctgcacaggctcgggacggctcggctctgtccaggggttgaagacaacactgtagcgagagggaggataaacagacttctatgcgggctgagaggaagggagagaataggagggaatgggctgaatagggcccaagactaggaagaagattttattgcttttccaaataaattaaccaatgagatgatctctcaattgttaaaaatacttccaatgctcaaataattccaagaaaaatcttgaatatacttgaacactctaagtatttaacaatattgaaaccagaccatttaatgattaattcattagttaaataattactgaaatgttctttgtattgttaaaattaggaattgagctccgaaaaatccgagaaaatttcagagagtataattaatcatggagaatttaataaaaattaaattcagccatgatttatatttaggaaattttatttcccacattaacttcacttgtaaattaatgaacatttaatataaattctattaataatatattaaataatttataaatcctgaaacgaaaattcaggctgtgacacctagtaccgatgcagctgacatgcgagttatagacgaaatagaacaaattaggcagcgagctgtatcggccatttataggctcgtatctgggtgaatattcttgtaataggacgacttgggtgacatcattttgctgaatttcctttatatattcgattgtaatgatttccatattcgtcttaactcaaaaagcttcgaaaacccatacgtaaaatttttcaaagatctcagtcccatctgtgtacatatgcccccttaattttgcagtgttgaaaaaaattggcaaaattacattggtctaagggcaatatattcatatatcggccatctaaaggcgatgtaaaaacatcagtatcttatattggcttaaaccaactgatccatagtcctgaaatcttccaagggcgataacacacatatcggccatctagaggtgatgctccacacatcggctatcatgagtcggcacaaacccgccaatcatgcattgacccaaatacttggtaaatatttcttcaagtattttccgttgagtgctcttccgtaaacttctccttcgagaccttgtaacatgtaagctcctttagaaacagacttgtagatccagaaaggtccttcctaattcgatgaccacttgccaaatttattgtcgtgagttcctatcggcaaaatcaacttccaaaccaacttgccttctgtaaaagaattgggcacaactttcttcttataatgacgagcaattatctccttatcctttgttactttttccacaacacgcatcctagactgaaccaactcttttgactcgtccaccatgagattgtgataatcatcggctgttaactcatcttggatagcaatccttctcgagccgatggtactttcccacggtaaaacaacctcatgcccataaacaagcttgtaagtagggacttgaattgatctatgacaagccatccgataagaccacaatgcttcagctaatctggtatgccactgcttaggaaaatcagaaatcttcctcttgatcaacttaatcaaacttttgttagaggcttctgcttacccattagcttgtgcatggtgaggaattgaacaatttaaaccccatgctttttgcaaagatagatccttgatcggttgtaattgtctgtggcacactaaatctatatataatatgttctcaaacaaattggattgcgtccccagaatcaactttcttcaacggaactgcctcaacttattttctaaaatagtcagtagccaccaatataaacttatgtcctttactcgagggtggattaatttagcctatcatatcaatccatcaacctctgaatggccatggtttgattattgtattcattgccgatgctggcgctctctgaatagctccaaatttttgacagccttggcagcctttataatatctgaagcaatcttccaacattgtcggccaaaaatacccaactcaccgaagcagccacttcatcttatgaggcgattggtgagtaccacatataccttcatgtacttcccccatcacaaccttggcttgatcggcactcaacatttgagcaatactctatcaatcgtccgataatacaactcatcatccaatagaacatatttcaaagctttatattgtaatttcctcgaaaccggttgagagggatccttcaaataatcaaatacatgatacctccaatcatcgaccgtaattgtagagacttctatctcaatatctttcaccatcggcttgtatcccgatgcccccctgagccaaatcattagcttctgcattttgctctcgggaaacatgcttcattgtcaccatccgaaaactacccatcaactcttgacacttttcattgtagatcatcaaagtatcgctcttccattcatattccccagccaattggctagtgaccaacaaagaatcgcccatgatttcaacagcatcgacttcaacctcttttagcaactgtaatcccttaagaactgcttcgtacttggcctgattattagttgcataaggtttaatagtataggcaaactcgaaactagccccctaggcgatatgactaccaagccgataccacaaccatgagtgcaaaccgatccatcaaaaaccaatgtccaaggccctatatcaaccaggctgtttgaatcattacgatgctcaacaatgaaatcggctatagcttgccccttaattgccttaggtgattcatctatgagatcaaactctgtcaagtcaaaaatccattttccaactccccccttcaacactggggccgatagcatgtattttacaacatcggccttgcaaactatagtgcattcattggataacaaataatgcctcaatttcgccacttagtttttaatcaagtgctctagtattaggactctggataaagaaagaagtttctacgcgatgatagagtagtaattaataacttagacgtggtgtctaggttagcctgttaccttcgtttgttgtgtgctccacagaaagtgaggtaggtagcgggtggtgacagccatgtccgtcctttgtatccctccatgtttggatacatcaaatagctcaacgccaattttttgtaagattctttagtggatttggtaaggaaagaaattgatcactcgatggaagcctatccagaaaagaccgagtttaagaaggaatcatgaagactatggtatgacaatttagttctatctattaattagacaggatttaataattttccgctacaatctttaggaagttttgtctagtgtccgatcaggacttgtattgttccttctatctttaggaaacttgtgtcgtgcccgatatagaacttgtatctacccgtgggtataaatatgtccacccagggtcattgtaatttatctcacaaatcaatgcaactactctcggcgcatcgccaccctcttttctatggtttttatcaccagcgtaacttgtcacctgacgcacggctacatcacttcgatctccatcgaaggggtgagccctaagttccactggccaggcaattgatctgctatattggcgttgtttaaggctacatcgttttgctctcttggattgctttggtttggttggtatacttgtctatccgacatttcaattctatctttaattgcattgtgtctagagaggcatcgatttagttgggattatctcggtgttgacggtccttaaatcataatatctgaccgtcaatacctgcatataatgaactaaaatatggtattcaacttagtggtagggattattattaatcatttccactagtattggtgaaatatgtgtatgcaggtattttaaggagaaaacagacccgtcatgcgacaaaatgaacctccgcacattcaggagtttacatggactggagggcccatatgtcaatgaaaaccatttaggggccaaaacatagtatatgatgttgggggcccattaagctacctcccagccgcctctgggaggagggttttctgagttcggccgaacccattttgtggtcattgatcgtcatcttccacgtgtacgctcctgatcacttcccactggcggttgcggggcatttccgacaattcccatcaatgtaaccatcatttggagcctataaaaggaggagctcactctcatttccaacacacaactttgagctgaactacaagatgctctattgtatcttttgttcattagaataaggtagagagtgaggggaagctctggaggggtgcccggaagaagttttccttctaggagtaattctggaggagtaccggagctgtcgatacactctgctctgggttcggagaaacttcttctgttaagtaagcatttgtgttcatttttatgttatttaattacttagtctaagtaaaatatatttcactctttgcgggttcattgtttagtattcttactaagttctctagtaccaggactccggataaagaaggaagttcatgtacaagtactagagtagtaattaataacttagacgtgatgtctagcttagagattagcttttttaattgtgtatcccatggatttgtcagaggtaggcggcaggtggcgacagccctgaatcccgtcccagtaatcctccacgtttggatacatcatagagctatagccggaactacgctggcagaccagtaggggtcggtgcccgaagcaacagataggaaattacctttaacttagcgtagataattaaaatacatagaaagtcatctctagcctagctagcctacctatagttgttgtccttagatagtcttagtcttaggtagattacacacattctttgagtttgatatccttttggagtcatccgaaggtgaactgctatagcggtattccgtgcgcttgcggatttatctgtggtcataagaaataccaacaagcatttctggcgccgttgccggggaacggttgctaatttgttcgagtctaggtcatcctcgtatctttatttttatttcttcttctcttatttctttccttgatggagcaacccacaattcaaaccctttctgctccttgggctgatctttgtgagccgtcctgttcttcaaaaccaatcctttcggatggctacgaaatcggtcctggctttatagccatgatttgagagcaaaccttctctggtagtattggtgaaaacccgtacttccatcttcgggactttgagctagtgtgttcatgtctatccatcataggcatgacacatggaactctcaagtggaagttgtttcctttttctcatagagataaagcgaagcaatggtacattatttctgtcaataatgtgaatggtacattaaattccacggtgaatgggaggagctaaagtgcaaattctgccttgctttctttccattaacccgtgtaattaatcttcgattagacatcctctctttccgacagaatgagaaggaatctctcggtttagcctgggccagattctcattgttaactcaatctggcccagacttgtctttaccagaccatgtgttgttataacattttcggtacgggttagacaaggagtctgccgcaaatctctgtatttccgccgcaggatcgttcgcacacaagagaaccgccgaaggaagagaactcctagatctcatcttagagagcgattctttctgccgcagcgaagtcgtcctggaggtcgagattacccatgaggaacgtctgcacgtggagtcggaacccgactcaactgtcgaatcctcattccagttgctggagccggaagaagaagaaattcatcctccgaaaattccattctaattcagggataatctttatgaagatcatggaaacaccctgaattattccagcaatacaaaggctcatcccaagcatgagccgttcgagggggtgatgtttgtatcttcgtttgtttcttctgaacctattgtccgtcttcatgaaatgaacgacccttatcaccttcgatcaagcctaaccttgtccttctggccctcagaacgttgttcttgtttatcatcaagacataacccagttcttgcacgatgcatctcttgagaaggaaaactttcaggccgcggacaagcttgagacatcgactctggaggacgagagaaaacattccacatatgagcatgagagtttctctttcaaaatcccccaggattcatgctcacataaagaatccccagagtcctgtttggttagtaccacttccctgtgcgaggaccactccacctttcggtcctcatttctaacgtgtttagaaggatggttgtggatgcttatatttatcataaatactacaaatatcgtatttgtggcactaatcttgcagcataatgtccccatggtcaagcttgtgaccataaacaaagcactgtggggaggtaacccggattgctatggtaagtttcccttctaataaaagcaagaaccaatttttaggataatatgcaccttcgggtattcttggtcgctaaacattgcaagttgagattaagaacgagagtcatcagatgcctaagaacacggtagctacatcaattacacactttggtgatccttggtattggaacaaactctataggagactccaacattacacacttggtttttgatgtcttgtgacacacaagtccaagtgtgggggtgaatgtcgatgagcttgtcataacgagttccatcaaccaaggccaccttggtttgaagttggggttagtcctagcttgataaaaaaaagaaaaaaaagaaaaaaaaagaggagaaatgagagacggaaggagaaaaaaaaagatgggagaagaggaagagagctgatgagctatatctatctacacccagtccctctcttgagctcatgtgccgccttggctaagcctttatccactcctagccatgcgcaatttctcgctcccgcagcacatacgggcatacaagcaggaggagattcttcttcatttctaggcgtttgcgtttgctgccccactctagttgacacttgcacatttgctcgaaaagagatgcatcctacgcattgtgccaacggatcatgccttcaagaaacaaggttcttgcacacgagctgtgtgcataactagaccgctcgctggagttggagtgatcaaagtgccttcctccgctacaatccgcattgagatggaggagaaatcgacaatcatatgtgaccatgccactgccccagagatttcaaaatatccatcatgctggcggtaagtacactcaggtatgcgaaagataaaacaaggttcaccaaacctttactcaatagtaccaccatgtgaatatggcttgatcatacatgattatgtttcctttgtctattttcatatactcaggtttgggtgttttcgtgagacatcgataggctttttaaattaagcatggtgcttaggttaaactagtctgctttaatcgaattagacatggagtcgagtttgattaatgaactcttagagttaatatgttcatggacattagatatatatcttccatagactaaccccttcaggaaagttttcaaattcattggtaattcgtcaagttcaattcacactggaggaaagtcaggctcgggaaacaaatcagtaaattgctacatgtaaaggatgaacacagtgcacgataagtatattgtcaaatgttcctttgtcatgttcgtgcaattttatcttaagccttgtatgagttttgcttaaacgaaaatttggtgaataataaaaattttgaaaaaaaatgtgtttttagaataaaaaagagagtgtctcttgaaaaataaaataaaaagttgacaaacttatgggatccacgcttcttaagttttgaatccaatttccttttagcgtggatgtgaacaactaaactcgaggctacgataaaatctttgcaattcttatagtccctcgggtatttcttgttcactaaccttttgcagataataaaatgacaatcaaggagcagtgtacaataacttcaaacacttatatcacgctccttggtccatgggaaagagatgcacagggaaccaaacagaacaaatgcaaaacattttacattcagttgaggtttaagcttggtaaatatctatctggtaagaatcttcaacaccttgtgcatcctcatccaatgttttcattctgccatgatacccaccatatccatcgttcccataaaaaaagagacaaaataaaacaaaataaatgtggctccttggtcttccaaccaagtgagtcatttttgctttactcgtgtctttgtttttctttttgtgtccaataaagagtcccaagtacaaaaacaagtgtgggggtgatcttgcacatcaatgccgtaaccaaagcaagatcaccccaaaagtgatgagccatgacaaaccacacaaggggaattgatgtagtcagatccaatgaggggtcaaccaaacctccagttcggctgaaccacctctaccatgaatcgtcttctgtttcatacagagcgcaggtttgcacaatttttcctttggacatccattctatcctgagttcaatttgattatcaattctaaaatattgaagataattgaactcaagctagggacagtacaattagagtttatggtctccctgaaaataacatgcatgcctattattcttagctcgttacttgttgcttgtggtgacatatccaatagggaccccatgttatctaggtaattgatgaatgagatatagtctgatgatagaaatcctactctttatattgcacacttgggaattttatgaaaaggaaaaaaatatataacgatgctaaactcctcattgatatttttattcccattagagccataggttgatcattcatgattagcttgctatatacgctgcttgtcattacattgagcattgtcaagttttgtgactcgtgcgaaatgcttttcatactttcatggtcaagatcgcatacactccacatacatgtacctatgcttgacttctacactggaagttaagtattctt

SEQ ID NO: 46579 - DNA, 6462 bp, Oryza sativa
  unsure (1)..(6462): unsure at all n locations
catacaagtatggagcatgatgatgaaaaaaagagaaaaagaaaaaaaaagagatagccatgcactctcccaaatttcaaaagagaaaataaatggaggagatatacaaaaggagttattgttattagtatttccccttttccacccacaaatttaccatacacatacacatgcacattcttgacggccagaaagtatgtcttgtatttccgtggatccattatttgacttttgcaatatatgtgatacaagtaatgctctactcttttccacaccctgagctccacataaacattattagatagtaggaaaagaaaaggcacaatcatatgcctttgtgaggaatcatacacttagagcgatcgagagaatcaatggaggagcacggcaaagttataattttgtgttacttgaaaaaccccaattcgttcttcatgaaaagttaaggtgacttgagtcaagattttttcatttctcaattgcccagtatcgcatggtagacactagaaagacccacaagtacatgtatggctttgaataatttgtttgcatgattattagtaaggaagtcataactctattgtagagtccatagccttcactccggacgagcaaaggttaagtgtgtgggtgttttgacggtccttaaatcataatatctgactgtcaataccttcatataatgaactaaaatatggtatccaacttagtggtagggattattactaatcatttccactagtgttggtgaaatatgtgtatgcaggtatttaaggagaaaacagactcgtcatgcgacaaaatgaacctttgcacattccggacgtgtttacactgattggagggcccatatgtcaatgaaaactgcttagaattgggccaaaacatagtatatgatgttgggggcccattaagctacctcccagccgaagaggcggccgggaggagggttttccggttcggccgaaccaccagttcggctgaacccattttatggccgttgatcgccatcttccacgtgtacgctcctgatcacttcccaatggctgttgtggggcatttccgacaattcccatcaatgtaaccttcatttggagcctataaaaggaggagctcactctcatttccaacacacaactttgagctgaattacaagaggctctattgtatcttttgtgcattagaataagagtaaattgcatcactggtacacgaacttattaggtgggtgcaatctagtgcacgaacttgttaaatgctcgttttggtgcatgaacttgtctggtgtgtgtggagaaaggcgaaaagaatactatatggctaatcttattgatttaggggccgattaggatactatgtaaacatatatctgagaaggtttctattagacatacacctctttagtaaaaatagaatggatatactgatcgtagaaaaagattaaagaaaccgagcaatgatataagggttagaaatatatgaaattcatcgtttccatggtgaaggataaagtagagatcaaatttataaatattgcatgtcttatgaatactcactacacgtctgtatgtcacatcctaatcaacatctgcttcataaaattaacattgccaagctattttagtctcattcgcacaaactagacaagttcgtgtgccgaaacgagcattttacaagtttatgtactaaataagctctggaggggtgcccggaagtttggcgctccctccaacttctttctcgacgagtgtagctttctaggaggaattctggaggagtaccggagctgtcggtacactctgctccgggttcggagaaacttctattaagtaagcattcgtgttcctttcttatgttatttaattacttagtctaaataagatatatttcccctttgcgggttcattgtttagtattcgtactaagtgctctagtactaggactctaaataaagaaggaagttcctgtacaagtactatagtagtaattaataacttagatgtggtgtctaggttagagattacctttgtttgttgtgtaacccacggatttgttagaggtaggcggcaggtggtgacagccctgaatctcatcccagtaatcctccatgttcggatacatcataaagctatagctgaaaccacactggcagactagcaggggtcggtgcccgaagcagcagataggaaattacctttaacttagcgtagataattaaaacacatagaaagtcttctctagcctagctagcaaagtagcagataggaaattacctttaacttagcgtagataattaaaacacatagaaagtcttctctagcctagccagcaacctatagttattgtccttggatagtcttagccttaggtagattacacatgttccctgagttcaatatccttttggggtcatccgaaggtgaagtgctatagcggtattccatgcgctttcggatttatctatagtcataagaaataccaacactcggttaggtccgatcatctatcttagtcaatatacctatacaatcacaatgttgtttagatacatttgttatatccatcactttatacatgatttatcgacattattgggtttactcgttgctataaacttaatgctgtatcggtttagtctgatctagccaggtaactcatgtatactgttttatcggtgtgctagtcgataagttatctttacaacggattttccagccaatgtatgctttaaccatggagcttacatttaatattttgtatcaatatcggccgattggttcattagacatctacttcatcatattatcatcggccgattggattgtttgttcaagttcttccattgtatttatctaagtgtcagaatctacatcgactagtgtcgacattggctattatcgctacatcggcttattggccgatcggctctatgatcatcaatttatttatctaactgacacgctcgcatctcatcaaaaatttaggacctgcactgaagctaaacagatttcccaggccttcgtgtttttggcatcaacagtgcctgaagcatttggtagagttttagctttaacttaagttagctagttgaatccataggaatcctctctagcctatcctatcattagttgttgtccttggttgaatcccattcttatatatacacgcatgttccttgcaattcaatacccttagaatactctgaggtgaagtgctacagtgatatacgtgcgcttgcggatttatatgtgactgtatcaagtaccaataaggagacagcnnnnnnnnnnnnnnnnnnnnnnnnnnnttaagccctcggcaggcacacgaccgagccacccgacgcgtcgtcgccacacggcaccgatgctcgcgcttcgccgctgcacggccacgtgctcaccgttaccacatggccgcaccgcacagccctgtcgtgacatcctgtccatccaccgtccgtcaccccgccgcatggctgcgccgccattatttggccacgctaccggctctgcaccactctagccgctgcgcctccccggccatgtgtcgagccaacaggaagaagaagaaaaggaaagagaaccggaaaagaaaggaaagaaaggggaaaaaaatgaaagaatcttctggttttgcaaaaaggtcgtggcagttttgggaaattaagcgcatatttttcagcagtggaaattttgcgattaaaacccaagagctttatgaaaatgtatatacaccctagaaatttgcaaaatcaatgaaaaagcatattatcgcataatagagccacgtgattttgaatttgatcccgaccttgcaagttgaggcacttttattgttgatgtttatgattaagaaatttatttattgtatttatgattattgattatttgtaatgcttttattacctttaattaatatttttaaggtaaaatgtatagatttgcatagaatatattggaattatttgcgggaattgatgtcgtaggctctccagatcttacattatatttcagagatgaagtgaataaatcaattcatcaaacaagcataataaagtatttgatgcctcaagagaagaatattagagacattgctgggcctttagcctaccagtcaacttcagcctgagatgtgctcgtcaaaccactcgaaggcggcgaccagatgtgttacacattcagtagacttgacaaaatggctaaagatctacaacatgtcaaatattcttaactcatactcatgtgaatctagttcccaggatgtgcactagattcacactttcatcttaagcatggaaatacatagcaagatacatttaagacgaaagtgatcacaaattacaactacttaatagatacatgggccgaccgaccaaatatagatatatcagagaacagcggaagcttgactacccaaacacaagcacaccgactaggggtttacccccaataagttcaagtcctagaagaagcagtcgaaaaacccgcattactcaacttaatctaaacatacaacctgcacaaatagatatttcaacatagcaggagtcagtacattatttctattcaaaggagcgcaatatgcagttcaattttagcataaatcaagttttgtttcacaatacttttgtaaaggagttgatgattcaattaatcaaaacatttttgtaagttcataataaatatcattatatcatcataagcatactcttgttgtcttccttgacaacaagtcatataatcatcatcacactcacacaactcaatacatttcacccattccaaatccaagtttcataacacattttaaaacataagtctatactcatgacactttaccaagcactcatgaccgtgagcatggctaattgattagtttttagactctgcagagtttgtatagctttatccacatgaggtgaatcgctctagtttgtctggtagccatcggtaccaccacactttacatattgagtgggtttacaggtcacaacgaggcttttacattaagtattgtataatccttgcataagcatgatgactgttgtttcacactaagttgtcacagcctgattttccgtatcaggatttataaattatttaataaattattaatagaatttatattaaatgttcattaatttacaagtgaagttaaatgtgggaaataaaatttcctaaatgttgtcgaatggacaacaatgccacatcgaaaggcgtgattctctcaacagtagttggaatgtaaaagcaattgtattgattcgtaaatttttttggggatccccccattacatggccctagaggtctatttatagccttagcacaagcctggaccttctagggtttagggttacagaggatttaacatggttgcccttatgaaacagacatttacatgggtatgcagtgtcatttgcacatatgggcctttaatgggctgataggctgctggtctatagcaaacaggcctaaaaggccgggggcggcctgttgggcctccttgatgccgaacttgtcatggcaaagtctttgtagttcgcccgagatgcctttactttcggagtaccgatgcggctttccagccttcgccatcttcgcttattgctttcaccataaggcttgcctgaatggtcttgacggctttggcttgaatccttgctggtactatggtttcggcaggtccggccgaagggcttcatggcatgcctccaacaagcccctcacgggcaagggtgagtaaggagcttcggccgagaccgtgcaaactatacggtatggcttgaggctccccctttcggccgatgttcctgtcgaaacctctttttagactcctgcagaaaaaatatgaacactggtgttcgcctttcgagaatggtgaagctgtattatgacactgggtgattatattttgccaagtttgtctgctttgcgtgattcttaacttgtattttttttctttcccttttttccctattgttttagcggggatttcgccgaaagtcatgtgttcagccccctttcggggattggcgaaaagatttgttgacttttcagctttcgacttccattttcgactcgtagcattttgcgctgggaaaaacgcttatgttttgcgtaagttgaatgtaacggtgtttggtatctttattccgaaacaagctgtcgcggtttcaaagttcggcgagcgatgcttctgccgattcgtttcgccccccctggtgttttcatcgatcaagcgttcgccttttatgtagctatgtggttgtcaaaatggcgaattggaggtgaagacatcctggtcgaaccttagaggattacgaccggtgccacatccagcgccgcgatgacattgccacactttggttagacttcgaaatgactaatcgtcaagctgctttcgcttgacgtcggtgtgtatttcgcctccttccccccttaaagtcgtgtatagtatag

SEQ ID NO: 46580 - DNA, 7486 bp, Oryza sativa
atatgcgtccagaaacgcttaagtatttgcataagtcaagtgtagcgatgatcggtatgttttccaaaaacgagctgtcgcggtttcaacgttcggcgagttgtgcttcggccgattcgtatcgcccccgtggcgtttttgtcgatcaaacgtttaccttggggtttttccaaaaatatcatacacaaaaaaggcgaagacacccatgaattttatatgactgagcgtcagtttgcaattgcccagcctcgacgcagcataatcctcgtttttccttcttcaccgctttaaattttttttgtgttgatctaacaactagcgatgaagaagatgctcaagggggtagtcctttgccattgaggactgcttttgctgatgaatcggatgtaaagtccgaatccattttggcgggcaatggaatttatctataacttgtgctttttggcaaataaatggggtgtggtgcgtgttgcggctgttcggctcgtactttcccctttttgcctttggcaaaggtatttttaggtactttaatcgttttgaccgttgccgcctttcggtctttttagtactttgacctttttaattgttaccggctttcggtcttttctttagtgctgctagggttttgcctttcatccctttcggctgccccgtttgtctacgggtgtgcaaccgatgcgaactcgatttcaagttttagcccctcgcacatttcattggacttctcggagtcaaaccgcttgttattgccggtaatgaactctttcggaacactgaatcggcagaaaatgtttttccgaacagatttttacactagtgccgaaggtactgccttagcccatcgaaggcggcttgacactcaggtgtccaattgagtttgccggccccttggaccatcttgaaaaatgataaatctctttcggctactcttgggagcaactccttatctcattttcgcccccagcccttgtcgccgtaactcgctggtactgtggcgaaaggcgtgggtgtggcgaaacctcttcgcccgcagcccttgacgccgtgccttattggcactatggcgaagggcgtgggtgggcgaaacctcttcgcccgcagcccttgacgccgtgccttattggcactatggcgaagggcgtgggtgtggcgaaacctcttcgcccacagcccttgacgccgtgccttattggcactatggcgaagggcgtggcgtgtggcgaaaggtgtccagagccttgggcggcttcgaagccccccagcttggacttaactcactttcgcctctagcccttgtcgccgtacctcgcgggtactgtgacgaaagggtgtgagtgtggcgaaaggtgtcccatttcgccgtttcggcctggattccccacggacggcgccagctgttgtcgaatggacaacaatgccacgtcgaaaggcgtggttctctcaacagtagttggaatgtaaaagcaattgtattgattcgtaaaattttttggggatccccccattacatggccctagaggtctatttatagccttagcataagcttggaccttctagggtttagggttacaaaggattttacatggttgcccttatgaaagggacatttacatgggtatgcagtgtcatttgcacatatgggcctttaatgggctgataggctgggcctggtctatagcaaacgggcctaaaaggggcggcctattgggcctccttgatgccgaacttgtcatggcgaagtctttgtagttcgcccgagatgccttcgcccgagatgcctttactttcggagtaccgacgcggctttcctgcctacgccatcttcgcttatggctttcgccataaggcttcgcctaaatggtcttgacggctttggcttgaatccttgctggtactatggtttcggcaggtccggtcgaagggcttcatggcatgcctccaacactaaacataaagcatggctggatttaatttttattaaattctccatgattaattatactctctgaaattttctcgaatttttcagagctcaattcctaattttaataatacaaagaacagttcagtaattagttaatcgataaattaatcattaatgatctagttataattatgttaaatgcttttcttgtttaaaaatccttaaattataaattgttgtttaaaaggaattattagaaataatcttaaaagcctaaaagagaagatctaattttaatttgctaaatctcaatataaaagtgagctaaataaaattttgttaagtacttctcttgtttctatagttcctatatgtttctaggatttatttgagcaaaggaagtatttttaataaacggaatatcatttcatgaataatttaaatagaaaaaggttttaaatctctcttttggctttgggccgaaagtcagcctaagtctctctctcccttccccttggcctgctcgtgctcggcccaagccggcccataccgccgcgcccctccctcctctctccctttcactgacaggtggggcccacctgtcagtcgtcttcaacctccggccgctcctagccgcgccgcaagccgccgcctccttccaaattcggccgcttccttccttctccggccgaattgatagaggggaaattatccacgggatctcctctttcctttctctttaggaatcttcggctaattttgtttggaaatcattggattcgagctcgattcggatcatctctctccccctaaccctagaccttccatctacttgccgccggccatgggcctccatcgccgcctcttagcccctataaaaggacccccgggacctcctcttttcgccgccaccttcgccctagcccgccatcgcttgtagcgctgcctccgcgtcaacccttgcgccgccattgccgccgcaagtccagccaagcgccgccgctgctccagtcgtcgccgtcgctcaggaaggccgtcgccaggttcgcaaggtcgccgtcgtccttgtcccgtcctccgtttccgccgaagactaccggagcgctgccaccatcgacgacccgaagaccgccgccgcctcgacctcgccgccgtcatcaatcgtcgccgtccgtcgtcatccaaaccgctggtgagttcgccgagccgagctttacgcgtagatgccctccgtttgcaccgccgcgccatcgtttgccgacgagcatagtgtgccgagccgccgccggcgatgacatcatctctgatgtcagcgctttgtcagccgtagaccgtggtagaccggatcgatctcggccgttcgattcggtcaagtttaggtcaattagatcttggccgttggtttcgtggaccgcttctgtgaacctggtttaccgtggacggtctttgatgatgcaataaatcctttttcttttcaaaataattctttattgcgtcataattcaattaaaacccatataaatgctttaatgcggtttaatctttagaaattcataactaattcattgtaactcggtttaatgtggttcaagttgcaaaagttgtataaaataaagatctacatattaaagttatccataaattgtgttaaatttatttaatcctttttaaataagctttaattaggttaaatcttgtaaaatttgtaattaatttatatgaaatcggaatgaggccgttcaagtctctaaattcatctaaaatcatgatctacatgtttgtttactttatgtgtactgtttatttggtttttattagtcttttttctcgttttgcgtgttagcttgtcgtttccgtcgtttcgaaagttcacgagtgcgtcagaagtattcaagaagattaactgaagaccctttattgcaaggcaagtcacacagattccaaacacaattcctttgagcatgttgatcctatatttaaattctctatttatttcaactgtgcatttattttcgaatgtcaccgggtggtgtgaacctgtttctttgttatggccaatttgcattgattaccctatttcttgattacctcgggttataagttgactagttggatttatatattggttcaactagatatattagatgtaattgcttagccatgcttagaaacattagcacacgattgggataactaatatttcactattacttaatgatggatatttaatgatagctcacgatggttaatcgtgattggttaattaattaattaatttgccaactaaaacttgataaaagtgggttgtgagcacatggttttgatggtcgtgctcatgataattaaggaccggttcacgagtttcggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaacagtgcgctgtggtggattgtgttatgcgaggggtactgtcacagttcctttccgaggtaccgtggtggtattgaggcgcatggtggcatgtcgtggggctgtatcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatggtacattcctagtttggagatagatctgtacagccgggtatggttgttcaggatggttgggcctgtgcagcatgggtgtgctgttcagtgttgattaatattgatgattaattaatttactgttttataattctcaaatgttggtcattctaactgaagaggtcagtgacaataatcaaaattagtatctcttgcgttgctattaccatatgagaatgtgtatctcaacctttgcgaatgttgctatttcagttcatagatttcatcctatagaaatagttgtttgcagaaaaaaattaccgtttccaatggctactattacatttatctctaacgccttcatgtgtagctctccatttctacctagataatcccgcagcaacgcgcagggtattatctagttacttataattgtcagagcccaagcaggggttaaatataatataatatctagcatttcaatctctctttggtatctctatgttactctcagaaatgagtactctaaacgaatgagcacattgacactctttttactacacgaaagattatggtgcacaccatacctctcatagagcaagaatgggtattttcaactatgattcacttataaaaatgacctagagagtacagtaatacggtgcaccaaatttgcaccgaatattgtggaaactcttgatgttctatctaaacatgacgaaagtcgcacgcaagtatcattagtacgcatgcaagaagtatgcctagctagttgataataaaattgtgtaacatataggatagtgtttactagaagagtattgtcttcccaaaccacctagtgtatttacctcaacgaaagaaaaggaaaagtgggagtattacatagttcaaggtgaacaatccacaaccatgtactcatgaatacaaaaagaaaatgatgatcctaatagcatacccatcatgaattgagggggataactcctaccctatttgcatggctaaggatgtagaatctctcatactagaccgcatacgtcctaaaaatttatatcagaatagaaaatctttgccatagttgccaagcaagaagctcgctatgaagttaattaaatgcgacgtatcggaatactttgttgaatcaatctactttgtcatcatttgttgtaattttttagtagaatattgaattgaataaatggttttatccaagtagagcatacacttttccctacaacgaacggttatttctagtataaattagcatatttaaggtatttactattttgttgctattttctagcacatggttataatgctttgaattttgtgtagcactcaaacataaaaaaaaggaatgaattgtggaacgcataaccacaaatagcactttaagataaaaaggtatttccagaagcataaaactggaaatataatgactattgctagaagcaacaactaaatttgttggcctagaaagcatcacagtcatattacctatggagcaattatgcactttgtagaagaattgattgtacaattaaccctcttgaactctctaaaagtgtgacgatttgggctacactatcttttagcaatagatttttggtcatattggtcttagaattataagaatagacattacaactcgtatagttatagcacatatatgcataatttcctaaatcatgaatatttatgtgccagtatgccccaacaggagattaatgcatagaccacataccatgaatgtataattataacatcgaattggattgcatggaatacttaccatcctatttttggtactatatggatagagacgcttctcaagtagtgaacatccaatgcctattcgacaccatatatttgccaagattgatccatcaagagcatataaatttgaacaaatttcactaatcatctttagaagtacacaaggacaatgctagaatagcatttgatgattagtgaactagcagcatgaagtaccaaatatctgcatgaacggactaaatataaactatgaattgtaatacttgctatgtcattgttataatacctgcagtatgaatggacatgtagtcttgaaatcagcggattctgaaagaaaattcagaccattagcatgaacatctgctctgcaactagtactattgcatttactttatttgtgtgcatattccactatcatagtgcattgcaaaagactctctccgaaagtcaaaaactttgaatgaaaatagttatgaagcctaaattccttaactatatgtatcattgatggtggacccaaatcacacggatgaaatgcatggagatcgagctatatgtatcacttgttctctccatgcacatattgatatattcatatataatattttcatgtgattgacatatgcatgtgagactaatgttttgtttgagtcttatcgcttgtttagtctatttacgttgaggacgtggagatgatgaaggtatgcatttattttaatatctatatttgataaatgccttctatttttgtataggaaaagctcccaatgtttcatctctatttatgcatactcttgcttcacacaaatattccgtatgcatacatttagggggagcaaatcctataccttagttatgcatgtatttgatctaagttattcactttaatttaattgggatctttatatttgagtatatgacacttgtggtgttgattaatactcatcacttatccatattcttttatatacgtgattggttgggggctgcaggaa

SEQ ID NO: 46581 - DNA, 2482 bp, Oryza sativa
ttggtcaacatgtgaaggttgacaaccagatcattgggactaataattttattgagttgaataagagaaataggtcccaaggattacaaaggtgttgatgctcatgtgatatcattacacctaaaattaacaagaatgacaaagtggagatattgaagatgtgggatacgaaatggctactatggcaagacggtgaagggcaagcgatgctcggtcacgatggaccatgcggcggtgaagggcaagcaaggggcttggcgccgaagaaccaaatccggtggtgaagggcgagtgacggctttgtcatgatggatcgtgcgaggccatttgaagctacaagtaaccgcatcaatcatttgaagactatatggtgaaacggtttcggcattgcgtcccttaagacaatgaaagaaagatggaaagaaggcatttctattggtataatttttttcatatttacatttgagtttaggaatgctgtactattaaaagggatgcaacgtcgaggtgtttgtgtatgtctcggtactcaaagtgacctatcatagtgctaccttgagagaaacccaagctttaacctatccttttgagtggttttagaccttgttcttggttgagttgcgtagtcctctaagtgagctttgcatagagtctaagatcatcaaaaacggactcccgagcaaaaagttatggtcattttactctgtgctttccggaagttccgaaaaattattggaagttccgaaaattccagtctttgcctccaacagctagttttttaggggctcgggtatataaactcctccatccctcctttgagtggctgctgttcttgtacagtattagacacatccaaagccaaatagccatccccatttccctacctttatggtgtctctttgtgagagggatttgagaaggggagagagttggattgagagattgagaagttgagagctagtgagcttcactctatactttgagcactcaagttcatagcaagcaaatcttcgattgtatttgttactcttggtaaggtctcctagacggctaggcatcgccggtgagcacccaaggttgtggtgtgccacggaaagtttgtgaaggcttcgatttcgcctccgcaagggaagaaatcaagagtgaaaccgaggagtgcatttgtgcaacctcatgaggaaagggttgaaataggcccggcccttgtggctcctcaacggagacgtaggattcgtggatctgaactttgggaagcaaatcatgcgtctcctctcttggtttgcccattcttgcattctcttatattgtgcttgagcttgcttttacccgatctacttgcatacttaattgatttagttggtgaacttatatcttgcttagatatcttatttgtcaccttttgattcatatacattttgtttgtttgaggtacaagttcatagctagtgttttattccgttgtccgcctaacttttcggttgagaccggaacttcgaatcccataccggaagttccgatttgaatcgaaagttctcatcattccaatatgctattaagttgtgataatttttaggaacgcctattcacccctctctaggcgacatcaaggtcctttcaattacaccagaagtgtacgaaaagaattgaaactactaaatcactttatgattacttttgtgattgtgaagagtttgactagttgcataattgaaatgcaccgaaggagggtgaaataccgaagaaagtaaagctatccctcatcttgtctagaggccccaggtaaaaataataggacaagaaactccgactcttcacaccacctaagtaacttgagactgttggtatttcttaacgacattactagaaatataattcccagcaatggtgcagaaatactcctggtatattatggttacagaattcatccgcaagcgcacggatataccattgtagcatttcaccccgagagtattccaagggtatcgtatttattttatcccgtgggaagatcatgtagagagagcttgactaataatttatatgttacttgtgataatcatattctaagcaggggttaagataatccaatggtagaatgacacacaagcattattactcattctcataatatattatcttagcttagtggaaagaaaagagaaagaaaatctattcctatacgtctaatacacatagcatatatacattctagttaactggtatactagctaataccctctatctgatgccctcctggtacttcaagaagccacccctgactgccgagttccttacaaaagcccatcatgaccatacaaccggggctaaatacggaggaataccctccccaagaaattaacttaggattatataccggcgcggaggaatacccgtactgagttgtcaccatcagcggcccacctctcatccgcaatatataaccccaaataatgatatcccgtaatctagacaccacgcctaa

SEQ ID NO: 46582 - DNA, 14617 bp, Oryza sativa
  unsure (1)..(14617): unsure at all n locations
tcctattccaccagctagatactactaaactaaacttgagagaaatgagagagctattgcttgaggtgtgtgttgaagtgaagagagtgaactccttaaataggcaggtaatgacggttatggcggttggaaaggtcggtaataccctccaatggccatagggagtgaatctccaccgttccctcaaaaccctacatccatcggcgctggcataggttcggccgaaccctaggctggcccaaccagcccacaagttggctggtggcctccttaggtgttcctcttcatagacttggcccagtgtgtcgtgtcatttttgagttcttggcccattcatacataagtctggttctcgacatcgtccgattgatttatcgtttgtgttgatgtcgattctcctccactttattgtcattctctacaaaaggttattaaacctaatactagtggaatattattgttctaacatatttatgcattgcaagcatcactagttctcctctattttggtaatattgacggtcgaaattgattgataacgaccgtcaacaaaaccccccaagcttaaacctttgctcgtcccgagtgaaggacgaaaggaaacaaggacttgcttgttgatcaggagttgcaactatgctgcatatctcaaagacacaggtgcaaggtatatatactctctctcagattaaataatctttggcacggtggcttacccttacccctgattcccacgagacgctgcttctccttgccttgagaagttgaaagatagaatagcaagttagagtaccaatcacccaatctttattcaactcttattccggaagttttcaaatgattttgcaaaagaaagccaagttcctcaaatgattcactcagtctctccaagtgtatcaatttgaattcctcaccaaattgttgccttttttattcctactctaaggttttatatgtggagctcggtagggatcaaacatggcatacttgcattcacatttattactaagtcaaaaacttagactaaagcagataactaaacatactcaagatcaagatcgtgcaaaatgtgtgtgtggtatatggtggaaatggtacatgaagaaaaataaagaaaatgcttctcctttgtgcttactttcttctcccaaaaatccttcttttattgcttaggagagggcatggctacattttttttatttcaacatcatgctcatgcttgatggagcataactttatttctcataaccatgcctttccctccattttttttaggagaagaaagcacatgaaagcgtggagagtttattttggtggtaaaatggaaatggaatattgcttagctccttgtgtaggagtttagcatgtgcatatgtgtgggtgtatgatcttgatcatagagcatgagaagtacctacacgagtcacaagagtttgacaaagttcaatggaatgacaagtaaccaaaatgtatatggtttaatcatgatagcacatttttggctttagtaggaatttatatcaaatgaggaattctcaatttatcattttgaaaaacaaaacatctggaattcaagtcaaactagtatcagggtcatagcaactcatatttactatctcatatctcgcaacaacctagacttagatcagcaagtgcagcccatttacctcaggttcccggataattgttggctacttatatttaacctttgagagagcatttaccaagaaaccatatataagagatataaaatagagcaactattcatcatctcaacaaagagaactagcttgtcttacctagcatgactcaaacctatcctatctttttggtatattctattttgcaaatttttatattgtttttatttttataagatgcaattggaaagggaaatatgcaatgtgatacaagttaccttagtagggggagcgatgtctcccccctaagcttggctttcgctcagggtacttgataaggattgaatccctgaaaacgaaagtacgcctgaaggtcatcgtgctgttgctgcatcatgttgttgatgttggcaaactgagcatcagcagattgttgccattcttgtgtttgagctatgtgttccgtgaggttgtactgaatctcccccgtctgcatatcaagggtgtccattctcctagttatttcacccaagtcccaacgagaggaactcgagcgacattcacttggagatggaggcgcaccacttgacctgggaggttgattgtccccccattggatatcatgaggcgcatgccacaggtcctcactggcagttgcccaggttgagactccgatgctatggcgtggagcttgggtccatccgggtgcatccccagttggtgcccaacctgcctcatacatctgcacgggtgttgaggatgatgaactctctcgttcgttccttgtcatgctgcgcgtctccctgtatgttccacctgcacgagattcttctatggtctgcaggggaatggttagttcacgacagtgtaggattatggatatcattcgttctaggtttcttgcaaattggagcaccagaaatatctttccaaaacctatttttctcgaacccagaaattcctttctggtgatcgattttacaggaatcgtgaaaaccaagaagtgtacttaagcctttccatgtgagtgtgaactcattacggaaaaagtgaaaagaaataccatctactatttctttcaaagtgcacagaaattgcaaagtaagcaaacaagaaccaagctcatctaccatagcaaatctcagccaaccaaaagctttccaaatagaacaaaattcaacatccatacctatcattttcagcaactccggtgagtattctcgcgtgtgagcatactcccggtcgctcagcatgtagtaggcttgtctctcccaatcactgacaagatcgaggtcggtgtcgttccggagtcgtcacggagcttcggcgtcttccatcgagacatcggctgatgaacgagtactagactcgtcatgatgacttgatgaagagccggaccctttgaacagacgagacaatcgcctcctcatactgcacaatggggcaagaatggactaactcggcgggggttaggaatgacaagagtttcacccgccggttagattcaccaaagcaacttgtatgtatgcaactaaatatttgaatttgagggaaactatcaaagcttgaatgaacttgagagcaaactttggagagggaatgaaaatgtgttgaaatgcggtggaattccctctctcagccggctggcttttatagggtacccacaacagtcagaaatgacatgtgggacccactagccgttaccctgccaaaagcggcaggtagccgttgcctggctggttcgactgaaccagggtgttcggcccaacccctggtgggcccaaccggccccacttttagccgttggattccaacggtcagtgtagtcatggcatagcgaattttcgttgcaaatattattttggtttgctctgaaaaattcatttgaagaatttcctcaaaattcaaaaatcctaaatgcaattttgaaattcaaatatgtgatgatgcaaaaattcaaattgttgaaagtaaatatgcggatacataccaatttacttgttggtgaaggttgcgtcgtttaaagtccaacgtgcaagactgtacctcctttcggttcagtgcccggattttccacccgtctccggaggtgatggagcggacatctttggcttttccttccacaccttctttggttttggtgcggaagacggcttcttttgagccagctgctctaacttcttggccagtataggtgattttaccggcgtcttccaataacggttcctgggcatcgttgtttccttttccaggaaattctacatgaatttcaccaggctgttctccgttcccacgtcaatgttggctcctgcggtgctaaggaacggacgccccaggatgagtggtgtctccttccccgtgtccatgtccagcaccacaaaatcaaccgggatgaagaaatcccgtatcttgactggcacaatctccgctacccctgccgggtaacggactaatgaatcagccagttggaggcgcatcggtgttggtgccaacaccgtgaagttgagtttgtcgaagacgtcttttggcatgacgctgacactggctccaaggtcacacaaggcctggtcgaattgttgtgccacgatcgagcaggtgatcgtaggacaccccgggtctttcatcttctccaggaggttgtggagtatcaggttgctgcattgttccgtcagcttgaccacctccgttgttgggagcggtctcttgttgttgagtatatctttgagataacaggcgtatgtcggtacttgcattgcgtccaacaatggcacgttgatgtggatcttctggattacttcaacaaaacgagcgaactgttcgtctacatacggtttcctaatccgttaaggaaatggcagcaactatgtgtcgcagtactcttgcggcacggtcttttctggctgaacctccttgtcagccgtgtcattagatggtgcttcgtttgataatccattagttcctgcagggttaggatacgacggatcacgagtggacttacctcccctcgtcgtgatcgccttgacattttcaatgtaggagtcgggttgccccggaatcctcccagtttcagttgcagggactaaggatgccagctgagctaactggatttctatcattttattaaagctcagctgattttgaaaagcagaagcaaagccctctagtttgacattgatgttttctaggtccttgtcattggcagcaagccttttgcttaatgcatcagtagttctagcttgcacgaaaacgagattgtaacaccccaggtaaccacgtacctagagtgccacaccataaatcactcaaaccactaacttccaaaattattagaaatttcggcagagcctccccttcaacaactaaaagtctatctttgattgccaattatttagaggtaataaacaatatctacgaagtcaatctcatggaccataggccacacttgttccacttataataaactttctgagtaactagaacgaaagcattatcctcaaaaactgccctgaacatcaatagatcctgaattttctaagaaactcaaacattcaaagtaaatgaattaaatccactcaataaaaaatcaatgtgttgggtgcgtgtaattgaaaagaaataattcgaatatggaaggtcaagcaacaaaacaaacaacatgataatatgggcgtggttggtcaaggagggctggttagaaaagttaccgttattgttacctccttgataatatgggcgtggttggttccacccctaacctccatgtggacggtacccgttgttgttgcccatgtacatcgcctcctcacgggtttccgggctgtcattcccagaatgacctatgttgccacagacctcacacgtgacgtgagagtccaaggccttgacggtgccttgtggccatttctcatggtcgtccaagcgtttcatgaggaggtccagcttggcagcaagtaattccatctccttgacggtgtgcatgcctcactgacgggtctggagtcgttcctcgctccaacccatattggagaccatcttctctattagttcaaaggctccttgaactgttttagagaagaaggcccctccagctgccgcgtccaggtgatcgcgggacattggggtgagtccattgtaaaaattctgcaggatcagccagtcgtccatcccatgatgaggacaggcggccacgtactcctgcagtcgttcccatgtttctagaatagactcgtcccttgtctgctagaaactagaaatccttccacgaagggcattggttttgtccatcgggaagaatttcaagaggaatgatgtagagcatttgttccaggtgttgacagcagcacggttggcataaaaccactgcttcgctctcccgagaagggagaacggaaacagtcgcagcctgacggcgtcgggactgatgcccttgatggtgtacgtgctacaaatctctaggaactgttgcagatgagcattggcatcctcattaggcttgccacagaacgggctagcctgcgccatcatgataaggctggacttcaagtcgaaatccacgtcccctatgttgacctgtggcccaatggccacatagtcagcagagagagcagcgaactcgcgaagagtcttgttggccatagtcttgaaggtcggtggcgctggtacggctggtttctctgtcggtagagttttctgcggagcaacaactcgcggcttgacgctccggatgaaagcttctgcattttctttgaagttttctggcaggttgaaaccagtcatgcactaccctgttttcacaacaaacagtgaaaacaaccaaggttagcctgcaaaggaaaatgattatacagaggtaaatataaagtattagttcaagtaatctctattatgaatcttctcgggcaacggcgccagaaatgcttgttggtatttcttaacgacattactagaaatataattcccagcaatggcgcagaaatactcctggtatattatggttacagaattcatccgcaagcgcacagatataccattgtagcatttcacccgagagtattccaagggtatcgtatttattttatcccgtgggaagatcatgtagagagagcttgactaataatttatatgttacttatgataatcatattctaagcagtggttaagataatccaagggtagaatgacacacaagcattattactcattctcataatatattatcttatcttagtggaaagaaaagagaaagaaaatctattcctatacttctaatacacatagtatacatacattctagttaactggtatactagctaataccctctatccgatgccctcctggtacttcgagaagccacccctgactgccgagttccttacgacagcccatcatgaccatacaaccagggctaaatacggaggaataccctccctaggaaattaacttaggattatataccggcgcggaggaatacccgtactgagctatcaccatcagcggcccacctctcatccgcaatatataaccccaaataatgatatcccgtaatctagacaccacgcctaaactatcagatacttctctaatatcatcgtcatgacatagaggaattgcataagcaaacattatacccgcaccaaagcatcttccagataagctagccgtatattcagtataacatgaacataatgtaaagtaggtactcatatactcggaaagtatttcaataccataaatgtatttagaagagtattctaataaaagtacaaagcttacaaaagagaagagaaaagctactagagccatacccgaactcttccgaagacttccgaactcctgatttctactctattcctattccaccagctagatactactaaactaaacttgagagaaatgagagagctatttcttgaggtgtgtgttgaagtgaagagagtgaactccttaaataggcaggtaatgacggttatggtggttggaaaggtcggtaataccctccaacagccatagggagtgaatctccaccgttccctcaaaaccctgcatccatcggcgctggcataggttcggccgaaccctgggctgtcccaaccagcccacaagttggctggtggcctcctctggtgttcctcttcgtagacttgtgaattttggcccagtgtgtcgtgtcatttttgagttctcggcccattcatacataagtctggttctcgacatcgtccgattgatttatcgtttgtgttgatgtcgattctcctccactttattgtcattctctgcaaaaggttagtaaacctactactagtggaatattattattctaacatatttattcattgcaagcatcactagttctcctctattttggtaatatcaacagatacgtctggtgaaaacagaggaagaggtactatcatactcaaagtcactaaaagtacccaactgaataaaaagggaggcagttgagatctggcaagtggtatggagcctcataataaacacttcccatcaaggaagaaaatcagcagttagagtacacacaacgctggtacactaagaggatcatgcccacatcaaaaagcattaagcaagaagaagaaacatatgaaaaatgcatatcctcgtatatctatggatactcgcatagagtctcatacaaccaatagaagttaacaatgagacctattatgggcaatgtttcctttagacagtaaaacttattggcaatcaaccaggagttgaatggaattaatcaactagaagttcaaaaaaaaaacaacctgaatatagacaacactgaagataaaatctggatgcttttcaggagcttggattggacacttgcataacagtacataaaaaagtacttagtcctaaaccaatatgtaatgtatataataatctataaagaattgaagaagcgaactcgttcattttgaatttgaatttgatttgaaattgaaatgtttggctgaatctaaatcacgcttagacttgcagctaaaaaatatgatagatggaagcttagtacatcagtccaaccacacttagaaagtgatcaaggtgcatggctttggagtagtcaattatagctaaaattgggacgaaattccaaacacgagtgtgtgatagcagcactcgaatacttggctaatcgggactaaaccgaattaagtatcattgaactatacatagccttggcatggctttgagagatggttacatcgctccagcaatcgtggttcgaaaattatctcaaccccattattttatttgaaaataatgtagcgtatgacacacaatgcaaatgagttcacatgaacaaactcactcaaagcatatgaacctcccaagttcttctatgcacatgaattgcatataaacaacgaaatattgcatgctaagttatgtgaaaatcttgctgattttatcactggtcattgttgacatcttctcgaatagatgtgtccaaggaaccagaacaatgagacttgtaagaatgtaaaatttaaggggagaatttcactgattcattcagaatcttaatatagaaaattcaaatacccaacaaatcaatttagaaagattgaacgaagaattggatgaattgtactctttttcccttgataagttattactggagtttcttatcaaggtttttaatgagacaattcgtgtgacaccgcatgaattttttgtagagttttgatgcacaagcatcacacaatgagagcacggagggagtgttagggaaccagcggcccatgaagagcggatcactaaatatgaaaggtggatgaggctatacctataaatagtggggaagagatgatagattgtacacttaaaaggatgaaagaatgaatgaaaagctgcccctccatatatcttgtgtctcagcacctctgaactatgcatgtagcaagactacgcatataacagatgggttgtataatacacacaacgggttacactaatattaatttccccaaacaccatagggaacagctgaagatcagcttgccatgtcatcaatttttgcataaacgcctctagttttcaggtgataatacgtacgtccgcagtctcttgtcatgcatttcgaccgttatcatatactcttgcagttaattgatttaacttagcatttatatcatgtaaatgcgaaagaaaaatagagtaagggcacgtacaacggcattaattagccggctctctccagtgccacataggcaaatcagatgacgtggaagagagatgatcgatgagagagaaacaacgatgctatctgtgacatcgttgaagcatcggctcctctcgcgcaaaaaacgagcagacttgaggagagccctccgttgtagaatcggtttccagcagagccgtgcctccagatccaacgtaaaaattgcgcgcggaagaaatttggcgcgggtgagggatcgggatacgggagggcgggaatcggaccagagatgcgcgccatccaatttcttcgaccccaaatatggcgctgaaatcggcagatcgggttccagtccaatacgtcgccgctacgctcctccacctcgctgctgccttggatcctccacctcgccaccaacctttcccctccacctcgccgccgacgttgctcctcaatcactcactccatcggcgttggctgtatggctgggagacggacaaaggtggcatcggtgcctgagacatcctccgtcggtaccaacacctccggcttctgcttcacctcaactgatgcccccgccgcctttggtacctttcctccctatcttggaatacctcccttctctgcatctaggataagcgcggctgcgacgggtggccatatttccccatctccttcatggatacagacagacaaaagctcagataaagctgctacgccggatttgtcctcgccacatgcaaatatgcagagctggtaaccacaaatcccagcaataatctctactatcttacgaagattcagttctgcaagttttttgttctctgaatgaaattattaaacggttgccatgttctaaacttgatatattttctgaaaatacaatgagtaaatcagtccaagattttctgaaatacatcgttcaaagcagtccatataaattgacagataaatattggtatataatccataaggttactgtttgttcatataggtctgtacagattaagttattgtacatctttggccatgctgaaactgaagagacctatagttgccatgttatgttatttctctgtacaaactaaggtttctatattttttgggagtatgtcacaccttaaaaatcctaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttttaaaatcctcttttggctttgggccgaaagtcggcccaaaaccttctctctctctcctggcccaatccggcccgcagccgagccgcccgctcgcgctcgcgtccgcccgctgataggtggggcccacctgtcagggctgtcgtcttcctccggccgcccgccgcccgaaccctagcgtcgcgccgccgccgtctccttccaaatccggccacccctttccgtttccgatgaaattagtagaggggaaatgatcttcggaatccactctaccttttcccttttggaaacatcgtctaaatcgctttggaaatccgtggattcgagtttgattcggatcgatctctctcctccgaaccctagactttccatcgcgtcgccggtcgccgtgggccttcgccgccgcctccttgcccctttaaaaggacccccaagcccgccgctacctgccgccacccttgcctttgcccgccgccgtcggtagcgccctagcaccgtgcagccgtgcgctgccgtcgccgccgttcgtccagccgtgcgccgccgccgctccggtcgtcgtcgtcactcgggaaggccgccgtcgtgatcgccaagccatcgccgacctcgtccgcccctccgtcgtcgccgtaggccgccggaacaccgtcgccgttgtgaagccgaaggtcgccgccgcttcttcctcaacgccgtcgccgttcgttgatcttccgccattgttttggtcaccggtgagttcgccgcgtcgccctctacgtgttggtgtcttccgttcgcgtcgtcgcgccgtcgttcgccgacgagcttgcgcgcccgagccgccgccggtgatgacgtcatcgccgacgtcatcgttgccgtccgtcgtagaccggtcatagaccgttggatcttggccatccgttttggataggatcgatctcggccgtttgtttccgtgagccgccgccgtgcacccggtccaccgcgaaccctagccgctgacgcaataattcccttttccttttcaaaaataattcattattgcgtcataattcaattaaaatccatataagtgttttaatccgatttaacctttaaaaattcataactaattcatcttagctcggatttagttggttcaagtctctaaatttttctaaaatagagatctacatgttaaaaatatccacatgcactgttcatgcttgtttatgtgctgttttggtgtttttgctcttttctgtttagattccaacgtttccggagagttcgttttcgcaggagaagaatttgaagagttccaaggccagcaaggcaagtcacacagatcccaaacaaccttttgagcatgttgatcccgtttaaagctattgtttctattcaactattgcatttattttcgaatgtcattgggtggaattaacctattgtttgttatagcccttttgttcttgattattttattccttgataccttgggttattataacttgactagttgggctttatatattggttcaactagatattagatacgattgcttagcaatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagctagcgtgggcaacggctttaccttttgtatagcatggttcattgcggagcaccagtctgagaagtggcggagataagcccacgggggtcgctggggagtccatgccttgtttataagggggtgattatgatccaggaaaggtgcgctgtggtggattgtgttgtgcgggggtactgtcacagctcctttccgaggtaccgtggtggtattgaggcacatggtgacatgttgtggggctgtgtcttgtgggtacagtggtacatctctggccagagtaaaactattcgaatagtcgtgctcgcggttatgggcaggtctaacaatgtctttcgtgattagtttcacacttctcaccataataaaagatgctataactggtaataatttgtttagctcctggtttgaaatggtatattcctggtttggagatagaactgtgcagccgggatggttgttcagaatggttgggcctatgcaacagggtatgttgtatagcgttggattaatattgtttaattattacttaactattttattaaattctgaaatgtttattaaatgctgtttatgcaaatgaaaccctactatgccatcctttgttatcctgtgcactttcatatttgctgcgtggcttgctgagtatgtcatatactcaccttgcaatcattcatcagaggaagagttctacagtggtgctgatggtgtggaggattaggtgtagccctggtcaagctgcctgtggagtggagtcgtctgcgctgtttatcttattttttccgctgcttagatctttattgattgagaggaactatctacctctgtaatgacattttattcgcttattaattagagtaataattgtactctattatcaatttgttctaagcacgacttagtagatcaaacttaactgatgcagcactaagtatgaaaagaaacataatatctagacaatcaagccgttgactgagttttcatggtggtagatgtctaagctaatctaatctagcaacgcgatttagccgataccggcagaaaccctaaaacgagaagcagccgatagagctaaattgatatgctaagactagattaacaaagacatatgataaataggtaggcgaatatatcatccaaaccagagcaatccaagaggtcgaatgtactgatgcagccttgaacgacgccgacgtagacgatacaattgcctaggccgacggaacattggacttaccccttcgccggagatcgaacaccgatgcagccccgcgtcaggtgccaagtcccgccggatgataaaataaagtagaaaaggtaaaaggtggcgatgcgccgaattgtattgatctgtggagatagattacatataccccgggtgtacatatttatacccattggttgatacaagtccttgtcggacaagaaagaaactttcctaaagataaaaggaaaagataaagtccttataggacactaaacacactttcctaaagataaaaggaaactaacaaactattcctaattaatagataacttaccatgccgcattctctttgaactcggtctcttctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46583 - DNA, 55414 bp, Oryza sativa
  unsure (1)..(55414): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactacgacaaggcctaatcctccagagcatcaccttcgctgaagtactccttctctgatgatgattattgcaaggtgagtacatgaaataatcagcaagccacacaacaaatatgaaagtgcacaagagtacaaaggatggcataatacatgctcatttgcataaacgacatttaataaacttttttaaaatttataaaataataaagtacttaattaaacaattttaatccaccgctatacaacatacccgttgcataggtccaaccatatctgaacaaccatgcccggttgaacagaccctatctccaaaccaggaattaaccattccaaacaaggatttaaaataattatcacttattattatttgttgagtaattgagactaaacacgaaagacattgctaagctcgcccataaccacgggcatggctattcgaatagttttactctgggaagaagtgtacaaatttacccacaagacacagccccacaacatgttgccatatgtcttaataccaccatggtatctcggaaaggagctgtgacaagatatctcgcataacacaattcaaagtagtgcaccattcccgagtcatagtcaccccctttagaccagggtatggactccccagcgaccccagtgggcttatctctgccacttcttagtctgacactccaccatgaactatgctatacaacgcatttagccattgccaacgttggcttgtggttagtacgattaatacttcacaacagtagctcgtgaactaatccttaattgtcatgagcacgaccatcaaaaccatatgctcacaacctaccattatcagattttagttggcaaattcattatttgaactatcacgattgacaatcgtgagctaccattaaatgaacagcaataagtgatagtgcaacataagttatcccattaatgcaccgatctttctaagtagggctaagcatcctaatagctttagctaaaccgcacatagttctaactaatcaatttatgtgctaagtaaaaaaaaaatggcactaaagtgccggagtaaccaagtaattactaacagaactatacatcttttttttaaaaaaaaaccacagaaaacatgaacatgatataattgtccaagtgatgtaaagccagactagtaactaaaaaaattatagaataaaatcaatagttgcacaaatttatatccaaaattgcacaaatttgtagttgaagttgcacatgattgaaaatggtaacttcgatgattggggagtgcaatttgcatgtaagggttcattattagtccctgacttctaaaatcaagacgacttccacctgcagcagtctctcgcaagacagaactaacaccaaaacagagttttttttttgtttgaataactaaggcagagtatggaaaaaaaatagactgaagtataactcagatttcaagatgtcgtttatcgggtagcaactatctagcaaatgtgttgacagaaaaatgagttggtaaataaattaaaattatgtttagctttcttcagtggaatcagcatcagaattccccatgtcttcgcatacatcattcgacgtgtagttgccatctgaattctgaatctaccaaatctctttgttatgctgaaaatgacaaaagtaatgtatacatctgtagaagtgtccccttgaacaaaatattaaccattccacctccccaaaataacaaatacacttcaaaatcaccaagaatataggagtactgtccgtgtagttcgtattcaagaaaccaaaaaccgcatgcctgataaatttcgacaaaatcagcaatgaagcaaaatccatgtaatcttgctttctcaccatccaataaaccaaaactcacaaaataatttgattagcaataagcaaaaacccatagaatccccttgcaaatgtacagaatgtcgatccaatcaaccagaacttatccaaattcagtaagaactcgcaaaaacaaaaaaaaaaggggcaacctaaaatgatttacaaaatgcatcatctacatgcaaaacaaaaacaaaataccacccttaaatctgccaggagatcaaaatcgtctttgcacgcggaacccaaaaaaactgcatgtttggataattcgtcaaaatcagaatcaacaaaatatatatgtttctcagatgaaaagtgcagagccgtgctgcccagaggaactgatggcattgatgctcttgcacatcgattacgactccagactctaagcctctactagctcctctttcgtgtcttcacttgccacagtaccaccaaaactaccaaaccaacagcacacatcaagcaccaaaggatcttcgatctagcagtaacctgaagatataccactcgatgtgtgccaccaagcttgcctccctggcacacagtttccctcacgcatgcatcttcgataatcaaggccaccgccgccaccatcgacaagccttcctcgcttgtttcgcaatgggattattctgctctcttccccccaaacacctccttctcaacccgtccaatcagccaaaaaaaaaaagtagcagatgcacatagatgacgactcatatacctgagaaattggtgaacgctggctcgtagacgccgccggtcgccggagttcgtctcagatccacggggaggaagtctgcagcaaatgtggagaggggagcatcttgatttacaagaggcagttggtggaaaaaacaacatatgctactaggggagcatccatggcccatgggttaacgggtctggtgaagcagcctgtaaccaaatgtgcctccactgcgtgcacagatcttgaagcagaatctactgccaacaaaatcgactgatggattagaaaaaactgcaggtgactgtaaaatagcaaagctgaaacaaatttgagtccaactgaaggatgtttgtgtgccattgtatagcactgtatggaaaaaaaatggttgaattaagtagcattcacggcaaattatctgttgtacacctaccaattgcatcagagtgtgttctactaccaattgaagctgctggtgttgtggtcagaataacataaactaaaataaaacactggctaatgtgttagtgtattcagattttggttttctgaacatccaaccaacccctgtaacaaagcaaataccttcctaatactctacacccaaaaaaaaatccagaaaacaatagatcaagagtttattggattgcagtagtttatcagattgcaggaatctgaacaggacatgtaaatacctattccagatccaccttccttcatattctgcacaagaaattcagacaaaaaactttagaacattgatgttcagatctttctagttccagatttcatatcagtataggtaatggccctttcccaaatcaccaagaaagacttctccagaaaattatatcactttctagactcgatttagtcaaatttactcatcactataaaacagaattgttatctattactaggtaccatctaccaaaattaggacaccacatagctagaattttccttcaacttgacacatgtagcatttttagaacacaagatgcatataaatctttgttggaataggaacaagttagtagagcaaatccaaatcaacatgatccatcaaatactatacatatactaggtcaataagtgaagcatggtaatttctgacattgattaaaaaatatgtggattggaatttaaacaaaactaacatttattttcatgagaacatgcatgttttaatatttcagatttctaaacatgctctgtgctaacaaataaattatcatctttaacaaatgaaaattgtaaaaaactaaagtatatgactaaaataagaacttcaaatgccagcctgaccaaatatagatgaaattttcagaaaaccaaatatgtgtctgaattaagaatttgtagtacctaaccaaaggaagatcagccagatcaaaactaattcatattttagaaggttacaaaactaatagaactattttaggaggttacaaaactaattaagttgaacatattagtgaacattttagagtactaggatatactcagaagatatttcttctatgggacaacatctcatagaacgaagggttgggatctaactgtacatgatagccttaggttcgaccatatgcaatgaagatgaatcaggcttttattagggaatagaaaatgaatcagatttgatcaaaataagcggatgggatctgcagccactgttcgttaaggcgctaggtactaatctggcagcagacagcacctagcacctagattctgttccaataagctaagtttctgcaccaagatgagcttcttcatgctctgacttcatccctaccgaggaatgaacacaatcacctattataatcaatttaagactttcattcccctaagcaaccagcaaaaattccatccactctttgagatttccctaatactattcaagtaatttgtcccagttatgtattctgcttcatcggtaactccattgagggttgttgatctccaggaaacggccaaaggttgctaatgcatcataaaatttgcggatcttgagatatccccttattgcagaaacatcagactctctgaggtcgaccttttccatgattatttcaatggctctaatgaagtaatcatccatacccaggtttaatagaccttcagctagcatacggaaggatgagaactctggtatgaaccccttatcaaccatctccaacatgaaatcaaaagcttctttaataggccctccaccacgacagagcccacgaaaaacaatcttatatgtcaaagcatcaggaggctcaccaacctctgccatctccctgaaaagactcagggcatctctgatattattccgtctgaagagagactggagcacaggattgtaagcttttggagtaggcctcatcccttttatccgcatacctctgagtaccttcaaagcaacctgtgtcctaccagccttgcatagaccgttaatcagagtaccgtacgtaacaacatccacttcaaatccatttgcagtcatagtttctaaaatatccgcagccttttttatgtcaccttgcttgcaataatgagttagaatagaattgtaagtgatattgttaggttgcaacccttcacttatcatttgattaataagctcaaaagcatcatcaatctttttgtccttgcacaaaccatcgatgagagtattgaatgtgattgcattcctcgaaatgccttgcagatccatttgatcaaaaacttcttctgcttcttctattctcattttcttgcataacccgtcaattatagtgttatatgtaattgtacttcgaggacaaccagtggactccatatcttttaacaaatccaatgctttaccaagcttcccaagtgagcaaagattgtcaatcaaagtattgtatgttacttcatccggggtgcatccactgttcttcatctcttcaaacaatcgaagtgcaagatgaggatcgcctactttgcagagcgcgttaatcagaatattgaaagtataaacatctggagagactcccttcactgtaacctgacgtgcaaggtccaaggcttcctcaagtcgattccccgtgcataaggcagcaatgagagtgttgaatgtggtaatgtcaggcaaacaaccccgatccaccatctgattcagaattccttttgcctcttcaagctgtccatttttacaaaggcaattcacaacgatattgtaggtgaaaacatcaggatcatggccctcctgaaccatcacatccatgactttgagggcatggccgacatgatcattttggcagagaccattaacaaaagtgttatatgtgatctggtcaggctcaaacccatcggcaatctcctgctgtatatacccaagagcatcctccaccctccctagcttgcagtacccattaatcaaaacattaaccgtcaccttcgtcgccgagcaccccatttccaacatcctggctttgaccctcagtgcagcctcgatgctcccctcctcgacaaatccttgcatcagggtggtaaacgtcgtctcgtcaggcgccacgcctctgctagacatttcctcgagcatgagaactgcagtcctgacctgatgtgctcggcacaacgccttcatcagtgtgttgaatgtgacaacatcaggcttgattcccctagcacccatctccgagtacactgattcaaggagtttcattttgctcccctccacaagaacattgagaaggtgattgtacaccacggtgtctgcctgaatgccaaacaatggttggagttgattcagaatcaggtcgacggcatcgtcgaacagctgctgcccctcgtagctgtccaagaaggagtggactacgcccaatttcacctggtgcccctcccgccgcatctccgcgacgagcaccttcatgaggtcgagggccccgaccgcgccgagcttgcggatgatctcctcgtagacctcggggccgggcgcgaagtcgtcccgcgccagcgccgcgttgagcatccggagcgccgcgtcggggtccggctgctcgcgcagggcggtgaggagctgctcctggccagccgcccggagagggccgtgccgggaggcgcgccacctcggccgaagcggccctactccgacatggcacgggcacggcggcggcggcgcccgaggggcggcgcaaacgcggggcattggggttcagttcagctcagctcagctacctgaaaatccagcggagccctcgggtggtcgctcctttctgcgtcaacccgccggcgatgtcgtcgtccccgcctcagcctgcgccatgtccgggtcgtcaggtcgtgggcaactgggcagaggagcagctaaagtaaagtacaggtggggaagagagcgcatgcacagggagagggaggaagtggccgcaggacccggcggcggagcgacaactttgcgggcgtgcggcggcgtgttctccgtgaaggcaggcagaggggaacaggaggaagggataaggcaacagtttagtttttttaaggataagtcagtccgccttttagtggtgttttgggaatcactccttcactctttcccaaacaccaccttactaccattgtggataatactagaatatgactatggtactttagttttttcggttaatacaggataatttattcaattggtcattctcaacggatgttgtacagaatggttctttcttcaacgcaccaaaatttgttgagtttccaacatccgctagaaagcttatgcatatttctacctatcttcaaggtttgccagacgaaaaacctccattgcttgtcaaaacacatggtaagtaaattatggaagccttgagatgcatcatgccatggaataactttgtagtttgataaaaaaaaacaactaaatgtattaataaagaggtgagttctgaaactgaatagcagctaaatgtttttttgcagcagggtgactgattaggggttggtagagagagaggaggtggaggggtggcgcaggagtggatatgtaactttagagggagacttgcatcgcgacgatgatggagatcatgaccgggggagtggactgcatcgcagcggcgaatcagtggggacaacaagaccttcgcgagggagggagaaggcagcggcgttttcggagtccgccgcgcggagccctccctacgctagcgatggttcgacggaggtggtggcagcgggggactggacggcatgggggaacgggcaacgacgcgggcacctcccagcgttggcgacggagacggtggcagcaggggactggacggcgtggggaacgggtgacgacgcgggcacctcccagcgctggcgacggcgatggtgaatgccctccccacgccagcagaaggagacgagcgcgtcgtcggttggatcgggaaccggagtcctccctgcaccagcagcggtttgacggaggcggtggcggcaggggactggacggcgtggggaatggggcagggggagcgacggagacgagcacgtcggcggttggtgatgggggtgatgtaggaggaggaggagcacgatgcagtgatggggcagatgcgtaggaggggagcgcgtgggatctcacgatcgtacgattagtattacgcgtgtctgacagggttgaaatcaccgtcaccactacggtttttttaagtagtagtatagatatagatatgagctaacagtgtggtgacaaaactaagtacttttagcttacaaaacaaaacaaaaaaaaaacaaaacgataaaataatgcagctcatgaatattacacacaaaacgaacaagagtgtgcttttagtactctgtgttcttaccctaagtttcccaactcatctccctcgtttttcgcgcgcacgcttttcaaactgctaaacggtgtgttttttataaaaggtttctatacaaaagttgctttaaaaaatcgtattgatccttttttttaaaaaaaaatagcttaatcacgtgctaatggatcgttcgtttttcttacgcactgttccggttgggaacatgctccagcgaagacagctaatccagcaatcaaccgtcgagctaaccaacaaagcaaccattgggcaaaataccaaaactacgaatgggacacacaacctttttgttgcaacttttttgaaaaaaaaaacacaaaaatgttacataactatatcaattaaatttggtgaccaaaacaaagagaatagtgaaaggagaaaatcacaaacaatgcattctaataaaacaaggttagtaggcttgctaacaaactacacaaaaactaagtataattagtaggttaatcagtaggaggtactgtccatttacacaaaactaagtacaattggtatcaaacaaaactgtcttattagtatcttcattgctaacaaaactgacaaaactagttactcttcaccaactacctacaaagccataaattagaactgacgaccattcttcacaactttgtttctatattatgattaataaaaatggaaaactataagataaaaattcagagaagatgtcaggacctataaaatttagagaagctgaaatgtgggctatatattctgcaaaccatgagatgcaagctgtgcaaacaattgcagattgcaagaaggcaaatcataaaagaaaatataatcatataaagatacaaagacaaaactagttaagtagtgtttgtaggagagacaaatatatccatgtaaatttacaaaattaaatgctattaatctccattgaacaaaactgaattgaagtgaattcaagtgaaatgctattatgctaaacaaccaaaactgaagattatttattattgtgttaaaaattgaacaaaagtaagccatcttcagaagtaaacgaaacatacagaactagctttatctgtatgatctagcatacatatgcatgaaaaatcaggatcgatcgagagagccagggagatcaggtgtcatgggcatcccttgattagctgcttgtattcttgtactaaggagaagcagaggaactatgtattcttgccgtgctacatgctgtgtggaatcaaacaacaataatacaatctttttactgacagttacccaaaaataaacaaatcagtgaacaaatggatcattccctcaatttgatcctctaaacctagggagactaatccccatggctaatcctctaaaaccaaccagactaatctccaaaggtaaaattgcaaaacaaattaggtagtgattttgctctaataaaagaagtgtgagatcaagctctaatcacacaacctccctatttgcaaaacaaagtggagacaaaccagcagctctatcgatagatcactttcgtgtagtggctagctgaatctgaggtagacattcctcccccattcgaaaaatatttgctcaaatagaaacagaatcatgtatataattattttaaacttaaaaaatggaataatatgatattttaaaacaactttcatataggacttttttgcaaaaaagcacgcagctgttgcctaagagcgtgctgatgctgctgaacagcgagcagtagcgatgtttgaagcagccaaacgatcctttgtcccctgcttacctacggagaaatatattttgcaacacagtttactcgatgatttagccatttttcatattaggtgtaaatggatccacaaaatgcgcttctagttggtactgcactacaaggagttctgaagtgtgacattcaagttcatagcgacgcaagaaataaatacatgaaagtaaacatttagcactttgtaaaccactaattcagaacactcatccctggttcttcctcttcctgcatatattgaggattctcatacaaattagaaacgatcagagcagtaccacagatggttatggtatcaatgataaaatggatttgtacaaaacgtgagttggatacgctatgcaaatctacaaaatcgattcacccatatcttgagttattttgataacgttggtgcttaccaagcactacagggaacaaatattatgattatgatgcagtatgaagctgtatcaattatgcggatacgtagattgaaatagctacataattaaaacatgtgaaccgatgatcacttcggtatttccaaatacttgtactggtagtgacatggtagtgatcacttttaactaggaattgtgccgtctatagggcttctgatttattctccatttagattgaagccaatttgaatattgaatatccattagcaagaaaggggtagcatgtgaatcagggattgagcttggctgcagtaccataatacatagctatgtgtatgcttgtaagagccactatcactgaattagcccacgcactgatgctataagaataaaactgacatacttcaattctacatgcttaattccagtggacaatgcaaagacaccaaacaaggctggaattctcttgtggaacatcaaagtggcgtcctagtcctaacactgacaccaccaataatgtagaaacaacctaaattgcttaatcatttcaacaggacacaattgcttttaccatcaaaaccaacagcatttctagaccacagtcgccctacctagcatcaaaagctgaggctctagcctaattaaattgcagatgcacacccagcaggtaattaattaagatgcaggtgtatgtataccatgtttaggcctggtttagttcccaattttttcttcaaacttataacttttccatcacatcaaaactttcctacacacacaaactttcaacttttccgtcacatcattccaatttcaatcaaactttcaattttgacgtgaactaaacacacccttagattgaattgaagtacttggaaaactctgaggggaggaaggactggggatagcccgacttcgccctgaccatgtcggcatcctcaccggaaaggtcctcctccccgttaacatatggaacaaccgacaacactatcttgctggctatgtcaatggtcaccaccgacatcttcctgatcatgcggtcgtagtcgcaggtgaggaagtgcatgacgctcggcgtgtccatgctcacggtagggaacaggagaacctcacgaggctcgagctcgggggcgccctcgaaggaccgaagaatctcgtcggacgcgatcgcgaagtctttgctccagctccactcgtcatcaatggcggccgcccctaacgtcgacctcagagtgtggcaggtgatggtgtagcctcctcgtccttgttctagggagcccaggagcttgccgtcgtgccggctgacgtcggcgaacttgagggcggcgccgccggtggcggcggtggtgacggacacgccgcggtacacctgggagaaattgcggcgagatcgtctgccggtagggatgatcgagctgtccagaggaaaccggaggaaggcgactctagggcttgtccgcagcacgtcgcagaggagcatgcctcggtcgtagtccacccagcagaggtggtcttggaaggcgatcacggcgtcggtggtccagtagaagatgtcgcagcgctcctcgtcgccgtcgtacacgatcggcagctccatgatatcccacggccgccggccgccgcctccatgatctccatcttctgcttcatcttcgtctttggaggaggatatggccgagcggagcacgcacagcctggctttgactctgccactggcggttctgaggacctgcagctcggcgacggcgaactcttcgcctcggcacaggatgccgacggaccggaactccaacggataccgcatggataggtcgttgccgtcgccctcatcatggtaggtacatggggggagggccttgagtagcggcgagggaactgggtggtggtcgacgtcgccgtcgccggagccggacgcggtgaagatgaagtagtcctgcgggcaagccgggccggagggggactcgacgatgtagcagaagcagacgaggacgaggttgcggtgggtggcgacgagggggcacgccaccatctcctccgggtccgggccctgcggccaccgcacgtacaggcgggagatcgccggagggtcggcgatgcggaaggcgatggtgaagggggtcccgtgggatccggaaccggatgccctcagtactgtagccctggtgtcgtcgtccctgcggaagacgaatcgctccagcatcacccagttggggaaggaggaggcagaggcggaggcggcggcggcggacatcgccatggatcggtagagatcctgagatggattggggaagaataagtctactttgactccctaaactattgaatttgattcgtttctctggattacaaaaccggatatctcgaccccaaactattgaaatcgctgcaattttactccctcggcggttttagaagactattttgctgacgtgacacttacatggcgatgttgacctggtctttgttcaacgtggcagcaacgaggcattagaattaaaaaaactatgtgggacccatttgtcattcacacaaagaaaaattgtgggacccatttacatgtggggcccacatatcatcctctctcctcttcttcctcctccctctctctcacttttctctttctttctcttttttcccgttgctcttctcttcggccgtttgcaaggagcgggagtggaccatcggcagcggcctcctcacttcgccgtccctaggccttgcatgttcgccagccgcatcagctgcttcgcctccttcgctatcacctctacctcaccatccttcccggcaccgtcgtaggctccacagccgctgggagcaaagcataccggcaccgctagagcttccctaacaccgacaccgccgtgacgaagcggacgcggaggcagacactgcggttgtggtggcagcgtggagaaggaagcgggagaagtgccacattgacatcgcccgttctgtctctttctctgcttgaatcgcgtgagcaaaaccgggggggggggggggggagggggtaggttggggagatgataagggacagggaggcggtcaaagtgggtagcggggaggccgtcaagggagatggggagcagaagggattgcggcgatggtcgagggagcgatggggttggtggtggtgtgcttcacggcggtgacagacttcgtgggtgagtggatgcacggtcggtgtagtcacctcgtcttcgccactccatcttgagggtgagccattgctgcgccttgaggccgccactccgtctcaggtggagccccctcacggatccctctccccagccatcactgccaattgacgatccttaagtaccgaattcaaccgtcaaaacctgcataaaagcaaatgaaataatataaaatggaacgccaaaagtggctattactaaccatttccgcaagtctttgtgaatatttgtatgcaggtgaattatggacaaaaaccacccaccatgtgataaaatatacctccggacaatcaggacgcatttacacggattgaagaacccatatgtcaatcaaaaccacttagaattgagcccagccaaagtacaatatgctaggggcccaccaggtagcctcccagccaaaaggagtgcccaagaggtaggccagaagttcgacagaactcctagctctgctgaaccaactttgcaccctcttgtcatttgcttccacgtgtacgctcctgatgactccccgacggcggttatgcgtggttccgggcttaatcgacttccaagccgtcattacaacactgtaaaaggagaagctctcactctcaagcgcacacaactcaagtgtagtacaactcactttgatatttaggctactctctagtagagttagaaatgggaagagagtgagggaagctctgaagggagtgccccaaagtttggagttctctccggggagttcggaggagtgccggagtgtcggcactctctctgatcttgtgttatttaattagtttacttaagtattcttatcggtgcgggttcgtcgcttagtgtctaactgagtgctctagtactaacttactaagattttggataaagaaggtagttcttggccgaggctagagtagtaattgataacgtaaacgtgatgtctaggttagaggctaccttcatttgttgtgtgctccacgaaaagtgaggtaggtggcaggtggtgacatccatgtccgtccgttgcatctctccacgttatgatacatcatagagctcaagatcagacttagcttggcagaccaggggagggccggtgtctgaagcattcgatagagttttacctttaacttaggttagccagttgaatccatagaaatcctctctatccaagcctaccattcgatagagttttacctttaacttaggttagccagttgaatccataggaatcctctctagttagccagttaaatccataggaatcctctctagttagccagttgaatccataggaatcctctctagttagccagttaaatccataggaatcctctctatcctaagcctaggttagccagttgaatccataggaatcctctctagttagccagttaaatccataggaatcctctctatcctaagcctaccattcgatagagttttacttttaacttaggttagccagttgaatccataggaatcctctctaccattcgatagaccattcgatagagttttacctttaacttaggttagccagttgaatccataggaatcatccctaccattcgatagagttttacctttaacttaggttagccagttgaatccataggaatctaggttagccagttgaatccataggaatcctctctatcttaagcctagttgttattcttggttgaatcctgttattagatatatacacataccgatacccttggaatattctaaggggaagtattgcaacggtatccatgcgctgacgaatttatctgtgtgcgtaacaaatactaacaagcatttctggtgccgttgccgaggaaaaccccaactaaccttaacctcatagcaactcattgataacaatccgacccaggtagggttggccgaggcccaataacaccccaacagttctttggcacacccactcagggaaatgcccaatctccctaaaagactagtccaataggggaagggtggtggctctcccttttaaggtggcttcctcctcccaagctaagcaatgtgggattattcagaggctcacacggtcgccgcccgactttggcgtctttgccagcgggtaatagtgaagaatgtcctcatcattcacttaaggttgcccggaccccaacagttctttggcacacccactcagggaaaggcccaatctccctaaaagactagtccaataggggaagggtggctctcccttttaaggtggcttcctcctcccaagctaagtaaggtgggattattcagagactcacacggtcgctgcccgactttgacgtctttgccaacgggtaatagtggaggatgtcctcatcactcatgatgttgcaaacgatctcactacattatggcgaccgaatcgacccaaagatatatgtatccaatgtcgaagtgaaaaaagccacaaatttcctaggagaatgacttctctcatggcgagagacgttcaaggagaaggtaaagactatgttaatcaaccctcctctcctagccagtaaagactacgttaatcaaacctcttctcctagccatctcgtgattgctaggggagaagaagcgtgaggtgctcacaaatactttatcagaaacgaggcatatgtgagtaggacatgagagtactgccataccgttataaggccgccaccattgacaacacacattcagtgtagttttcccattgcaatgcacgggcactttgctagtcaaagtaaaagtaagagtagaactcatgagtcctaccaggacaaaatccctcacgttccaaggtttttatactgttttatttacaattgtccaaaattgagctctctctgcctgtcaaaaaaacagaaaaactactcaaccgtatcccgtggaaacataataagtggataacgcttcgatcttatccattccccttcactctctgagtcttcgtcttccttctccgcctctcctatttcaccctcttttcccccctccccctcctccctgttgcagagagcttctctatacaggcatggcggcaacaaagcaagcccccgaaaacggatcccttccccctcttcctcactgctagatctaccctgagtgcacgttgactacaaggtcctgttgcctcctcctccgtctcatgcttttgagggcacccactggatctagctcccatggaggaagggggcaaccagctaggagggaggctatcgggaaggaagctgaccagcgtggacttctcgacctcctttttctaggcgcgttgccgatggtgatggaggggcaacctacgaagcttctagatctagagctttcattgacggcgacatgatcgtgagccatcatgatcattgccggagcgtgtgtaggtacgtcgtgctatgtatcgggtctgatacctggtaggtaccatggttagtacccatggtatcatgacttacccatagatagcaaacctgatacctggtacctgcgaggtatcaagtatcatggctggttgtgaggtatcaagtatcatggttggctgcaaggtatcaagtatcatggctggttgcgaggtatcgggtatcatggctggctacgaggtatcaagcaccacacgccctctctcctcttatccctctctcctcttatcccttcccctcgacttgatccttgtgtcctactactactgcaacttcacggctagggactagtcgacgtttgagatcgcaactacggtattttgcatagtatggggattgttgcgcttgtcttggcgtgtgttagcttgatctgttgtatgtcatgtcttgatttgttgttgttgttgttgttgtgtcatctctcccctagggagtcttgtatttataccaatagatgtccccttgtccaaatagaactaggaagaccaatatggatacaatccaggtagtccttgtcgtttccatatagaactctattcatccttccttatccggatctccttctatatacgatgtatgattctctataagacttggtacatagtgggtcctgccgagcttagtcaactactattaggtatgtggtatccataaccatgacaaatgtcactctctacgtcgccctaagtgttggttcaagacgtcaggggcgcgataccaaggaggatattggaggaagagggcactgctgctctggttagctgcggtggcactccctcgacgacctaggaggatccggctagggaaagtagcgaggaatcgcgtggacagcaggcgacacggttgaaaatatctattaatttatcgggtgtttaattatccagtgaaaaatcagcattatttacaattgtccaaaattaaactctctatgctggtctgcgctagctgccctcctaaaaaaaatcagcattatttacaattgtccaaaaaatcagcatccggccacataaaatctgaatcggctttccgtaggctaaaccgggaaactacttctccctccataatcttaaacggaaacccaatccttaatataaagttggacacatattctgaataatagtaagtgtgcacgtgcaaggcacgttaaacattcatggttttacactaagaattgagtacaccctatttcagctaatatgaagaaaaataaagatggatgagattatttatactgtttggaaggtgctatattattatatccctcgtttttctggaaggaatggatcacaagaaaaatatgtgtgaatgtatggaaaccaaataatagagaaaattacaaaaaaagaaaatatggcattgtcatcaacagagttgtcctccagcttcaatttaaaagaaaattgcagcccgataagaggacgaatactaaaagcaacttattttataaagtagtatttcatagtatagcaatagtaccaagccaagctttcatattaaggccaaggattaaaccacatttcaattggacacagtataagcaaagcgattcaatccatccattatattatatcttgaatgggcagtggaaatcgaagagacattcagaatcgccaacaatacacaacgcatctagctgaaaattttgaaaacttggcttacttacagttccggatgactaaggcactccttttatccaatttattcagtttaacctgttgcagtagtcaaactaaaattaaattcaaatcaaacctacaaatatttatgaaatatcagtaaaatccaacttctaaaatatatccaactaaaaaacatagtaaaaagcacatcaattttagaaattgctttggcatagaaagctacctgaatgtcagtttttgtggacgcaatatcagaaaatgatgggcaaatgataaaccattagaagactgaatttagactaaaaataaaaagtaaaacctattgtgaccaaccacaactgccatcttagtctacccgttggcatggtcatcccaaggaactcaaataataagtgcttgcattatgacatgaacttgacattaagctttgtcaagagatagttccatgtgattcccttgaaaactttaatatattcaacttgctcctagcatttaactcagtgaacattttgacatatatccaatttatcaatacatgaactattttataagtatggtcactgcttcagaattgtggagacaattgctgagaaatccatcctctctggcatttagctgtggagtagttcggtgataaaaacattaataaatcaacatcctatatatttaggcatctgtaaattataaattataagtagtgcaatatataaaataacaagtttttttttaaattagtactactttcttctggatgatattgatctggagcccttgcctcgcttgtaatccatctcctagagtggccagaaaggaagagccaaagatgtgcagtggtcaggtgcagcagctttgctgctctcccctgctgtcaaccatccatatataccaggccattattagatttacatgggaaaaaataattaatccaaacatataacttggccatagctgtatatgtataacatatgtaacttgtttgtctgcaaatttaaatggtaaagtttcacaatttgttggaattgaaaattatattttgtatagctcacttgacactgatcatccgtcagtaatcagctcgtttcaacctgttgtggatgctacatattgtatctcagctgaattgaaatgcctgacagaggcaataagatatattgagctatttctataggaactgcagaaagcactgcttttttattccctaaagaaacagtacccattgttttccttttggaaacctacattgatataatcaaatatagagaaatatggagcaatatagtttattttactcctatggcagtagatgatttgtgatcttcagcttagtcttcaggactcactgtatcaacatattttagtaacaatataaaccaaatttagtaaaatctaagtgattggtatatgaagtccagaattaaaaacatctccaaatctaagccatcataccagtttcatctcagagttaataggtgcaaaatctaaacaattagaaaattaggttggacatatcgatagagattagtaaaatctaagctagtgctacatgaagccctgaactgaactaaaaaaaatctccgaacctaagtcatcctgccatgttcatttcagagttaataggaacaaaaatctgaaaaaaaaatagaaaattaggttgcacatatcaacaaattaagattagtaaaatctaagcgagtgatatatgaagtcgtgaactaaaaatagtctccaaacctaggctatcctgccatcttcatttctgagttaatagatacatacatccgagcaaatagaaaattaggttggagagggtattcaattgaacctagctttttagcagaaaatgaaaaggaaaagaaaagttatttaattgaagatgtacttgcagctctgaaattaaaagatattcaattgaacctgacttttagcagcaaaacagaaccatcgcatcaagtgcaagttggggagctgttcagaagcaaaacgccacagttggaacactttgaattcagatgaattttactgaatggaggcaaacatgtcatgccaatcggtctggcactactgctgaatccaaaagaaattaattattaactgatctataaaacagatcttagcagctgagcaattatacctctaagtttacgactaaatgctaatcaactaaaaatctgtgagtgtttcagttgcaacggagtaaattagtaactgcaagaactgaacctatggccaaatgtagattgcataccagtatttgtgatttgggttccaggtaatcaaatagtctactttgtcgataatatagtggacacatacattcagaaaataggaacaacgcgattttttttagtttcagtgtgagaaagagagcagacctatcaagcctcaacaatcatcagatcatggagcgattttctttatttcttagtaaagcttccttatggacaatttaagttcctgaatatgccaatcatgactcatgagcggtgtgccattctcagagccaagaacgagatcgatgtcacaatatgtagaaccaactttgctgcagtaaactgaagcaaagcaaatgagcacagatgatatgacgatgcctggcaagctttctatgctgcgattcatcccagggagatgatcggtacggaaaacaacagttctaccaaggtcacttcgctattctcagatagtcagatgtattatcattattcacaaatcacaacagcagcaggaatcaagtctgccctgcatttgggttggttccagaaccgtgcggtgattgttgaagaagaggaagggggaagcaatggatgagtacctgcttgaccaccatcgtcggcgaagcgaagaacgtgtagcacggcctgcccgctgacctgaacaggatggaggagcgggaagcctcgccggcggccgtcctgacaaccttctgcggcggcggggtgatcagctgagcaaggggcgatggggttggaaggggcacttggaggaagggcggcgttccagtggtggcggcggacccggcgacgtgcggttcccgcggaggacgttgatgacggcggctgcggagggctagaagggaggggaggcagcaggacggatgtgaacctcgccgttccggcgccggcacggtgcagcacccgtcagcaggggaaggggggatgcggggcggtggggggcgggcgcgttacgcgcgtaggaggcggcggcggcgatgcggcccgcttcctcggcaacgacgacggctccggcgggaggcggcggccacaggcgatccgaggcagcggcggggtagggaaatcgggagcgcagccacgcgagcggagcggcgccggcgggcgcgcaggaggcgagcggcgggcggcgccgcgcaggaggataggttttcccttttttttttcggcggcggtgggttcttttcttttttttttcgctaaccgctgtttaccacgtggaatcgctaattgcatgagttgatccaacttttaatataaaccgttggatgaacagatctatgggtcaggagagagaggtgttagatgaactggtattggcatatatatatatatatatatatatatatatatatatatatatatagaggttcatgtaagtactattctctgtcctctgctcatagattcctgggcccaagatatgccctcttatagattccattatttctttatgtcccattcaatttacctttggacctttgtagattttcagaaaatttctttattcattattcatggatttaatttccaatgtgaatttgtgggatgctattattttttttaaccatgggcctcggtgcctatcattgtttatatgtagcaaaatttgttctatggcactaaaacataaatctgaatataggcccccctgtcacactttttttcgtgatatctttagtggaagtcatatgtacactgttgtgatcatattgtttttgtttgaacctgcagtttggtggcaatgataagatatggtttgcagaccaggggcctggtatgccgcagcttacgcgctgcgaatacagttgtctgaagaatgtgcacattacagggtacaaaggggcgagatgccagattgagtttcttctgcacatagtggaaaacgcccctacactggaggcattgaccgtagacacaactcaggtactatatgaagattattatggcgccagaattggcagcaagttctccgagtgttttgctgtagtttctagggattttctccgtagaaagctcccgacaaaggtgaagctccacgtcatgtaagacttgtttagggctgtaaaaaaaaaaagctgaggctcgtgaactgctcgagctgaagcatcatctccttttctccgtggagcatcgctagctctgatctgattcccatagtcagggatcacgtttctgacggaaaacggtcgaaaactatgaaatttcaaggtttcgacgtggggtgaaagttgatttccaaatttactggctcatcatatcattgtgccagactgctgggtgctcgtctttagatgtatttttccatatattttttttccaaatttgatgcggtggtttactgggaggaggtaatggaaacaaaaaatgatctcattgttaacttaattgaatttggatataaattgagctgattgtctgacacaccaagccaaaagccattgtatataatgtcctaaaaccaaatcaaaccgaaacatcatacaaattactactagcagcacacaatggaaatatagcttctttgcttcaaatcgtccaatgaagattgctgaacgaagatcaattagcaccatcagcgtcgtcaggccagatggccacctcgtggcggccgccctccgtggcgcacgccctgaacatgccggtggtgttgtacgccatggccacctcgccggcggccgacacggccaccagcccgaccttgcccggcggcacgccggccacgacgcgcgcggcggcgtcccccagggagaggccggccggcggggcgtgctccagcagggccgcgacgtcgcgcgccaccgtgtgccggatgatggcctcgcccacgcccgtggccgacacggcgcacagcgcgttggcgtacgtcccggcgccgatcaccggcgtgtcgccgatcctgccggccatcttgttcaccagcccgccggtggacgtcgccgtcgcgaggttgccggcggagtcgatggccacgcagcccaccgtgccgacccggctgttgtcgtccttgggaattggttgggtgtaatccacctggcaacaagcaaggaggttatactaaaagtcctgctccctctgaaaatccgatttcatttcaaattttctcaatttgaaatgaaatcagattttgaccgttaacatgttgttttgtgatgattttatcgaaacagctctaatcttataaaaattattgtttttctgaatcaggtacactactactagtatgtttcttatttgactcatcttgaacaatagcttaacgaaatgggtgaagctcctatgtgcattcttagagtgattaatttggacataatcgtgcatatcccgtactgagtgtatgggggaaaaaaatgcatggtgcacaacaaaatccgatttcatttcaattttttctcaaatttatttagtcatttctgatgcacttggcaatataaattcagacaaagacatggcaacaaaatggtaacagaggaataactgcaaaatgtatgcttatcgtgctacatatacacatgtatgaaccacagacttgtcagggccatgtgcatcgcttagaaatctgaacaggtttgtgggtgggggtgggggtgtaggaatgtgatatctaatccaatcaccttgtagtagctaggaaatgtgctaaaaccaaaacttagcaacgagccagacaaaactgcgacagtatgaacggcagatgcttaattatcttcctaaatatacatatgtatgaaccatagatttgtcagggccatgtgcatcagatatatttcgaactttgaacaagattgggggaatatgatatctaatccaatcacctactccgtagttaggaaatgtactaaacaccaaaacttagaaaacagacagacaaaactgtgacagtacctgcaccctgttggcttcttttgcttgtctgagcctctctttgtttgcctccgtaataaagtggcttggatctttagtctccactccctgacaagtgactagttatcaccatataatcaagtaaggcatctaagcatagtaaattcttattctttttttaataaagaaagtaatgcatagtaaatttcattctttttaagattatggatagaaatccagcgtccaaatggatatacttaattccaggtcttaaaaagtacttcctccgtttcacaatgtaagttattctaacattttccacattcatattgatattaatgaatctagacatatatacattcatattgatattaatgaatctagataaatatatatgtctagattcattaacatcaatatgaatgtgggaaatgctagaatgacttacattgtgaaacggagggagtaggtctcaaaactaagggaaaacaaaacttagcgtgtgtttggttttgggactaggtaggatgggatgaaaccattcctgattttggggttgggatgattccatttacgtgtttggtttgtaggataggacaatcccaattttttgtttggttgaagggatgagctagagatgggatgggcgccatttgctatcaccgtcagcgagaaagaggagagcgagcggaggtgcgacgatggctggcggcgaggaggaggagcggcgcaatattgcgagcaggcggacgaacagaggaggagcacggacgggcgagcaggggtgcggttggaggagcaggccggcggcgaggaggaggagcggcgcaatattgcgagcaggcggacgaacagaggaggagcacggacgggcgagcaggggtgcggttggaggagcaggccggcggcgagcaggcagaggacgcggatccgcctccaccgcccttcccactactagatcctccgtcgccgttgctgagccccccgcggtcgccgtcgctgagcccccaccggtcaccgtcgtccagtcccccgcggtcaccgagccgagccctcccacggccgtggtcgccgtcgccgagcccaccgcggctgccatcgctgagcccgctgcggtcgccgtcgacgtcgctgagcccgccgcggccacggtcgctgtcgtcgagcccaccggtgtctaccgctgctcctgagggcgagtagggcgagcgcgcaggctggcctcgagctcgagcgggtcacgccgttcgctcatcccaactgggacgagttcgtccgccagaatttgccggatcggttggtcccggatctgagaggaatattcctctccagggaccaacccatcccactcaccgctcaaccaaacaacctcaaaagtgggttcgtcccatcccatcctattccatccttgcaaccaaacgcacccttatagaagttctcctaagctaagtggtgcacacaatacgtgtgatactcaactatttccattcatgcaacacacacctgaactcatgtagtgccagttgtctctactaataaaatcaatcatacgtagtaatcacgccaattgtattcgattcggtctaagaaatgtgacgcaatcttggagaagagggtcttctttctaccatttccgaacagatcatcagagcaaggaacaaaacagtggagttgacctgaattttattgctgatttaccgatagtattaaaataaaattcagagaaagaactttattttacgagaagataatcagagcgagaaattagcgatgagctaaagataatcagaaattatctgaatcttcatggagtgatactgtaactgtaatattcgtgtgcagtctgcagaaaggcgaggggatggtggtgggagcaatggtgattttattgacctgctccctggcgaaggcctcggcgccatcgaaggcgaggtagatgtgcggcgtcttctccatgacgagcctggcgagggagacggcgttgacgacggtggagagtccggagacggcgccgcagcgcaaggtgttgccgtccatgacggcggcctccatctcgacggtgccgtcggcggtgagcacggagcccacgccggcgttgtagtgcgggcagttctccagctccctcacctgcacacgcatagatcgatcgatcgatcgatcgatcagttctccatacgtgtatgtatgatggagaaattaataaggtgggggcaagcagaggcaaacagtacgcacgacgagctcgacgacgtcgagggcagcgcggccggaacggagcgcggcggtggcgaggtcgaggcagcggcggagcgtggcgaggcggggctccctgcggtcgggcggcagcgagcgcgggatgtccccggcgccgccgtgcagcgcgaccgcccaccccatggatctatctatcgccagtcgtgcccgcacttgatagatgggaggagtgcgcgaagcaacagcgacaactactagtacatatatataccctggatctcgcgcgcgcgcgcggaaacgaagagagagagagagagggacgacgcggcgtctccctcccccctcccgcggtcaaaaacaaagcaaaagatataaaatagggtggatgatgatggatgggcaatggcgtcaggaggtaaacgtacgtcgatcgccaactgccgccactagcgaaatggctagggccctcgccggccggtgatgggtttgtgggcggtgacgacgccggcggggggcgtgattggtggtgggaatcagggcaaaagatcccaccagaatcagatcacgccgttggatagggacgtgccgagccgctgcccgctgatactctagtgagggaggctgctgctgatcgagtcgagcagttgggtcctcccggtgacgtatggaggtggtgccgtggtggggtccctccttgaacaacgggccagcttttctctccgcgactccaacctggccccaggaatcggtagcatctcttcaaaaacaatgctcgatcagccggtaattgaacatatttatcatttaaactacttactgctggcattatactacaatgaaaaaagaaattagaaaaaaaaattaaaaatagccaaaaacggtacagttgaaaacggtacccctatacgaaaacggcattcggtcgatcgggaatttccgtgaccgttttcatccctgcctagcaccacatccaaatccaaggccatctttctctagaaccaactttaggcccatctcaccagttcacctcaagccaaactatttatactccatctgttttcatacgctaccattaacttttacacgtacgtttataattcatcttatttaaaaaaatgcttatttaaaattttaataacaaaataaatcataacaaaataattttttaaataaaataaatgatcaacgtctgtttaagagttaacggtgtcatatatattaaaaaacaccttctatacgtaaactacaaattttttcccgatggactaaactacgatattgtattaagattggccatatagagtttacaataataataataatttttagtgtaccataaatatatttttttccaaaacatggttgattattataagaaaaaaaaagatgattgcaacctacagttacaacaacaatataagtaagacctaccaatacaagtacaatacaatacaaaagaggtatcttaaaactccacaagagatatggggaggcgagtgcagctacaatgctgaccgatttggaattcagcacgtgtaagagtatatgaacgaacattgggcgccatctttgatcatttggtagatttgcaagccagcgtcaccgaataggttggcagatgatccaataatgggttcacgtcctctgcctttgaagccaaagagtttgccgttgctgccatccacgccatccatccctcgatcaaccgttaggcccttccgtgacttactaccagctatttatttgatagaatttactctccagaaatataaagaaaacaatctccagaggcaaagcaggaaaaaatagcgacacaatcttcgctttttggaaccattggtatcgattcattcaagaaacaataaaaattccactgtacaataccatatttttgttgttttaaaagaaaagtacggtctcatcttttcgcttatgcttatcagctaaaatttgaattttcaacctaaaatttagagttgattttgggggttttttcatcgaagtttattttgcctttgcttttacatagctaagaacacgaatataaaatttttattcataaattatttttcgttttcaaatatgctgcacagctaatccttagaaaaggctataggaaaaagcgctcttactaacttctataaacactgattcgacctggtgtgagtaaatataaatttctacaaatagttaaatcaaatggtatcaggaagttttgtgaggatttcttaagtacgtgtggcaatactaacgatccatctttaaattggtccagtacaactgattttattaattaattggctgttagttaaccttgaaattggaaaaaaacatgcagagccgttgaataagatatggatgggatggatggcagcaacggcaaactttgcctttggcctcaaagacagaggatatgaaccctccaataacataacaaaaagaggagtaaggcaaatggaaataataatacccaagtaaattagttaattattattacataaacagatgcaaaggagattcactaaccggtgtgaatggacaattcagatgctaaacagcagtgtgctccaaacaaaacatgtccagtaaatagattgtaaaaaaaatcctaacattttgctttgtaatttgttttgcaacacaagccaagttgtgtatctacagttattctcatactgtagtactaaatcgcagccactccgcaatttgtcctagaccgtacattttacttgaaacaacaaatatatttgttgtacatcatttcgcgaagatatttttattttttttaaccttttctacttaaatttttgtaaatatactctcaaattttattttcaattctaaaccatctgactacactaatgtcgagcaaaacattattgccacactaatcccttgacatggaaccattatatggccacaccaccgcgtggcaaaggttttaccacgccatctaggttggcatggtaaaacaacactgacatgtccgccgtgggtgtgcgtggcaacgttattttgccatgccaccaagactagcctggcaaaaagatttagaattagaactaaaaataggtttcagaagagttttttgtaaaattaaaatttaaaaagttagcaaacaataaaaaaaatccatgcaaatgagaacccacgtaagatatagaatgttctcatccaactgaaaatcctaggctccaggtttgtcacctacaacaaaacctccggactcacggctaatcctaataatcctcaccaaagacggcaactgcaatactcagatactactatctcccagagaccaaacaaccttctctctacgacctgtattgacgaccttaattacgcaagaagcaaggatatgacgaattccaccactgatatccacgccccctgccttggcaaatccaccagcaccacatcctgaagcagctagctgccagcaatatgtgtcttttgtcctgtggcaaactagctggagttacttattaagggcagcttaacagatctctgtaatcatgtagttgcttgcagatttttcttcacctttgtgccagccctcagtttgccgttcgttttgagagtatccacagctggatgtccgcctcgcagaatttgcatcgtctccctgagttctgtgtgatccctgcaacaggtaaacggtaaattaaacctctgttatgttctgtcggtcttttattttcctgtgtgtgttatacagcatgctcgagggtaaatgacatgatatctgttggaagcatctatgcaaaatgacatgatatctgagttcggctgttgtagcatccacgaacaacttgtacacagttagctttccagcacaaatagcagggctaaaaggttcacatatggaaattaccagatgttttatttttaaagttgtacttataatggttcaaggaaaaaatgaaacatccatttccctattgttcactagcccccccccccccccccccaaaaaaaaaaagtatgatctgatcatactggaaacatgaaaggtctcttaaattaaaagtattctgatgatttcggtattttaaccttaagcattccagttaagtgcatcaaagaatacataaatagtctgagccctgcaccaattaagccttactttttggtattgttatgttagaaatgctatttacagataactcagatctcaaaggttgggtataaaatgttgattgatgctaatgtgacgaaagttgcactccccatcatcattctctttaagaataactttttacaacctttctacagtctaagatgaaattttgaattaacattaaactggtgggtaagcaattcttttcttgagaaggttaaaacttaaaatgatatttttttatcgtgaattacactaattagttaaccatatgtaactttgttcaatttgagtataattttaccaataaaataatgtgaaaatatccaacgatgttaattgtaacttaatgattaagaaccttggcatgtcaactaaccttcctgcgccatggttgaatttactttagccttcttagatgaatcatgaatgaaatgaattcttttaatcatgtgttaatttataaaaaccaaggttatagtgatttatggttttttgttctctaagactcttctgcttgtttcttgtgcaaactactcaggagccaggacttcctaggatcgtcataagatcaaatatgggctccgatgacaataaaagatttgatgattttcatgtcatcacaaacggaccaggaagtgatgcctattctaatgaggaatccatcaatctagtaagcaagtctaacgatttcagaattatttttatacccaccaagccccatgaactaatgcaccgctaccaattgtctctgaaaaggattcctatattgcaccaagcacatccttctgtagcaaaatctacaacccccaattatacgtggagaaaggaaatgggacaacagattggtgccaaactagtggaggagactatcctgagaaaagcagcataaattcagatataactctcagctacatagataagatactgatgcaggaggacattgatgacagaggcaatgaagatactgctcttcaagctatggaggagcccttctatgaacttcttggagaaaagtatccggcattccctcagcaacaaccactttgtgtatgtgatcacctgcagaacctcagtgccaacactgacaagtctaatggtcacgcatgcaatacctggtctgtcactagaatgacaaacattagctcaagtatgaattccaatggcaactttcaagggtttcagtttccatggagtttgtcttccattactagagagacagaacagttcactcatcactcaaatagaatggttgttggtctaaaagtggatggcctttccatttccgaaaagcctagccaggacaattgttcacttcaaattgatgcgcattacatgaggaagcatccattgtttgaggttcatgatagaaaaagttatccgtgtattgaagatcttgatttgttagaaggaaggagcaacaagcagtatgctatttactatgatgaaccgattcgggatgagatgtttgacaacgttctactatgttctgatcataagcctctagatgaaggtgttagtttgagcagagccatgacaaacaattcaagcaagtcttcacaaattggacaaggaaaaacatcagctcggcgaaagacaacaggcaaaaggatacaaaagagagatgttgtggatctaagaaccctccttatcaattgtgcacaagcagtatctgtgagcaaccatagcctagctagtgacatactgaagataataagacaccatgcttcacctaccggggatgattcccaaaggctagcactttgcctagcgtattgccttgatgtacgattaacgggaactggaagtcagatataccacaagttcatcaccaaaaggaggaatgtaaaggatattctaaaggtattccatgtgtgtctctctacatgccctttcttaacagaactatcgttgatgtctcaaagggaaaaccacaggtccacattatagattttggcatttgctttggtttccaatggccatcactatttgaagaacttgcaaaaatagaagatggaccacctaagcttcggattactggtatagaattacctgagtcaggcttccgaccatatgctagaagtaataatattgggctgcgattagctgattatgctaaaacatttaacataccctttgaatatcagcatatatcatcaaataaatgggaagccctctctcctgaagattttaatattgagaaagatgaagttctcatagtcaattgcatttacagaataaaggatcttggtgatgagacaatatcaattaacagtgcaaggagtagggtgctcaatacaattagaatgatgaagcccaaagtttttgtccaaggagtgttgaatggatcttatggtgtccccttctttttaacacgtttcaaagaggtcatgtaccactacaattcattatttgatatgcttgataaaaatattccacgagataatgagacaagaatgataatagagagagatatctatcaatatattatgctaaatgtcattgcatgtgaaggaccagagaggattgagaggccagagagttacaagaagtggaaggtaagaaaccttaaggcaggactggtgcagcttccattgaatccagccatcgtcagagaaacacaagatatggtaagaaagggttatcacaaagattttcttgtcgacgaggaagatcaatggttagtgttgggatggaaaggaaggatactctatgcatcatccacatggcaaccaaatgattcaggtgacagtgattaagaatgcgggatttgctacttgactacaaagaaaggtttgacacacaatgcaatctgccatttgcatacttatagggctctcagtctcagatttcattgtttgtgtgcaactaacagtgcattgccaaactagttgctatacatgtttttcagacacatgttcatcgttatgtacttatggacatacctgttcctaagaagtcagcatgtttagtagcttttttggtgataataactgatatgtgtttttatcgtattcatacttatcttcagagttcagacaaggctagtataagattatgtttagtatgttacggcaacatatgtaagttggaaaacatttgaccagctgtttatgtagcggggaatatcaaatccgaactatgtgtgagctacatatctaaaactatgttaactagtaccaactgtcaacaccgtttatgatacttctttcgtgggaaaagagaaaaaaatgcatatgaatcacacaatcaagatcctgtaaattctgcaagaaagaaagagaacatgaaaatgaacagccaaatagggaatgcaggcattgaaagcttaggtcgatctgctagccactgttggggatcacatcagttataaccatctcaaaaaaaagaagagaagatattgtctctaaaatcaccatagctttaagccagtaaaacaaagattagttcacgcactacaagtctacaagtccaagaagcacataccttgccacgcattctgtcgaaaaactgcaggacgccgtccccctccctcccaatccagtgcgatcgaacggccctcgatcacgagaacacctcgtaagcctctagctagcttctaggttggcgatggcggacgcgagtcggaagcaggcggcggcgcggcgagctagcgcgtggtatcggcggtggccgcgactgtgaggggggcctcgatctcgtttctgacagtgtcatggccgcacccacctgaagctgaaggtacatactggagtggagtggagtctgatagagtctatagagactgttctcttaacaatagagggccactatgcaacggaatcccgtttttaaacgggatgataccggttaggttttagagggtttcagaacatgatacctctgaaacctaaccggtatcaagtaatacctatcatgcatcagacgattcctaccacgtatcaggtgatactcgtgaggtatcatgtgatacctatcaggtatcagatgacttctaccacgtatcaggtgatactcgtgagatatcatgtgatacctatcaggtattagacgatttctaccacgtatcgggtgatacttacgagatatcagatgatacctaccggatatcaggtgattcctactaggtatcaggagctgagcatcgaggcggtgtcgccggcagccccaccctccacgccccatgtcggaggtcgttgccggtggctgcatcctccgtcatccacgcctcacatcaaaggtcgtcgccggtggttgcgtcctctgttgtccacgccccacgtcggaggtcgtcgccggggccacgtccttcgccaccacgcccacaccaggcttgttgctggtggtagcgtcctccgccgccatgcgccacgccgggctcgtcgctagcggccacgtcctccgttgtccatgcatcgcgtcgcgtcgaagctcgttgccagaggctgcgtcctctgccatccatagccacgccacgccgggagctcgtcgccggcggccacgccggagctcgtcactggaggctgcatcctccgccgtccatagccatgcgccggagctcatcgtcggaggttgcatcctccgtcgtccacaaccatgccacgccgggagctcatcgcttgagactgcgtcccctaccatccacaccccatgctacgccggagctcgtgcagcagtcatgctttgagagagataaggtagtttggtagaatgtataaggtagaaggagatagaatcggtggattggttggttgctgccctatcccgtccatcatggttgggacgggatctcatcagatagcatttccgtaacaataagatatctttacgtaaaaaacaataaggtatcttaactactaatacataaatatattttttattttttttcttttctctacctcatgcagcaaaattttaattttctctagtaaatgttaatagtcgactctaagccaatattatgtatagcgacagtgttttcctttcttcccactctcttttccacatcaccaaattatttatatcaattccgctaataaatattaaattatcacaaaactatatattttagataatatattacaaaactacatatttaataataacattatcataaaattacatgtttaagggtaagtatcgcaaaactacagatttaataataaaactatcacgaaactacaaattttggggtttaaatccttaacactaatactatgtttgagttgtaaatgtccaagttttgtgattaaattggtattaaacctgtagttttatgataactttattactaaatttgtagttttgcgatattccactttaaatttgtagttttgtgataaatttagtattaaatccatagttttgtaatacaccatgttaaatccgtagttttgtaacacatcatgataaatctatagttttgtgataactaaccaaagtaactatagttttgtgcaaaagtaaattacaccaacggtccttaaacttgtaagaaggtttcacctagctccacaaacttgcaaaccgctcattgagatctttaggcttagtttattttatcatcgcagttaaaagcctcatttgactttgatcttgtcaaagtggcatgccacgtggatgatcacatggaaaaaaatccccccccccaattttctccctttcttcttctcttcatactccaccactaaatgcatcggcggttgacagtggtgggactgactgcagacagagaagggggggggggggtggggggaggcagcgagagagacgatgtcggccatcagaggcagaggtgccgatggcggggtcagcccggcaagcaaacggaagctgggagggaggggggggggggtaacggcctcatattggttgaagcttggtcaggttggatttgagctggagtgggggccctagccagcggaggagctcgcagccaaagaagatgggtgtcggtagatgcctgcaccagcaagtggcacaatgctgttgctactccctcatccgcgacctatcgtgacttcgtgagcgctgctgctgccactgcttctgctcggttgggattcctcccttccaatccgatttaagtggtggtgtggatggtgtagatggggaaaatggcatggagctgtgtggagcgtcgtgtcggagtgctcgtagccctggtgccgctggatcccgtccccttgtgtcggttgcgtcagatccgacctgcccgatggatagcggcgttggatctgctgtctccttgcatcaccggcaccctgtttgagggattgtggctacagacccgcaggggacaatatgagagaggagcacctcggtcgggaccgagccccgtgacagggtcataggcttggtccaggcaggcgtctcgcctagcttcctctggatccactcatgtgaaacaaacgccaccgcaaccaccgaatccgctcgccgttgggccgtgggtgaagccgacaggcaacacgacatgcacggtggaggcaaaggaggaaaaatgaaaattttgccttggtatcgtccatgtggcatgccacataggcaagaccatactcaaacaaggctttggattgggataatacaataaactaagtttagggatctcgataagggttttgtaagtttatggatctaggtgaaaccttcttataagacgcaatttactctttgtgaaatttattctaaagattattatacatgctctcataaaggaaaaaaattaataaaatattgtttatcgatctttctttcataaatatactggatgtagattgatttgcataaatataccatcgaaatcgtcattagaaagcgtgataccgaggttcgcaacgggaaagtgcgatatcgccactgtatcgcattaccaatgcgcgagagcatgatggtctcgcgcgtcgaatgggcgaggagatttgagctggcggtgtcgcttgttggctatgcgatatcgacgcggtatcgtgttttcatagagtgagagcgccacgtcgtaccgatttgggatggagtagcgccatcggtctcgcttattagtagcgcgagaacgggatcgctatcgggtttagacgcgcgagagcgtgggcccgcggtgttgcacgcccgaatcgcgagagcacaatcgatatcgctctttcagagtgcgataacaggtgtggagtaggtcccacaggattttttttagttgggagatccggcagccgtggtatcgcacggtgggagcgcgagattgctcggagagtcggaggggaggcgcggtctcacacgttggttttgcgagaccgaagctgatgtgacactgacaccctcccgtcaagcattcactcacacgcattatcaataagcacacatgcaatcacagtagcaaaaatggaacacgtcaatagtaaaccactgcatccgaaaaagtttttcaattaagcgatgtacgaagattgtcatgaaataagctgcacaccccttaatttctaattgctcacgcgtgattaatttatttttatacgaagttttctacgtaattaacttaacattaacaccattaggcacgcagtggggctcacctgaccgctctcgcgttcctctagcgcgagaccgcgccgtcgcagtcaggggcccaccgctcttgtgttcctgtagcatgagaccgcatgggtcgcagtcacagttactgggcccaccggctcgctctcgcacttttaggccattcacagtggaagcaccggctatgaggtaccacacagtgacacgtaggatgaagagcttcagagccaatttcttcatagtgcaagcactgagtgggacccaccgagtgggacccacggatatccttcccccctccccctcccctaaagaattaaatttgaaaatatactgttcattcaattttttctcaggaatattcgggatgcaaaaacttgtgcagaaatataccatcgatgtcgcacttccattgcgcgaaaatgacgtggggatgacgtcgcggacagtaccgcgcggcgaaagcgcgagaccgcacgggtaacggcgcgagaccgcacggtctcgcgtaatggaagagcaagaccgaacagtctcgcagaagccatcagcgacactgtccaatgggatccatttgattagtgattaagtacttaattaacaattaactaatgataatttgtgattaattatcttaattagtgattaataaataaataattaattaatcactaattaggataattaaccgctaattaaatcggggaggcacggtatcgatctttgcttgagcgatagcgttgattgcttgagtggtatcgctgtttgcttgcgcgagaccgtgcggtctcgcactttccctgcacgataccggtcgcgacgtcatttccacgttattttcgcgtaatgattgtgcgagaccgatagtatatttatacaaaagattttgcatcccaaatattttaaaaaaattgaataaatagtatattttcaaatttaattcctcccccaaaatccccaaatcactcccaccaaatccaccgacgccggctctctccctctgtccccggcggcgacacggatccagctcctcgtctgccgcggccagcaagcaggacggcgccaccgacgttgactccggccgcgccatcccgtcgtcgctctctgtccctccccgccacggcccagctcctcgtctgcgcgcgcggatccggagcgctggcgcgggaggacagtggcggcggcgcggatccggagtggagcggcgacggcgtcctcgtgctcgtggtcgtcgtcctcggagcggtcatggcttcggcggtggaggtcctcgaggcgatggctcagatctggacctcggcggcggaggtccccgaggcgagcggcagaccccctccctcctccctctctttctcccgcggcgtgcgggaaagcaggacggcggcgagccgcggagctcctccctcctccctctctctgttccacggggtgggaggaggaggatgaggaggtggggggaggggccgcgctccgggctcacctgctcgtcgacttcaagccggcggtgtcgacggagggagctggcagcatcgacgtctcctcgccggcgctggcgttgccccaccctcctcaccgacgatggcgccgcgccgtttctccctcctccccatccaccggcggcgtcctccgggccgtgcagcggcggcgtcgattttgttgcaattttgttgcgatttgttaccgccattttgttgatttgttccgcgattttagggaaaaccttccacgggcggcgcaccggcgagcctttcccctccctctctgtccgccgcccctccgctctaactcccccactccatcctgccgccgccgccatttttgtttcttgggagccggcgccacagcgcgagggagagggcacggggtggcgaaggcacgctgcccacagcgcgcgtgtctcgcgatttcagcgttgccctcgactaagtttcgcgtcgctctgtttggtcccgagtttctctgtttggtcccgggtgcaagcgccacatcgacgaaaatcctaggtggcaaaaaggttccgttgccacgtccttgcactgtgaagggccttagagtgcgacaccatgcgcactcgctaatcggcaaagcgatattgtagcaccgcctaggccaccaagtgcgctccgtcctcgctgaccgaacgagcgatactgttctcgttctcacgcctcaattgtgcgagaccacggtctcgctcaacgaaaccgcgacggcggtatatttttgcaaatctttactcgttcggtattttcttgtaaattctacagaaaatacgtatatctctaaaaatttttccttataaagcttactacttcctcaattctaaattgatctacatatagtttttttaggttattcctaaataatctatatatttgtgttcatttattaggtctattcgttatttgtgcattggagtaaatggacatttatgcatgcatctatgcacacatgtatttataacccacatgcaatatcttaattttctattggctaggaaatagtggggatggtgcatgcgttgagtttgttgctagagtaaatatagtatgagagagttattagcttttcttggtttggtgtacctatgaaatatgtagatcaatttggaatggaggaagtactctataatcagaattaattaagctcctattaaaaaggggaattcattagtcttacaaattgacctgtgttcaccagaattcaagatggcccagcatcagaatatatagtcatttgagcctgcgactattcaactaaagtctagcaggcccaaatacgttactccctccatgatagttatattttatcttagcacacagacaaagataagtaattttacttattatacatttaaatatgctactagttatttctcgtaaacaagcgattcattaatatttacatttctcgatgctcatgtagccaatcttgtgtggaagaatggagagtcacgcattaaatccgagaaagtcattaagatgataagttgttggattgaaatatgcctatcaaaaataaatttttcagatttgaaaatatgcctatcaaaaatagatggagggagtattgttttataacactttccttaaaagtgagaaattaaattaacctcttgcatgtggatttcttttcttattgttgttttctttggtgtactcccacaattaaagagctagcatagatcgatgttgataggaaaaaggaaaaacatctcggtagggtacttcctcccgttaaaaatcaggataagacccggtgaaactcttaaaattctaaccaccaataatttctcaaatagtcagtttaaaaataaaagaaataatgtaagtaaatgtgcctcgaaaagtactgtcaccccacaataatatcataaatttattggaatgtaaagttaattatctgaattttaaaagcacgttttaatcttatcataaacatgaaatacttttgacagggaagagcttttatttaaaaaaagaagaagaagaagaagcagacttaacagctgcagatctcaatcgtgttgattttttttagataatggaatataatatcctggtctttgctcaaaaagaactacagccaattattacaaagatccactcgagaagagagtgtagttcaagacaagttgaacacactaaacaagagaagagaggacccaaattgagaaaagtaaaacaaaatgtgaagctagaaggccttgtccaggtctaggactgtagttcgaagccaatgcataaaccaatgacaatatcgttgcacgaagaggtttctccaaagcggtgcccccaaggaggatgcgacgtggatcgccgccaccgctcgttcggaaccgaagcaaggttttcactcggagaatatggtagggaaaggaaaggggtatgctaaaacaacgcctccaaggaggggaccgccaaatgacgccgccgttgtcagccggccaaatggctcggcaaggctttcgcccgcgattccctgtccaaacccacaccaccaatccgcacaagaaggatcgtcgtcggtcaacaacattatcccttcagcgattcggccaaggccaccgtcaataattgttcccgctgtcgctcaatcatgcagatagaccaaagccaacttgtgcattgcagatgcagctatgtgctcatggtcatctcttacatttagtctcccaacacaaactgcgtgctcgatctgctcatgatctattttgttgcaagagtgcatgaccaattgaccctatctatatacatactctactacatgttctactacatgttatgtacttcattcgtttcaaaatgtaagtcattctatcatttttcatatttatattggtgttaatgaatctagacatatatatctatctagattcattaatatcaatataaatatataaaatgctagaatgacctatattgtgaaacggagggagcagataattacggattaagatatgccagggcgagtgcatgcatgcaaactagatcagtggcttggtctatatatatcagctaatttaacttagcttggatcgatccacttgcacatatggcccaagtagctttctctttttcctctgcaacatgtgtcagctttagcacacagaatggtgcctgacgggataattatgcaaagaaactagaaacaaacacagacacatattcttccaaatcaagagagtgtgcatatgcaatgggtatgtgctttcctgtcatggttcactcaaagttataaaattaaaagttgtccacagccacaacatgcatggtatatatatagttagccatggtaatagatattaatgaagaattagtcatggcgatattggtgatcatgaatgcatgtgtcatttcagggcacatgagagcttatcaacgggggtgaaaggagtggtcatccatgataactagataaaaatggttgaaaacaatattgtttagaaaattagtcgattgagaatttttcatatttaccaatttaattattaagtggtcattgcaatacatagccgaaacaaattagagaactcaaattttatatataagctaggatcagaaatgactaaaaataatatcatttttataaaaacgatgctcggtccgccaagaattttcatcaccgttttcgacacattaacttcagcgtatatggatttgactggacatagcgttcactgtgtctcattgtttggattatgattgtttggattatgcttatacttatgagctaaactctaaattttagaatttaattttgaatttgattttttttcttcatcgtactttattttacaatatttgtttttaattgctaatgtcacgtatataaaagtttactcataaatggttttttatttgctaataagcaattcggataaacacacatgaagcgaaacaacaagggatacatcactatctattcttcacacgatgacaagggaaaggacatgaaccgaccggttaatttttctttgatgcgcggattggttgaccggcctgccgatgaaatacgttttggaacaccatttccatgtccaatcatgtctcagagttcacaagggggtgttagatcataccaaaattgaaagtttggttgaaattggaacgatgtggcggaaaagttaaaaatttatgtgtgtaggaaagttttaatgtgatggaaaaattgaaagtttgaagaattattttggaactaaacacgacctaagttcgatcgtgtctcagagttgacggtaaggtatactagggtaggcatgcagactgccttaacatatacttcctccgttttacaatgtaagtcatttcagcatttcccacatttatattggtgttaatgaatctgtaagtcattctagcatttcccacattcatattggtgttaatgaatctaaattaattaacaccaatatgaatatgggaaatgctagaatgatttacattgtgaaacagagggagtatttacttgtggttaactattcgatcgtggccatatcctgaaggaggtatttgtcaaattaaccagcaatgcactaccgttgttaaccacatcagtgacggttagctgagaactcccgggtgccatgccatgtgacaagaatgttaatatttggcagataatcatttagaaaattaaagaactcatcaaaaaagtttgtatgaacaagagtgtaggggggaatatatataagtcggtgacatgatgtccagtctccattctctattaccccctccgtctcataatataagagattttgagtttttacttgcactgttagaccactcgttttattcaaaaaaaaaattgtgcaaatataaaaaacgaaaagttgtgcttaaagtactttggataataaaacaagtcaaaaaataataattttaaaatattttgaataagatgagtggtcaaatagtgtaagaaaaactcaaaatcccttatattatgggacggagggagtagttcatctttgtactctttctagttttaataaatgaccaccattaaccttttaactcatatttaattatttatattattaaaagaaattgtgcaaatatgtaaaaatataagtcatcgccttaaaattggtgataaatcaagtaaaaataattatgtaaaatattttagataaaatggtagtcaaatatatatgtataaaggtcaaggatactatgtattaaaaatcgaaagtagtatattgttcgtttttggatatggccgtcatctgtcacttttttagaattagatgataggaagagttattgtttaatgaatatgcaatgacatgaatatatataaatttccatgatccactgaattaatcttttccatgtgtcattatcaacagtaaaagtttttacggtttgatcatatatatgtgttctaaaaccatataaactaaaaaaggtgcatttttaaatatgaaaaatatatatattgtttgctcagtagcacatagtacacgacaaaagagttgatcagatgtggaagttggcacgaaacttcgatcgtgctgcaccaaaaatgtacttgttaaagtcgaattttgcttgtaccctttttcctccaattgtatttactcctactagcttaggatttactccttccattccgaaataaagtaaacttcaactttatcttaaaacaaatcattatttatctatccatccactaatactactccattctataatattaattaaaggtattttagtcttctctttctgttttgaacttcaccttataggaagtcaggagtaggttttttaggacaagcaactagaaattcctaaatgtggataatatgaatatatagattaattagtgggctcggtaacgacagaaaagattcttcatctatgcattcttaaaaccaccatgtcaataatagaataaaaatattagggtcttatcttttcgcttatatttatacttatgacttatcagtcaaaatttaattttaaaccttaaatttggaggtaattttgaggtttctttatcgaagtttattttttagcctttaattttaggtcgttaagaacacgtatataaaagttttattcacatattacttttcgtttgcaaatatgccgtttcacttattccacgaataaacaaaacgatggctccgttagttttcaggccttgctgtaactagtaataatagtataaaagatggaaattattagatgaaaatatgtatccattttagtagatatcgttttaaatgattccatattttagttagaaaatagtttctatgaccttgctgtatctagtaatagtataaaagtaactatgctttgactacatgtatgcatttaaaacgacatctactaaaagggatacatattttctactaagaaatacaactatgttgtttgcttggtggcactggtgcgcgcgggcacatatacacacgacaaaaagttttgctcgttttaatggaccatctccctaataaatatttcacactgctacagaaaagattcatcggtgatagtcgggacttcttatatgtgccgggttatcccctagcacaacatttataataaaaaaacgggtactgataactactcatcggtaccggttcacaatactgatgaataatccactcatcagcactgatgagtagtcatcggtgttggatcttatttatactgggtattgactgtgtggatgggcgagatacctctatcagtgccggattttatccacgggcactgatagagcgacactaatgacaaattttgtagtagtgatatggtctccatcaaaggaactttatgacttgaccatggcaaggtacacgtaatcaccagtttatcacaagtggaagttgagcaggaaacttcgatgctacgtgctgccagtccaaaactctcaactttatacagtcgaattttgcttgtatcgatccttaattagttagttgttcctccacttgtttagttaattactgcttaagcttagttacaaagaaatgctttcggtggatgtgcacatctagatattcgtgggtttggtaatgacagataagaatataagatcatgcacctgcattgtgaaaagcatgctaatatcctgaaattattgatttttatactataagtaatgagtatgacgttttcatatgtgctacctaagtgacgtttttgtttctcaaattaagatgtcgtttccgtcggtcaacaggggtttgactattagtgatgaaaatataaatgttttaatacgagtggcacatgtacgtcctaggtataatagtaagttaaaggaaattgaagaactattatagcaaagatgatatactccctccatggctccatcccaaacagcttaattaacactagacaacgatgttattgttatcgagcgaccttaattactaccctactgtttcattgttgctaaacaaattgtcgaaaagtcaacctgaatattccttggcaagtaccaaaaggaaagagagggattgagatgcaaccttttgctgctaatgataagactgattactccaatgggctagctggtcatatgttttttttttgcaagctttctttctttcttttagagtaatttgtcggtcgatgtgtcatcaactttaatttgtcatgtactagtaattaagactagctagtgaaagtatctgaatcatttcgttctcttttgatacagatacttgtcttgttcggcaattagctgagctcacttgaatcttccttaattttggtgttgaacgtgagagagatggctgactgcattctgactcaggtgttactcaaaagatgataaaggaattaactgcaattcatcatgacatcttaaaaaagattgcttgcagtgtactcccccaccgatcataattactccctccgtcccataatataataacctaagaccagacaagacatttttataagataacgaatatgaacagatgcatgtcctggttcgttaaactatgaaatgtcacatccagatctagattgctattttatgggacgaagggagtggatattgtgcatgtgtgtcatatattaattgactcgagaaaatttcttaatctgtcacaaatggtaagaaaatgctcactgtagtcctctagtttattttttccccctaaaagaataatatttgtgcctgaaactattgtacacgaaaaacaagtgcattgatatagtcaacgacacatgccatttactaggaaaaaaacatacgtatgtcatcaaatattctgtcctcccacttgttttggttagctagggtaatgacattattttatttaatttgttaatgtaagtcgttttcgatagaatattatactcatttgcttgcggaggatatgctgaaataataagaagaaaactggcttaaattagcaggattggaactagcgaaattgaccattggatcaggctaaacattgatttatatatttgaaaacatatccaaattatttgaaagagcattgacatggtggcccacttaggtaagctttctcgctcattgctccttggccgatgtactccagtgagagacgaggcaatttccttttcgtacgacacatctgggtgcaaaaaaagggaaaaaacattccatccttttcatattatatgattatttgccttttttcaaattagttttaagtttgaccaaatttattaaaaaaatattgcaacattacaaactcaaaacaaatatactattaaatattaaatgttagatttaataacattaatcctgtgataggttttgctcaatttttctataatcttaatcaaattttaaaagtttgactaagaaaaaaaaatcaaaacgtgtaaagtatgaaaagggtagcacatgcataaaaggaagtaaatggtgccatgcctaaaaaaaaatgttgccgatttgccatgttcgccgtgcacagctgcatgggcacattcatttcctatttccccctcaaccttccatctgttcaccaatgcaatttttagctcaacatatcatatcttagtataaaattatgcccaccaacttttaaagctcaatatacaaccatgccatattattacccactagcaataattacatatttattctttttaattataggaaaaaaaattcattgcgctctgccattttgaactaaaaagaatcagaattattatttttaaagaaaaagttcacaagaaacaattcaatccaattgctaaagaaattagacctttcagccacgatactgcacgccaagaaccaatgtcgttgtagaatttcccgaccatagctatcaagttgtcttgaccagaaaaaaaagtttacataaataaaatgcatgaaagattacatttaaaattttatttaaaaggatcaaaaaatataaaaaaaactagagaaaaaaaataggcgctccaagcacactgtttttggtactagtatcccccagtgtgaacgaagcaggcaaaagacggacagcctcagaaccaaacaattctccagattctgtccgtggtttggtgagctggacagccgtccacacgcaaatccggaataacccaggggcgtaggtgcaaaatgcgcaggcatgaaaaacaacccgtaggccaatcccagccaagattttgggggaacaaggagagagagaagaggagagaagaggccattcttctcttctccaccacctactctctctctctctctctctcatctcctgccttctctctaggatcgccgccatccaccacatcccacgctttttactgccgcacacataagagcacaggaggaggaggaagaagaagagtagagagagaaagatagagagaggagcaggagaagcattcgttcatccaggagagagagaggcttcaagttcttggtctcctgctctgccatgtccatgggtatccatccatctctgctttctctctccctgttgtgttgggctttcttgttcatgtccttggaatgtaaagtttggttctttttttttatggtacctttgtccttcctttcctcttgatttcatttagtaacggtgttaggaaggaaggatattctttctgctctgttcttgattttgtttatcaattttcctttttttatggctcaccctctttcagatattgccatatcagaaataaaaaatctgattttttttcatatattattcatcatactagttttaacctttttttttttgaaaaaaaaatatgagagagaagaaaaatcagcatgtttcttgctgttcatcagaagctgtagtgaaatttaatggctgcatgtggacagatgaagggtatggccctacctgggacagcgacgacgagtacgacaacttcatacgcaagatgaacccgccaaggtgcattcacgtgctcctctgctcctgcttgtctcaattttgggagattactatctcatactgttatgttattaattctcgattcttcatcctgcttgtttcctttattaactgtaggatcgagatcgataatgattcatgcaacgacgccacgattgtcagggtaatggccctactattttttttaagtgaataatggccctactatcatctgcaggatattcctaatccacttgatgaagattcttgattcatctctttagtgagaatagatactgattcggttttggtggtaaattgcataggtagacagtgcaaatgagtatgggattctccttgaagtaatccaagttctgattgatctgaatcttgtgataagtaaggcgtacataacctcagatggtggatgggtcatggatggtaataataaagcatatagtttactaattagtttacacctacatattcattttttattttttattttttaactaaatccctatttggtttcagtctttaatataactgacaaagaagggcagaagcttaaagataaggctactattgcgcgaattgaagactacatttgtaaggtatacaagaatccttggcaatcttcagtatgactactgaatgatcacccaaattggactgacaactaatgcatttttcttctgaaaatctacagtctttgggtgcagattcaagatacataccttctcgccggagatcagtagatgtcgctgcttcgagtgatcacaatgtcattgagctgacagggactgaccggccaggcctcctctctgaagtcagtgcagttcttgcaagcctcaagtgcaacgttgtcagcgccgagatctggacccataacaccagggctgccgccgtgatgcgagtcaccgatgagggcaccggatcggccgtcacggacgccgacaggctcgagaggatcagggataggctgtcctaccttctccggggaggcaacctctcgcgcggcgcggccatggcggtgtcgacggggacctgcagcacgcacaccgagaggaggctgcaccagatgatgctggatgatggcgaccatgagcagctccatcggcatcctccgaatcagtcccagaggcccaatgtgacggtgagcaattggaatgacaaggactactcggtggtcaccatccgatgcaaggaccggccgaagcttctcttcgacacggtttgcaccttgacagacctgcattatgttgttttccatgcaaatattgatgccaaggataatcaagcttaccaggtgaatatgctgaaccaaacatgtcctaatttgccatatccattcttcatgagattcagtttgagaaaacatgtgacattgggggcgcttttgtaggaattctatgtgaggcatgtaaatggatctccaatgcacactgaagctgacaggttgcgagtcatccagtgccttgaagctgctattgaacggagggtgtctgaggtaacaactgaatgaacttttactgtctcaacaaagtagaaatcaggaccggtgttcactcgagaacatcttctgaatgttggttgttttcagggtgtgaagcttgagctctgcacaaatgacaaggtcggcctcctgtcagaggtcacccgaatcttccgcgagaacagcctgactgtcacaagagcggaggtgagcacgagaggaaggatggctgtcaacacattctatgttcgcgattccacaggagggacggttgatcagaagacaatagactccatcaggcaagccataggccagaacattcaggtgaaaggccagcctgagccatcagagccacagaagaaagagtcacccacatggttcctcttcgccaacctgtttcgaccgagatctctctacagtttcgggatgttcatgcgctgatctcatgagccgatcccgaaaaccgcactgaaaattcttagctgacgaagaggcccaagaattcaggaagttacagagagggccttcattctgttcaagacttaccagtggagtggcgcaggaatggaatagtagtgtaggggttgtttatagatcatcatcatttgtaaatatactcgaattcgccatgtccacattgtacatatgtagataaatcatgtaaatataactgtggaagatattgttttataagaaatatgttagattaacaaaaaaatattgctccttagaaaattcattttaaaagcagcaattttggccattgctttcaaattattgtagctcacctctcacctgaagctggaatcttcatgacagcaatggcttcaaattctgtggtggggcaagcagatgcaagtcagtggacaaaagcatgctattatcttcttacctgaagctttgctgacaaagacatattgcatcaaagcaatatcacattagcctgattctgataatgatgcatcaaaagcaaatcaacttccttgactaacctgcaacactgtcatcaatcacattagctgttattcgtcaacatgattcctcggttgatgacatggcgctgacgtctccgctgagcggctaaaaaaaagagcagctgaaatgggaatcaagaaataggcagcatgagagttagtttggaatgtctcttacctttagggatctctatgactttgcccatcacttagtgatgcttttttggctctggtgatgattgattggatgcacatattgctgctatgattggtgacatctaatctagagagcaagtcatgaaaaaggcagcagcaagcactgataaaaaaaagcaaataatgcaggcttaggtcagaactagagccttcagaagcaggacatgatcacattagcaaacagtaaagcagcttttgttcatgctttgcacacagaaaaaatgcaagtgcgtgtatgcatgcatgcggctccattaggcgcatgcgcctaagcttctccatgaattgagtgggactgtctgaataatgggcaaagtggatggtcacaacacaagtggcctctctgattgataagcaattaggcagatgtaagcatcaagatctaggcaggtgctgatggtgatgttgctctccacatggaagccatcccaattcccaattcaaagcaggtcagcatttgggcagatctaaagcaccagcctaatttatcttctgatgcagaacaccatcatcaccaacagcaatagagttagatgtaatgctggtgaacacaatgcttcccttgcaatatgagcaaatatttcagaaacagtgaacaacatggcaaggaatggctataaaatggaagtaatgttacattaaggatttcattggtttacattccagtacatctgacgagtgcaaaaaggaaagggaacacatcaaaaactcttggctgtgatacatcaaaattgctattgcaggagtataacacagtagagcaatccatttcccgatacaagagaaataaaaaaaccattgccatgttggtgctttgttggggagattgcaaaaacattcttccaagtagctttcatgcaagtgacgctccgtctccatattgctaacaagggagttctgaccatctacttttgtatttcggtgtgtccacaagctagaagttacaacaggcagttaaaatggagcatgcaaaggccattcgctgtgtctaaatctccagtacccaagaaagatggtgaactgaacagcatggggaatataatcaatatatttacacacactaaatatggagaaaatgttaccgcctcctttttctgcccttccctagctgtccagatttaaaagcatgttcctgctcctgaaggaaagccatggcttttccatacttttcagctctctcttgctcttgttttatcctctccttctctttcacagcagacaggaaataattatctttacgcagttcgcgcattgcacccttcttctcactcttaaggcgtttcttcattttcttcatttgtgccctttcccgatcagggtcataatcaaggcctttaatgtaactgcagaaagagaagaaatggagtcaataaagaatgaacaacagaaaacccttcaagaagaatacaacatgctgttaacacagaatagaacaccaaaaaatgcatacttctcttcaaatttcggattcaactgcctgattggttcaggcttctgctttcgcatttggagtggctgccttgatgcatggacttcatcacttctgtttttaatcaactcaatgacttcatgtaaaatgtattgtaacaatccaggcaagtctgatttatccataatttcttgcatcaaagaagagattggcaggaaaatttcggggaacgaacatagttcttcgtgtataataacaaatccccttaaacattcagccacagatagaagtacactagccctgttagaaaatgtacgagtgtaagattatgtgttaagtaaaccaataatattcaaaatgccagagaaaacacatcctcacttgaaattatcagaggagaaataaggagcatcagaatccatgcatatgacttccaggatattcgctggattcacctcgtgcactttttcatggatatgaagccatggttccattgtcttgagctccaaaaattgatcattgatctatacaaagggtcgcttgatatcaagcagtgagcaaaaaaagaaaaaaaaagttcaatgcctgaaactaaaaaataccttttttcgtaggtcagatcccaggtttcctcccagagatgttaccaaaa

SEQ ID NO: 46584 - DNA, 1526 bp, Oryza sativa
agactaaaatgagtaatgagtaatgagttatgtttatattttgagttatgtttatttgcaggcatctcaagaagaaataagcatcaacgacaagatgaaattaaatagagaaaaaacaaattcaagtgatgagtacaacaattgtactctacatgatgaatggtctcttttaggagtaagttttggaatgacagaatttataatatcaaacaaaaatcagcaatacatgtcataaaataaatttgttttcaatttgcaggctcaaaatttttcatatacaagtctcatggaacaaattatatcatctcaaccttcaatatctgaagttcaggtattttacaagtgtaataaatgtaatgttgaagacagataaacaatattattaatgtgtaaaactaacattttaaatttcaaatgcagcaagaaatatcaacagaatcaaactttgttgctacaccaagagcatttcaggtactcacatatttcataagaagaaagaaaatagtaaatatgtattaaattttaaataattgtcttattatttgaattactttttgtgtagaattcaatgatattgacaacaagtagaacataagatattccttttgatatggattatgctaatacaaatcaggtatgaattaatttatttttttgtttctataaatcgtatttgtgatacaattaatgtttgagtttacttatgatattatttgttctaactatttttaaaggttgaagatgaggatctggaagataatgaattggaaaattggaatcttgatatgttcaatctgtcaaacggtcaaaatgtaagatttactaagaacttttcattactgaaaattttacatttgaagaatgttattcaaatctaaaagataaaatttgatttgataataattgttgtgaaattaaagaaaaaaactttttaaaaaataattgtttgaaatatgaaattgaatttttgaataagcaggtgcaaaattcagctgacaacagtactgaaattggaaatcaagcaacaacaaatgttgatacagtggaaagtaatgatttagatgcaaatggagaaatgttgacagaagaagatataaacaattttttggagcaagaacaagaagaagctacaaaaggaaataatgcagcaattgatgcgaagtacattccaagagttgatatgcagttcaaatcaattaaagaagcacacgatttctttaacttttatgctttgttggctggattttctgttgtcattgctcacagttaccacagtacaagcaaaaaaaggaatggagaagtgattagagtaacattcaaatgcaatcgacatggaaaagcaaagtcagaatcacaagaagaagaaacagaagagacagtagtagcagagagaaacaataatgagattaaagccacaagttgtaactgtgcactggtaatttctaagagaaatttgatttggagaattataagggttaatttagatcacaatcataagatgagtccaagagatgaagttagattct

SEQ ID NO: 46585 - DNA, 6367 bp, Oryza sativa
ataattcaaggacaaaaaggccaagcaaactttggtctcattactacattgagtaccaagctgtcaagctgtacaattcaaaaatattcaaaaagttccaagttgaacttaagaggacaacaagattacaattgattgaggtcgagaaattgaagacttatgaagtttttcttgcattgaatcagaaaataaaagtagtaagaagaaggaagtaccttgtaattgttgactctgaaaaggaggaatacacttgtatttgctcaaaatttgagaaagatggccttctttgctcccacatattgaaaattatgcttcacctcaacattatgaagattccaaagaaatatattatcgatcggtggagaaaaaaggattacaaagaaaaatatgattttgaagatagaattatacctttatcggagagctcaatcctcagattcaatattctgtcaaggaaatgtgctgaaatagcctcacaaggatcaaaaagtattgattcgttccaatttacagttgatcagattgacaagttagaaaaagaatcaatatcaatgaattcagagcaaagaacaaagcagcaaatggagatagacaaaatagatacaacaaatggagaagtcattgaagaaacagaagaaaacaatgaagaaattttgatagatccagacatagcaaagtcaaagggaagaccatctcaaagatacaaatcatttagagaggaattacagagtaaagaagtttatcattgcagttattgtcaacgaacagatcacacttttccaacatgcccactaaagcacattgaatttgattggccaagaaagaaaattagaaagacaaaaaacacagcacaaaaggtaaaaaagtatttattttaagaattctcatttgatttaaaatatttaatttgaatttgattgcaattgcagaatgcagaggaagaacaaactgatggttcaaagaagacaaataaagggaaaaaacaagaagcaacaacacaagtattaatggagcaaaaagggactaagaaaagaaagacagatggctaaagttgaagttagaaagtagtgaagcagaaaatagttatactgaatatgagaagttatattcctgcgtagtgaacaattgtaatagtcgttcagaatagttacaatatatgaagtttggtactttttgtgatgtgacctttcaagttgttatcttactataatagttacaatatggcgcagaaattgtatctatacaaatctactataaactgttgagctaaagtaatcttggttttcaaagtattcctgttgaattaaatcagccctacaaaaaaaaagaaaaaaaaagctaaatgtaaaggtaacagaagaaaaaaaatttaaaaacatattttttaaaaaaagttaaaatgactacttacctttgcataatagtcagtaacaagtttctttgttgcagagttcagcacaatgttgcatggatggaaaaacaatttgttgacatattgaatccttatgttaggaatgtctttttgagagaactggttggttagcagaactcttggacgccaaatttccatgaatttcagagtaaaaataccacaatcaaggctaaaaaaacagaaataaaaaaaacataagtcataaataataaaaattactagaattaaaataacattcaaagagttaacatttgtaatttaccgatttgtttgtcttggacgaggtgggtatattatcttgaaactagcaaagttaattggatgttcagggacaaatttcctccatacaattgaaaattttgatatatgacaaaatgaaacaatcataaaaataaattattctatacatataataatttgcaaaaaaaaaatcataccagtctgcatctagcattgtattgatagtcttcttcttcttcttcaaataaggagtcaatgaaaacaaaactctcatctttcaaatcaacaacaaacagaaaccaatgcctcaaatgcaatattgggaaaaacagctgaaaaaaatgatacaataaaaacaaatgtaaaaacagagaaatctaatacaaactaattcaattaaacattacataagtacataccatgtcacatatctcaattggtctagcaagtgatgctccagaaaaactcttttggaccattccaaaattagtttttgaagggtgtttcataagatcattctgaaataaaaaaaatacatactcaatttgcaagtaactgagttgtatttaataaaaaaattaaaaattacaaacacttaccccaattgaagagaagaaatagtgtcttttggattttgaaggatgaatcgatttaaacatatatcgacagaacacagacattacaaaatttgataattctccaccttgtttgaatgaagaaccaaaagatgagaatttgcagtgaactccatcaatattaacagtttcttgactgcagtaacagtacaaaacttacatatatgaagaaactgaaaaaaattacatgaaaaaatatttaaagttacagttaattttgcaagaaaaaaaaagtatgcagacattctaacatggagcagcacatgcttgcacaagcattcaatcacagctaaatgttcagcaagtaaatataaaagtgtcaagcttatcccatagcatatcaaaaactataaaaaattaaagatcatgatcatataaaacaataatttgcaatcagtcagaacacacccttgttggttatctttctcaaaggtttttctctgccaaaaaaatttaaagaaaagaaattaaaaaaactaaagaaaaaattattcaccaatgtaataaggtaataaaattaccttatttttagactgttcaccaagcatgcttaatttcattttcaaagaatggagaactagatcattgtgaatctctaacaatgcatcatcgataattgagtctgattcaactttatgtctctgaaaataaaaaaatatcatattaaaaaaataatgtaaattacaaaaatctaaatatgcattaatcataccttctttttatggtcatctgtaaatggccttttaccaagctttattttcaatttcttcataagctcttctttagttaaatgaagcaaaggatcattttcctcaaaatgttggtccttaataaaaaaacaagaagattcaaaaaaaatattgaaataaaaaataaacttccatgataaatgaacatgacaaatgaacttacatgattatcagaactttcatcatgattagataaatgaacatcactatcatgattatcagaactcaaactacaatcattgtcactgttagattcactagaaatatcaacttttgatctttttctatgacccatgactgcaaggagagaaaaaagatctcaaaacataagtattatggactaaaatatataacaaaacagaataaaacatacaagttaaatgcaccatgtcatatgaaaataatattactttcatatagtagaaataattattttcatagagtagtgtcaaatgtgtagcacaaactcatgtcatatatcagagtatagtgatgactaggaatactatactcttctccttctgaacaaatgtattaacaatactcttctccttctgaatactaaacctgagcatgcaaaatgaagagacaaaaattgactactataaaaaacattctagtacagaaatcttcaataacttgtgttatttcctcatgtaaggttgtcattgaaagattaaaaataccaaactaaaatgcaaatggcatatagcatttgtggatttctagaaaaaaaaacatcctgaatcagtgcataaacatccacctaaatagcatatagcattttcttgcatagatttagaaactgacatcaaagcattactacaaaatcaatcagtgcacagaacatgcaaatcaaggatatacagaagggtcaacaaatgtacattgcacacatctagttcacaaaagcaaaagcacagatctagttcacaaatgtaaaaaagcaatcataaaaagatatatctaaaatgaaatgaatcacacatctagtccacataaacaatatctagggctaagaacacaaatcacaaccataaacataacagtacttttctcattttgaatactgaacctgaacatggaacatgcatcagagacaaaaaaaattaacaaccataaataccattctaataaagacataaaacttgaaacttagtacaaaccagcatatcttagtcatgcaaaaaacaattgataatatcaataacaaatttaactgctcatataaggttgtcattgaattaacatatagcatttgcagatttctagaataaaaacatcctgaatgcattactaaaaaaacaatcagtgcatatagataggtgaacatatgtacattactcccttatttgcacacatctagttcagaaaaaagcaaaaaacacagttctagaacaaaataaaaaagcacgtaactagttcacaaaagcaaaagcgcagatctagtgcacaagaagacaatatatagggctaagaacacagagatcaccgagtcataaacgaatatgaatcaaggggattcaccatatcaaacacatacatagattccgagtcgaaacaaactcagatctacaagccccacgaatcgacgacctaaaacacaagggaatatcagaaaaacgaaggggaaactcaccaaaatcagctccaacttcacagccgcgtcgtagccaccagcaaaccaaaaactacgagaagagaaaaatgaagagatgaatcaacacaagagcaacaaatagaagaagaaatcaataaaaaatggaaaataaatctgccaccttcacctcccgcaaactgcgcaacaggactgcacaatcaccggacggaatcgccaccgctcctcccgacggaaactccgccgctccgcccgacggaatcgctgccacgtcgcctgagacgacgagaacgagagaaatatatctctctctctccctctatctgactcactctctctccgtcggcacaaaaaagacaagcgcggatttcaaaattcgaacagtgcccatgggtcccacacaggctgtcgaaaaaaatttctgatgtgggtcccacataattaccacacacaaaaaaaaaagcccaaaagcctagacacaaataaaaagctcataagcccacacaccgatactacaaaatgaactacaagccagtacgaatcacaaagaaatccgatggcttaaaaaacgaacgatagagccaagaaaaaacatgtgactgccaaatagccatcccgttaaaaaaatgcatgcatgtagtacgagtacgatgtagtagactccacgtcttctccatatttaggcgtcactggttaaggtaaaaacgagaggcctccaaatagattttacgttttctttttgttatatttttgttctctgaacgaatgattgggggttatgcatcattcatatggggtgatagaagtcctcttgatagacaggactagcgccaaggaaaaagagaacaaaaggccaagcatttgtctaacgaagatcaaattaattaaaatcagatcatctcatcacctccgtgattgtgggcctgtaaactaatcttctgcagtatctcctcttccaaccaataacgtcgttaattaattagctagattcgctagtcaacattaattgcttgaaaattttcacatcgcatcattatgagaagagagaatcatatccataacgtagtccgtttcaaatgaatgaaaacgagattagaacgaggaagcgaagtacgatgagagagaatatatagtttccgtgacattgtacactcacataaaggacgtagggatcagacggccatataattatatatatatagtcttaaaaaaatatggacatatagttcagcaatgtatatgtgagagtgggcagcccaatctatcacccgtgaactatccaggttacattcattggacgagatctactccacaagtttacaatcggcgtataatttttaaactctgggtctgcaaaatctaaacgtgtgttcggtactttggtttggagatgaggtaagataggtaggcatattcttgttttctgaatgaaataattcctaccactgtttgccacgagagatgagacggtgtggcctatgggtccacagatttttaaggacatggctacacagctatggtagctgatttgtctaaactagctaccactccatctatgataaacactatccacctacacttcaaatacaattttctcttaaactactcatccgatttacaatccgattacaccgttgtgttcgtaacaattaaatctttacaacaagatctcacatgattatattttgatgaa

SEQ ID NO: 46586 - DNA, 19808 bp, Oryza sativa
aagtaacttagtgaaatcttaaattacaatttagatatattacaaaagtaatttgtgatcttcatcaaaatataatcatgtgagatcttgttgtaaagatttaattgttacgaacacaacggtgtaatcggattgtaaatcagatgagtaatttaagagaaaattttatttgaagcatagatgatagaaatatttgttctatttgcttgatcaattattactatagtaaagtatgattcttcaagacatatctggacaacggctgattggatgataaggtcgctcattatgactaaatcgagagcgctctcgatttagattttacggatttttaaggtagagagttcatcgggatgttaagggagtattcttcttcggagattacaccattccatccctcaaacccttgaaaattggttcattttatcctgatccatcacatctctttagccaaacacatattaaaaaacaaatatgatacgcaagcattgtttccattttctttagttgtgcttctccattatcaattgccaaaatgagattctaaacccaacattatttatagatgtgcagtggctaagcttggctgcaggatcagatcgaaggggccaatagcccaataccaaatgctagcacgaagggaacacagtggttggaggaatgtcaaacataacttatcattgtaaaccagctagcattcttctatagtaccgtactattcattctgcgtaatctaatcatcgagataagggagggttaggctggcaccattttggtgagttacaatacattaaacctctgatcagagcttgacaacgttttccatccatcaaagatatcaaatttttcgtgcactcggatcagagaacgatcgaccgacaatataatcggccggtgaatcgatccggcccaagcagacagcaccactgtctgaactaactaaatgtctgcaatattgtagtacgtagtacttgcagagccggtgttgaccaactgatcaaactgttcgtgatatatcgtcgtgtacgtgcagatcgatcggtggtacagatgtgggcaattataattgagatcgaccacgctgatttccaacgattggtcgtgcgtctctactacgtacgtacgcgcaggtggttgacacatggatattaattaactatatgcacagattgctactaactgatataggagtacatagtaccagtatctcttaaatttctctccctctgtactctatatttcctgcttgttgtattggaactactgattcgtgcgcatgtgcggtgaacatataactcgcacacgccacaagtacataaacaatttttccaagatgactaaaacagattttcgcgtgcggacctgtgcctaggggtctatgaaaataaaaataataataaaaaagaataacaaaaatttcaaaaatccctcgaaaccataggtccgccgccacccggtcgccaccgtcaatcaaaaccctagcccactgcctccacctaggccatcgtcgttgaggtcatcatcatcgctttcgaggacttcgtcgttgcgggggagggcggccgccaccagaaccgtgcaggggagggccgttgccgccggatccgcatggggggaaggtggatgccgccggatacgtgcggtggatggccacctctgccctccctcgccgcccaagccctccaccaccgttgggagggaggagaggggagatgagtgggggagaagaagaggaaggccgggacacccgccatcgcccgtcaccgctggagcccgctgtcgggagggaagacggggatagccgtcgccgccatcacgtgcctcctccatcctccctcactgccgagccatccatcaccttcaggagggaggagaggggagatgaggagtgggagagaagaggaggaaggccaggacgcccgtcgtcaccgtcatcctcgcatcgccgtcacccttgcttgacgtcgcagccgctatcggagcctaccgtcgggagggaggagaggggaaagcaggtgtgcataggaggagtggggagaggaggtggggagatgtggagtagggagaggaggagcgggtggtgggagagagagagagagagacgggagaggagtaggtggtgggagagagggaggtggggagaattaaaaaataatggtaagaggagggagtatttttgcatgcgggtgacttatgaggcccgcatatgaaaatacccttattttcacaatgcagtccttctcaagaggtccgtttgcgtaaattgatttttgcatacggtcctcttaagcagtcgtatgaaaaatgcgggtagatttttgtagatacggacacttatggctcatctaaaatctattggggtgctcatctggaaaaatcatttgtgtagtagtgcgcggcgcacacaattgtccccattgggcttcatgccatgagaattcgattcatacatcaaagataagtcgtccgaatttttatgtaagaatcacaaactttcaatttaacaatatgaaaatttcatcttaaatcacaaaaactttcaaatcaagtctgaaaactttcatcctaagttaagcaaacctttctcctcaagtctaaaactcttatatcaagtctaacactttcataacaaaaatagaaaataatttcaattaaatatctaaatctttcatcctaaaatcacacaaactttcaatgcaaagtcttaaacattcttctaaaatccacaaaactttcggtttagacatagagtatttcatctaaatactcaaatccatcttcgtcttcaacctcagtttccacaacatcctggttgccaccgccagcatggctacttcgccgtcttcccaacctcaaccaccgttgtcgttgctgccatattgccaccttcccaacctcagctgccaccacagttgcgacatccccaaggactagggttgagaagctagggtgtcccactacatggtggaatgagcttagggttggcaatggggcgggacggggctaggtttggacaagaacgaccctacccccgcttcgttccaggcctagttattaaaaccggactggaccgatggtcggaccggaaaaaaccggaaccagagccacgaccggtccggtccaggtaaaagaccgacatgcaatcgaaccagcaatgaaccggttagaccacccggttttggagaaaaactgccattaaactggggaataaaaccgcttccaaccgggcttggcggctgctgtacgcgcgcatgggtgctgttggggggaaaacgagcgaaaatgtgcatgggcctagttattaagaccggaccggaccggaaataaccggaaccagagcctcgaccggtccggtccaggtaaaagaccaacatgcaatcgaagcggcgatgaaccggttagaccgcccggttttggagaaaaaccgccattaaaccagggaataaaaccgcttcaaaccgggcttggcggctgctgttggggggaaaatgagcgaaaatgtgcatgggtgggattcgaacccaggaccacatgggaggaagtaaacaccccaaccaccaaactatcatgttacttgtgtatagatagaatgcttaatatatttaagagttattgaaccggattaagccaacggttcaaccatttgaacctgtgaaccattgaaccaagagcctcaccggttcaattaccggtccagtcttaataactatggttccaggtaaaccctgttgtagccccggattgaagaatggagcgaaatttgtccccggcccggcccctctggggccctcactcatcctgggtcccacacactcagtgctagcggtagttgccggtggcagccagagggagaggagaatgcatggggcacctacaatcggaggaagagggagtagaacgacgcaaggagtagtggccggccggcgagatgggggagacgacatggagcagcatggagccgcgcacctgagcgcctgtgactgagagcggtgatgtgaatgcagcgtggagcctcgatgggcactagcagggtgtggtgaagctgatgagcgacgcggcgtgtgtccctcgttgcagcctcgcatgatttttttttcatatgagcgtcacactaatgcactatggtgagccgctgctgttgggaacgatacgttcgttgtggatttgttgagatgggttagggtttactttgtgttttaattttatcttctctaatgggttgcacaagatatacttgctaggctttttatggctactacgtatgggttgtttccgatgggctttagactgctagtggacaacattatttctagggttaatttgatccatgccattgcaaagttgtcatattgcaaaaataccattactattcgtgaaatcttctacatgccactgaaattttgtaaaattcgaaccgttcgattgtcgtcaacatttttgtcaacatctccgtcttagcgcaaaaaaaaatatccaaattgtcctttcttttcacatcctcattctctctcctttgttcttctccaactccggcgtgaatagcacgaagtggccggcagctacggcaggttctgaatgctatgaggggagtagtttaattcgggagcgttttctttcttaattcgcagctaatcttgcaagtggtcgcctggccttgtagagtgcagttgataagatggacgaaagaaataaaggcatggcctatgagctcagtttgccggctgagctagtcaaagcgattctttgttgttttcttttgcaccactaccactaccaacctgctactaatagagaacatcatcgcacgttagatctgactaaatagaggccaaggacatctcgccgttcgtcatcgctccggccactcccaccgccacaccagcacctaccctagctcccgcactacttctaaaggccctgccaatatgataggcatgggtgctgatgggcaggagtggtctggctcctctgtgaggacgaccctaagcctctgtcgaggcctagctcctcccaacttttctgccgatgccattggtggccatcacgactccacgaactggtagcaacgggaaggatagcaccgccgtctccttgcttctctacctatgccatcggtggacaccactagcaggtggggaaagaagagacttggacggggtgctcatagaaatcttgatggcaatggaacatttcaaattttataaaattttagtggcacatagaagatttcatgaatcataatggtattttttcaatagggcaaattcgaagtggcatggatcaaattaacccttgtttctatacttccgggcccctatgtatgaccagcgggtgaagaagctgactcggccctagccacgcacgaagtcggggccccgcccctactcacccgtgggtgaaaattctcccccactcttggtcccataggggcaggtcctcgccggatccccggccccaacagggcaaatgccacccctagatgagctaagggcggatgaaatagaaaggatgagggaaaatgccacccctagatgagctaagggcggataaaatagaaaggatgagggagaatgagagggatggagaccatggctgggcaccgactccaggcactagcagcgcaacaggaacgatgaccgcaacaaggtgtgaaggcgacgaggagtcgaatgagaggaagttgggaaagagcgagaactcgagaagacaacaatggttcggtcatcggtctccagggttgggccggtgtggccagaagtgtgtgcccatggtgcatatgcgtgaataagcattctagtgttgtgtttaccctcaaatttgtaccccgataaactctagtgtgcaccttctctttcttataatgatagctagcaaggacttgctaatggctttaccacactagggttatagggatggaacgggagggtggtagggttggtagagacgatgggtttagagaggtattgctaaggcctaagtagcagcaaggaaaggaaatgatggtaccatatccaagtcatatgctaaagaaagacaataggacaataccaagtgacgagagtaacttatgacaggcagcaatggcatatctagtgccaaaaccattggagatggaaaaggagataaaggaaaattaatacgataaaatcggcaatgatacgtagaaagaggaggaggagggggagggaagcgatagtcaggaggacaggagagggtaatgatgacaaaccgatgagaagcattggcaacaagaatggcttgaaaattccctatttactgtgtaacttttcccctcgcacttgtgtcacccccatgtgggccctagccgcctctagtgcccccaactcatccacctctggcctcgccaccaccagagcaagccgttagtaagttgcgtcgtgagctatgaaggaagtaggggggaaaaccctagaggcgtgggctagaatgtggtgcaatgcttggggggtatagatgaagctagtgcgacgtggcagatagggtggcacagatagaggttgtgcactggtggaggttgtggcaatgaggatctagccaatgcaactggtttgggacaccgggagagcgaacttggtgatggtcagatccactgtgtggcagtgcatggccaaggtgccatgatatgacgagagggtggcgatgatgcgggctagaggtatcgtaactgatgatggcacacagggaggtggcgatgactacgtgtagttggaccctcccagcatggtggtgcgactcaccccttcttgtcttggtgagattggctggcaagccattgtagcacgggagccaagaggcgcaagccttgacctaggaggtgggcgggcgggcgatggcatgggacaacacaataagaggcaacaacatcatggggtgatgatgaagcgattagtttgcctaaggcggcaacaacgtgggaagtgagtttggcgtagggtggcttgcaaatgtcaagccctacctaatggtcagttggcagcgtggcgttggcacgatggttccacgctaaaggtgctttgacatgagagggtagaaggtttatggcaaaagtctagcctattcgaggctaacaatggcgacacttatggacgttgtaactttggtgagggcatcacacctctggatacatatgaggggggggatcaggaagcacttggagatgctagaagatggaggccaaattcatatcaagttagagtcaacccgaaatccaggaccagcccacactaaatcattgcccagagctcatccgaactctttttttgacattttacatatgtattgaaagctaacgggactaccttcctaaagggtctggtctcacggcaaaaacatcttctaagtcaatgggaaatgttgaacaagagagcctccaaaatctatccgggtgttgcgccattgtctttaaacccattgggccatgtattgtgttggagtccatttgggacgcatccaggggtcatcggtcgatcctagaacatatttattcagtagccatcgtcgaactagggttgggttttgcttcgattattctgccatttgtgacattcatcttatatccgcaatatattcagatcgtatcttctactctcttgcttgtgttcccgatttgcttataggagataaccttatcggcgaggttaaccgtgtttcaactcaggtgatagccaatggaggagtggtgcagtaattgtgaggggttcgatctatatggtcggagccttgggatcatcaatgttgaggctccacaatcgacttatccaataccaataggaagatcgcgacctacttcttcatcaaaccctactaggacattgttgtgtaatctctctttctatttctggtggatctcttcaagtgaaaaccacgtcttagtttcaagacgaacgatggtggctttcttggtgttgtaacattcctgaatgcgtcatttcaaaagatccattccctttcaaacctctcaatgctggtgtctcttttggtgtcggtgagccactacaagatgaccatgttgatgggctggttagggggggagtggtttcatcttctcatgcaccctcttcctctccagcctaaagacgtggacggagttgggtgtttcaggtatcgggtttgtttttgctccttagcaacgtgtagtatctaatagtagaacattgtttccaactagagacaacctaaacgcaggctggtcgttggttgctggagaaatcggtgtgcatgcgcgctggaataaaggcggttggccaattggcaattagccagacctatacgtgcacaaatgttaatcaattctagtaccactaccagctagtatatgacataccaccatgcactatatattttcagagattcagataacaggcgcacgcggggtgtatgtatgtatttataattggcccctcttgccattgcaaaatgtatgcatatatatataattacgataatcaattaatatccatatcatgaccgtaaacaatgaaacttgggtcttgataagctgatgatctttaattaacattatcgacacaattagatgattgttagcacatcctaacttctgtaggtattgtgatcgacgacctaacaactcttcttcacgccctgcacgtcttagacacagcagtgttaaggagaagttgagttaattaatttattagtcagtgttttagcataatttaaatgtttctagcataactaattgtctaatttgcgcgcgcacttgcatataagtgtgcgcctaccggcgctaaaaagccagagatcactccagccactaccttcttctgctagcttcttctcaattccttcaattcttactttagctatagctagctagctgggacaatggccgggaggaggctaccggcgttctgccgcggcggccggacggtggcggtggccgcggcgacgacgacgacgagggtgaggaagcgcgtgcagcgggtggcggccgcctaccacgctgcctccaagctgccgccgccaccggcggtggcgacgaaggcgagcttgggcggcggttgcgctgacgcgccatgcgcgggagggtggtgccactcgtacggcgacggcgccgccgccgccgccgtcgctggcgccggcggcggtggcggtggcggcaagaaggacggtggcgggaggcgggtgatggtggtggcggacgggcgcgcggaggcggccggcgcgctgcagtgggcgctgtcgcaggccgtcaggcgcaacgacgcagtcctcctgctcgccgtcgtcaggccggcggcgaacgcgtcgtcagacggcggcggcggcggcggcgagtcgtcctgcgtgaacatatcgaggacgaggtgctaccagcagctggacgccatgaggagcatgtgtgaatcagccagaccagaggtaattaattaacaaacacatcaacttcttagttaacttgtgtaatttaaatctccttgggttcattcgtgctatgcttaaatgatttgactgttcaattagaccccctttttaaaatgccagaatacattttctacagtaagttgtcctctaaaaatatgttacagcaaagtttgagaggttgagtatactcctatttgacaagaaacagtgatcccaacatgtaattagaagtcaaagatgcaattaaatcgtctctccagttcagccacgtgttgattggacggcttacgttgcggccataagtagttcagtcgattatctactaaccattagcattacaataaaagttttttaaaaaaaataaaaagaaaacaaagctttatagccttataggcagtgatccacttagcacatttcgcggaatggaggcgtcaaaagctattctagctaagcatgcagcctccggatccggatatttgcttcatcgtcctccatccctttcaaagcaaagaatattctaaacttaatttttttcagagtttcaattcaataaaataatattcagaatttcaaaaggacttatatatttttcataatttttgtacacttcaaattttactagaaatataagaaattctactagtatttgctaattaagtggcgttgtgcatgtgtgtaggtgaaggtgaaggtgtgcgtgatggaggcggccggccgggagcgcgcgccggcggtggtggaggcggcgaggcgccacggcgcgtcgctgctcgtgctgggccagcggcggcggcggcgggcggcggtcgcgcggtggctgcagctggcgctctggccggcggtggcggcggcggcggcgaagagcaagtactggcggcggaggggcgcgcggaggtcgacgacgacggtggagtactgcatcgagcacgcgccgtgcgtggcgctgggcgtgcggcggcggagctccggcggctacctcgtctccagcaagcgccacaaggacttctggctcctcgcttaattaattaatttaatttaattaattactagtgctttgtactagctaattgctgcgtagactggtcaatttgattcacatgatgctggataaggaagatgttatttacgggtggtttcatatcctctatagtaatgggaccctgatatgcgaggtactagaaggtggaactcacatatcagtaactgtaatggcagtaatattatggtagaggatcctcgccttcacggtggggttaaagcgcactaaaagtcggggagtatgctgtaatgtataagtgattggcataccaaatatcagacggttaaactacaaaccaaaaatatgacacgataaaaccctgctcgttgttgcgagagttaactatgataacaacaagaaaaaaaaatgtgtaagatagtttaaacaatataaacttacataaacataagtttacataagttgatgtgatttaaattcaaatagtatgtatacataagttgatgtgatttaaattcaaatagtatgtagagtgatgatttaaatgtaaaagaaaaataatgtgtctttgtgatagaacacaagaaggaagataatttagaccatatgagggaagaaaaaaaaagataatttgaaccatggattaatcatctaaggactaaaaatattgatgtgatatgacttaacaagagaaaaaaaaatagcatgaactaagtgagaatgaactactcactccgtttcacaatgtaagtcattatagcatttcttacattcatattgacgttaatgaatatatatatatatatatgtgtagattcattaacgtcaatatgaatgtggaaaatgttagaatgatttacgttgtgaaacggaggaagtatataggtatataggatataaaaaaataatggagatatattgatatattatgtgaatttaacatgtttatatttaaatctctaaaatttaataaattattaaattatagataatatatcatgcttgcatgatacttaaatgtaataattactagaaaaaatatccgtgcgttcaactggtgaaggatattttaatcttattattattgttatactgtttaattaaagtgaaatttaatgtgggatgaattcgtttggatatatatatatatatatatatatatatattagaaaatcatgagttgcagttatgatcgtctcaaggtagcatgcgagttttttttaaagtgatttcttatacaactctttttgtattttcaaaagtgaacaaacttcaaaaccgattcaaatatggatatgtatttccaaaaccgaacggacttaaaatcgactcatacacagatgattaccaaagtatcggtaaaaacatctttaatttttataatagtaaagattagtggatgatgatgtgtcatctttataaatgtgactttatagtaagagatgattagtcatgtacctgttacgtagagtagcgtagttgaacgttctaaacatgaagttttacatatttgcatgggaaaaaatgataatcattattttcaaaatttacctggcaaagtttttggataataatcaaaagatattttttaatttttagaacttgattttaggattgatgggaaaggctcgaggctttgcaacctacctggtcttaggcttaatttcagcggtgtaggcatctcctggacttcgcacattgccggatttgctactaacttctatcaacatatgtaaaatttgatcaatcgctgtaagacgctaatagttgtatggaccttagatatgagtgatattgtgatctaagttaaaccatatagaatttgacacatgagagggttcaagcatatctcaccataacaagcggccggacagtgacacagaccaggcaaatgaatagaatagttcaaaatgataaatattatggggattaattgatacgattctattacaaccataccatacgatgccttaaaaactttcaactctattttatttttttaaatcaactcaattttgaattcttctaactcggattttgaagctttcagctcaaattttgaaactttcaactcaaaatttaaaacttttaacttagatttgaaaactttcaactcaaaatctaaaactttcaacttaagctatgaatactttcaactaataattttaaatttttaacttgattttcttatatattactccctccgtttcaggttataagacgttttaactttggttaaagtcaaactgtttcaaatttgaccaagtttatagacaaatatagtaatatttataatactaaattagtttcatcaaatcaatagttgcatatattttcataataaatttgtcttgggttgaaaatgttactatttttctctacaaacttagtcaaagttaaagtagtttgactttgaccaaagtcaaaacatcttataaccaaaaacggagggaatactttattacgaaaaatgattcaaaaccataattaatgttaaacgctattaacgctaagcgcgtaactaggcccgcgtgggcacgtgatgtgcgcaccaggtcgcctcctgctgcagacgcgctgtgtcagagggtgaattcctcaagtgggggatagtaaggcccccttgttagttcggctgggggcagcgggtgagaatcgaggactcggtggaaggtgtgatgtagagggggtcgggcccctcaagaacgatgagacaagagcggtctatacaggttcggaccgctgagaagcgtaacactctactcccaggggcgaagccaggatttatagctagggggtgtgggcagggtgaacaagtcataagtcaaggtaagtaataccgacgataaaacaatacacaatgtattctgccataaaaaagcttgaatttagctttttagttgtatcattagatgtttgacagtttgagacttgagacaccatgctcaataacgagacgcaatgggaggacagagagacgtgtgaagccgaagcaatgatgacgaggagttgatttgcatcgtctctccgtctctttcttattaattgattttctataccatgtttattaataatggactaattaacatgctaatgcgctagttagtacaataagcatggggtcggataggggggtgttggcccccttcggcaccccttgtagctgtgcccctgcctactcacgtgcttggttgatcgagtatggaatacaacccttgaatctctgagacactagtgtgagttagccaaagaatctttctctttctctccctccctcacgaggcctggacctccttttatatctcaaggggctgccacatgggcccaaaagtctacctagggatgagggaggacattctctacattaaatgcatgtcttgtcgcttaacttggaagccataagcacgggcgccatggcatggggcccatcaaatcgcaccggctgacacgggggacgcctgcgtcatttaccatttaatagatgaagacttctgggtcctcatgcgcgccgggaaacggaaaccccgcgttgaccaggtcagacgaactgactccggctaggatgagagactaaaaaacctttgatcatcatgacattacggggcatgttaggtggcacgccgcctgacatgtgaccagtgcgcaggcgcactatctcggtactattggtcactcgactggtcatagaccagtcaggcgcatagcacgtcgcattaagtgcggcatggcgcgcccgctcaggtcgccttaaatgcggttaggtaggcgttgggaccgcccacctaactccgtacacgtggtgtcctgcagagggggtcggggcccgacccctaggcatggagggggcggccactgctctaccccgggcccgacccccctcgagggagttgttgatgcgaaaaacacacactggcctggaagatctgcttaacttcagtgcaggtccaaaatcttacttttaggttcgtgagcatgccggttgatttgatcctgcaatcaacaagaaacaaagacaagaaaaaccatggttaaatctataaacgatagctgatcggccagccgccgatgacatatcatttattttcaagccgatgtcatatgtgaatcgatcagtagttgtaaacaagcaagatatgactaaatctgctcgatcggctgtagatattaacgatatacaatccttctatcgatgtatatttaaaccaagtgattgggatagatcagtcatcatgccgagacagtataaatcacttagatcaaaatatacattaacatgaggactataaatgtttatagcatagccgatcagatagatctagcatgtatcggctaatactccgataccactttatattaagatattaaaacatatataatatatcaaacaggagcctaatatactttattgcgaataagatcttaatataaagggcagatctagcatatcaattaagcatataagatatagaatagctaaatcaggtaagatcggctgaaaccccgatactatctctctcgacaatcataaaacaagccagatatcataataataaatattacttaatagatcgaactcaaccgatgcagcattaagcataaaaataagtacaagatctaggcaagatgatgaaaacctataagagatggtggatacaccatataaattggattagtaacgtaacataaccctatcgatcacttcccaacaataaggaacagccgataacaagttataaagcgcaaccaatctagattacagcgtgtatatgataactcgatggattacatgaacatgattaaagtgtcataaagatggaagcattaaccccgagaatgcaagccgccataacaaactttacctctagttgaagatcgaatcgatgcagctcaacccgaaagcaagaactcgtcgaaataaaacgaaagtaaaaagggtggtgatgcgccgagattgtattgaactgttgttttgattacatggtttcgggctctatttatacccgagatacaacatatatccttgccggacacgacacttatctctaacaaactttaagataccataagtctttgcggcatatttttgcccaaacatatctctatggaatttacatgaaatatcctaattaatagatataattgcctatctgagagctttatctccatcgtggcaatccctgtgaagcactttgatcgattccagaaacagccttgaaaccatcttcatcggaatcggctgtatcacctctatcggctgtgttggctgtcctctatccaatccatctcagccgatgcaaactccagtcgatgccttcgcagccgatgcatactctattcttcgaatcgatctctttgtcgaatccgccttaatcccaatgtcgaacctgattcacaatttaccaaatttggtagtcaacaggagtgccacgtgagtaccgggtttagcctcttccctctagccttgatatcctcaggcccatatcaccgacacgctgattaggagcccctagaaagtctcacaaaaccgcactattgattattttaagtttgatctatcacaattttaaattctaccatcacatcttaaatttataatcttttatccatcatataaatattacatgcatgaaattaaagctttttaaaagtttgatatacgactatgtaaaattggttaacgttgtggttttctgaaactttcggaccataatacctgaggttatttttcacgtgtcaaaattactatggtttttgtgcaacttgaatggggttttatgaaattttacttttaaaaattaaaaataagatccatggatcaattagaaaccaggaaatgatcaaatgataagtggcaatcccagctgcagcagtcaatgggctaaacgcttttgggcctccaaatccaaacgggcctaataggcccattagccgacagcccatcaacaacagcaaaattagggaggcagcggctggagcaaacctccactaaaaccctagcctccccgctgctcctctcctccccccgtcccccggcaatggcgaagacgaagcccatggcggctgccgccgccgccgccgcggcggacaagaagaaggggaagggcaagaagaagaagcaggggaagaacggcccggctgcggtcgcgatgaaggcccgcggcgccgcggcggcggcggcggcggcggcggcgtcggggagcaacaaccccttcgaggccatctggtcccgccgcaagttcgacgtgctgggcaagaagcgcaagggggaggagcgccgcatcggccgcgcccgctctgaggccatccacaaggtaaacagtcaatcaatcgatcaatcaatcagctagtggaaggggcgggatttgggatgggtgaatcgatcggctgatgattttggtttttggcgatgtgcagagggagaacactctgctcaaggagttcgagcagagcgccaagtcgtccgtgttccaggaccggcggatcggggagagggacgagacgctgcccgagttcgacaaagttatcctccgccagcagcgtgagcacatggtacgcgtctgcgctgtggattcatggttggagattttctttttgagagagaatgcatgttttgcgtagaacagtcaacacctgtagcatttctctggtcaggacagatgaataaacttgatggattgtagttactagtaaaaatgaagtaaccttagagctttttcaatgaggaaaaattaatttgttctccgcttacaattgttcctagtgatattcgccttgtaatgtaaccacattgttcttatctctggttagtaactttaggatgatatcgttataagtgttttcttgtattactatagtttgttgagttcccttttgtaattctatctaggcaaagctgaaacgagaaagcaaatacaatctatctgatgatgaggaagatgaggttgatgttcacctgcctcactctctctcgggaaaagatgattttgatgaagaagtgcctcttgatgattatagtgatgaagaaggtttgttccatactctgtcttagtgtcttagcttggcatataatcatcttattttcttcttggattcctgtgaatcttccttttctgacattcatatggaaattttggtttcttgaagctagcgttctgttttctgcctcaaatgatgaatgtattaaatatttgttgtgttgttcctgaaaagaaacagtgtgcttgtttggtttggagccaattttgccctaccaaattttgtagtatagaatttgagcttgtgtgggcaaaaaatggtagcaaaccgaacattcatttcatactattgaagttgtcaaaatttcagtagggcaaaaataggcttcaacccaaactagcccagtaactattgatggcctgcaaaatcctgtctgttgatcatttgtgcaattgaggacgtaaccctttttaggctcagttttagttgatactggcaggtagcgatttttcccccttacgtgtagaatgtaggtatgtgtatttttaatggttcattatctataaaaagtgagtcctttttcttgcatatactacatattataataaataaatggcttacctgtaataggctcataaacatgcactaattttagttttcttttcatcattttatttgttaacttcaccattggagaaattaagatgacattattacatgaaattgttttcttgcatcatagtagtctccaaaatgaagtagagtccctatccacatgaatcaacatttatgattagattttgttcagcgtgcttaatcctctgtaattttcaggtcacatgatcctctcgaagaaccgcatacctctccaaagtggtgatgttccttcagaaattggtcttcctgaaggaactaatgtaagttttgataggatggtattaggatccaaatttaatcagtccgtctcctgtgacctcaatttaattacacttgttggcaggttcacaagagcaagaaggaagttatgtcagagatcattttaaagagcaaattttacaaggtacagcatcttctgtgattagatgccatatgtgttactttggtacccgtccttttgttcttgtgtgatcatttaggaccttattttgttttaatattaagtagatcgatcgaactgtcattctgctgtttttctggtatatgttgaactatgaaactttacaaaaaaaataatctgaattcagtccaggggctaatatgatttaatccatcatactattacagtttttttgcttagcccttgctttttgcgaaccattctcggagataggccagtgaaacctggctttaaccttctatccctgtattcgtcgcaagcaatgataaagtattcttgaatgtttccagtaatactctgttggtcttatagtattttgggaatatgcactatatcctgttactttttggacgtgctcattattagatctacattgctaaaatcaaacaagctgaaatacttgaggaaaccccattaaaacacaatcgtttttagcaagtgaggaggctcgcctatggaatttggttggggccaaggggctatctttgatatggaccctgcttatgtaggcgtgtgcgttatgatgttgtaagagccttgttgggcgctttggcttttgtttctttcagcatgtatctgtgtcatggatgcatcttttcctcctattaatgcaaagatacacagttctcatgcgtattcgagaaaaaaagatctaagttgctgtacatgactaacatacgctatacttgcagtatttttgtctcatgtttccggaatgttattagttgtgtgtgacatgaagaggatgaagctgtttcttaaaacacaaaatttcttccttgtgcaggcccaaaaggccaaggagagggaagaggatgaacatcttgtagacaagttggatagtgactttgcaatgttagcccagacacaggcgatgttgtccttgactcgatcagctagaatggatgcaaataaatataattcaagtacagtccagaaagattcatttggtttgactgccaaggagatttttaataaggtatgttcttagtgctacgcttcttgcttctacataagttgttaataatcacactgttattcattcaacacatgttctattagaagaatgggtttgcacccggtcacttggatgcaacagttggttaaaatggttttgcatgcatgtccatgagatggacaaatgattaaaatggtttatgttaatggttaatattgttagctgttaatatactttttaaatgtttcgttcaccttaaggacctggatatggtactatgacattatgaagtcatttttctttggataaattcattttgtacctatagattacaggcatttgtctttgctccgttt

SEQ ID NO: 46587 - DNA, 968 bp, Oryza sativa
ctgggtcgatgaaatttatgaaagagagggtaaaaagattggtgaagatgctgaagggtcagacaatgaagaatctgatgatgatggtgatgacgatgatgatgatgctgaggatggtgatgatgatgctgaggatgaagatgaagaagaggatttaagtgataatgactttggtaatatgtctgctagagactgggagcaaagtgacgatgatgaggttaccgtggaagaagatgaaatggaaggtctcaaacaaaaggaacagaagatcagtggcaaagtggtgaaaaaagatctacaaaattcaaagaaagagtctaatgcagaatcgcaagtcaaggatgacaatcttccttttgtgatagaagcaccaagtaacttgaaagatctatgctccttgctagatggttggtcagaaactgaaataattgagattattagtcgaattcgtacatgcaattcaataaggcttgcagctgaaaatagaaagaagatgcaagtatgtaacttttttttttactgagatcaatatcgtatttatagttctacaaatatttactgatttttttcttaaatatcttacaattcacacggcatttattaaatgtatcctcaagtattgtgatctcttttggcaggttttctatggtgttctcctgcagtactttgcagtattagctactcagagtccagtgagattcaaactaattgacacccttgttaagcctttaattgagatgagtggggagactccatattttgctgccatctgtgcgaggcagcgacttatccacacacgtactcgtctatgtgaagatataaaggtttcaggtctgtgagctgagaacttggacttggtaggaaattggttttattatcaataaactgtgtgatttactgtgattgcctttgaatatatcttataggaaagagctgctggccaagtttgaaaacattacttcttctgc

SEQ ID NO: 46588 - DNA, 28142 bp, Oryza sativa
ttctaaaatgacagttacagtgatttgcccaatttacttacagtggtcagatttactttcagattgactctatttagttcatattagaatagattcatttttttagatctaatcagtttctacatttctaacctcattaacttttctttacagatctgatcaaacaaattccaaaagaagaatcaaattctgaaaagaaccaagcaggtaatatttggagaatttttctgttcactcacctttgttcttcttggacttgtcttttgtgctctttctgctcttcgattcttttttttggagttctttggattgacctttagtaccagtttctttgatagatttgatattctttcctgacatttccttcttttctggatcttgatcttttcctaagcgtatctttctcttcttgatctcttctgaattcatcttgattttggattgatgttttgggggatctttctcttcctctagctccatctccctagtataatatggattgttgcggcgtgtgttgtgtgatctctttggaaagaggtggtcctagttgtgatctgtaatagttagctgtcatcacatgcccatcaacttggattgcaagctttctaaatatgtttgttttgtgggctctgtttgatcacgtgcctttgtctctgtttttctagggacctttttagactttattgtgggcttgtcaatttgtttttaagatagatgggcttttttggcctgtattggtctcaaaaaaataaatctagacttttataatatgttattgtagcagtttttgtgagttgttagatgtaaatcgtgtggtacagaaatctgactgaaataggacacaaaaaacatgcgtttgcagtatagaccgtccctttttttaatagacatgcatgtatttttcctcttcaaacaaagttttctctcaaattatttatccgatctacaatccaattacaccattgtgttcgttacaattaaatcttcgtaacaagatcttacattattatattatgatgaaaaaatatttatatttataaattacttttattatatatgtaagttacttttatcatgtgtataagttacttttagatttaactaaattacttcttagacatatacaagtaaattcaataaagtctaaaagtaatgcacatatatattataaaagtaacttaaaaacaaaacggaagtaactttgtcacgacattagaagtaaattcgttgtagggataaaaatatgacttcacgtccaatgaaaaaaggcattcattaaagttactttctttttattataagttacttccataatatatgtaaattacttttagtctttattaaatttacttttatatgtctaagaagtaatttggtgaaatctaaaagtaatttagatatatgataaaagtaatttataatttttcatcaaaatataatcatggaagatcttgttataaagaattagttgtgacgaacacaacggtgcaattggatcgtatcggatgagtagtttaagagaaaattacatttaaagtataagtggataatatctctcttaaatggagtggtagctggctaccactagcctagctgtctagtcacgtccgaaagaaaagtatgagctgccgaaattcccacgtgctttctaaaatgcacagcgacggcgtctagggggacacggcaaaatttcccatgttacggtcaggtcaaaattagctttcctttttttaggatcgtgtgtcgaattgttggttgatccaggctaatatctaaggccgagtgcatttctcttcagtggacgagttatctaagttggatatgtctctgagtttcacagctggtactgtacaagagtagagaaaagccccatacataaggtgatgatgcctctgagtttcacttcccaaagccctaattcttagcttcaagatgcccgagaactgcctctcctcacaccttaaaaaaaaaaaaggcccgagaacttcacctattatagaaagcgcctcgaaagaagaaaacactaaaattatgtagtaatattaatattagaaatcatgtgattatgtcttaggctaaggtacatatagagataatgaagttaggtcctacatatatccctctgtttttttaaatatttgacaccgttaactttttagcacatatttaacgctcatcttattaaaaacttttatgaaatatgtaaaactatatgtatacatataagtatatttaacaatgaatcaaataacttaattttttaaataagacaaacggtcaaacatatttaaaaaagtcaacggcatcaaatatttagaaatggaaagagtataacaaaactataacaaatctttaatgtacagtagtgtaagcatccacatcaatatgagtaggtaacccacgaatttagtgtgttaagggggaagctactgccatcaatatagtactaccttggtctaaaaagaaattgtatttttttactgttcgtatttatagccatagctgaagagagagagagagagtggtaatagtatatatatactcccttcgtcaaaaaagactcaattcctaagttttggtgtttaatgtttgaccgtccgtcttatatgaatttttttatgattagtattttcattattgttagatgataaaatatgaataatactttatgcataacttatctttttaaatttttttataattttttatataagtcaaacggttaaacgttagacacggaaacgcaggaatttagttctttttttactgagagagtactccgtataaagcaaaattccatgaaaccatcgaattaagttaaccggccgccatcaaaattaattgatgagggcccctttgttttcatgaggtcaggtgccgggcacgttgaagtctgactgccgaaattgagtttttgtcctcatcattaattagtactccatccgtttcacaatgtaaaccattctaacatttttaacattcatattaatgttaatgaatctagacatatatatctatatagattcgttaacatcaatatgaatatggaaaatattagaatgatttatattgtgaaacggaggaagtaatagatcctaactccacagatgataaattgatgttacgtgctgctaattgttgtctgaaagctacagttttaattaacaattcactttggttagtccaattctgatccacaactttcttgcacggtcctacacatcagtctagataattcataatctaggatcggattgaatggcatggcctgctgatttaattaaggggacaaccggccggcaatattacgatggtacgttgtcaaagaatagaaagggatcgtccctgcatgcactgcttcagaaaatgatgagctttgtcaagatccattcgtcgtaaacgttcttcaattcactgcctatgtatacgtgaggacttttactgtacgttttactgcgtgtatatacttgcagtatatagaagggtatgtttggtatttgttaaaaatttaaaatgggttgtttagtcatttgaaattgagatttattttcatcaagagtaattgtccataggaagtaattgtcctggatctcgtcatctgttcgtgctagcgcttcttttgaatgtatcgtgcatccccggcacccttgcctcccgtcccggcgcctccatcccgattcctttaggctaggaagccaaaagaagccgagcctttatgcgcctagcgtctcctgtgtccctggaccccggcgccttgcctctcccccgcatccaacctcccacagcttctgtgttccccaacccacgctgcctccccccgtctcacatatctagcctggcctcattgccctgcctgccctgacgccgctgagtgtctacacaagcttagacttctggtaagacacggacctatatttggtataactgtaatgattaattttcgcaatggttgttttgttctgcaatttaaggtgtgcttaactttcatgtcgatatgaaaatttgctgtcacattaagaaaaagaggtgggatttaatcttgttgattgactttgtatttagaagatctgcctacgaacactaggctgtctttgatgagagaagtaggatgaaaatctgtaactagaatcgcattaaacctaggtgtatagctagatgagtgagctatgtcaaattaatgtcacagagctgtaaattgtgctacttaaatttagtaaaaattaaggtattatccatatatgtcataaagctggttccattgaacgtttatatattgcaagttgtcataaatcatttgttttaacatttgccaatagttcgtcaagcctttattactttgtagtttgtaggatgtttttcacaaaataattttatcattattcttacatccatttttctatttgtgatgtgatctgtgtgtgacacaactcgtctttgtaactacttgatttatgtgaagacttgcaaattttaatatatttttgtaagtgatgtatgaaacgcaagatgttaattttattttaaaatatgctgatatggttcatctctctgtctatgattactatgtacgtattgacagtggcacacaatggctgagaacgaagttagcttggaggagatggaggagtataacatggttgctagtaagcattttagaagcgagtaagatggttacaagttttacaatgaatatgcaaggtgtaaaggttttagtattagaagagacaaagtgaagcaatttagtggtaccgagcttgtcttctagaggtgattttagcaagtatatttacaatagtttgttgtgaacatttgtgcgtgtaccgttttgtgcaatacactccattatcaggtagtcgatcataccttcatgctgctactatgaactcctatcaacacctgacccattcgaactctcttaaggttttagaattggtaaaaaaaagtaagacgtcctcttttctatcgtttcttctcttacatactccctccgtcccataaaaaatcaacttctggctataaatctagacacacgctacgtctagattcgtaaccagaagctggttttttatgggacggagggagtaagtagtattggtgcggaaaagctaattggcgaacgattgccctccggcctctgcgatcactttctttacgcattctcattccatattccttccgccactggttcggactgagcatgttttcggcgttggagagacgagccatgtcaggctacccatgcactttttttttcttttgttacttgacttttctattgcgtgcatgcaaggtggacccacaccatatatttttaagtttgcatgtagtttacaaatactacttaacctacatctttctatttttttccatttaggggcatatagaaagtttatatattctttttacatatttttttatttttaaaattcattcatacacttttttaaaaaatcaatatcaaaaagtttatatgtgcaaagttcatatataaaaatttaccatgtataaagttaccatgtgtataaactttccgtgcagaaagttgcaatgtataaagttagtatataaaatgtttatatagataaaattactatgtatgataaattagtagtatatgtattgggctatagtctaagcccacataaaacatgtacatagataagagaactctggatgagaaagaaaaaaaaaatacttgagctagtgggcctggaaaggtttttgcacgtgggctagagaacatggattcaggggttgttgcgtctgtcatgcgcacacgaaaacgccaaaaaatgaaatagcgagagaagccgacacgtgcagatgtaataggtcttgacatgtccgccgtactagacccacccatgttggtggggctcgggcccaatcccacctaggattatgttgtgttatgattgttactgattccaattataagtaagtcgactacaccatggacaaattatattctcccttctatttattttggtaccacacaaaaacaatgaatgccaacaaaagcatggcattttgatttgatttaaggtcactacattttagccaaattgattaggatcctctgactttggagaatgctccagatcagtataccgatctatccggcactgtaaccaactaattatcctactgtttttcctactcaatccatccatacatgtatatattgtttttcaaaatatattttctcctaaagtacttatccaatttacgatacaattgcaccatcatgctcgtgttaattaaatctttatgatagaatatcacatgattatattccgataaaagaaaaacatatgttttaaaccgttaaaagtgaatgtttcatacattacagctatatgtttccgtgtgtttttagcgtgttttaaagtttacgtaacaacgtctttcacactctctctctcttgtcttgtactatttgcacactctctctttccattttagatctttaaaatattttttcttctaaactacttatccaatatgtgatccaatcacaccattatatttgttgtagttaaatctttacaataagatatcacatgactatattctaatgaacgaaatacatatgttttataccgttaagacttattgtttcatacatgacagcagcatgtttcaatgtgtgttttcactataggcttggtttagttccaaactttttcttcgaacttccaacttttccatcacatcaaaactttcctacacacacaactttcaacttttccatcacatcgttccaatttcaactaaacttctaattttagcgtgaactaaacacacccgtactttaaaaaaagtcaatgtttcagttactaattttttttcaccatgtataacttaatgtttcacctaatggttaagtgaagtatttaaccacctgatttagagggaatcgaacgtccgatttggagttcactcctcagacttttagttgaatataaaggcataggtgaattaagtcgaacttaatttgggatattttccgatatccaattcacaaggaattaataaggccaaacatgctacagtactattgaacgatgattatttttgcatcatctacactgttgtcaccgtatttgcaccaaactcatttctgtgtacctttgaaaaaggtcagagaatctgattctcatctgtatcactacatattttcatattcacaacctttctcaaagctaaagcataatcgatttgatgctaatatgtcaatttatggatgcgattgtcgcctgtgcctactgcctagtgttcagtaaatttgcgctagaaacagaaaagaaagaaaaatagtgtccacgccagcattctaattgtattgtactcctgtttatttttatgttatatgtttagttaaaaaagaactaatcaacatcaaacatttcataattaacagagagagtatttcttttttcaaatatgttcactgtttagcaagcccacgcaaggagccagcaatgatagtaacatttgatatttcagagagacttctaaaccatgcacgcatctaacaagctatcgatatacatgcctctttgcgttaaggtcaattaaccctttacttgaatcatactacacaacatataattctgtctgcacagtgtacctgctagttcattgataaagtagcttatcttaagcaagtaagtatgttaattagtggcctgagagttctaaaacgtagtgtaactaacctccctaataacttgtctagagttaattaattagtggagactgtgggtggcagacaaataccaagggaggaatctgtgtggattatgggcatgctgacaaagacattcttctttggtcttaagtggggagcagcatatgtatgtatgtgtagctaagtgttcattaattgccatgattggaggatatagtccactaaatacagtaccaaatggggattaaattaggcaacccagcactccacaaggacagttttggtatagaagagtaattattataagtgggggcaagttgatcgatcaccaatatagtctcaagaaaatgaaaagtgtaacatggaagctgccccgtgcttccaacttctttgtttgtatcgggagacatggataatactatgaagattgttaagagttacattagttacatatcgattcttcttttaatagtggtgatctttcaaaaaaatatgattcttgttttaatgatagattaattgttgatgctagctttaccaaaagttgcaacatgacttcgtgcgtggtgaacaaaagatatagcaatgacagttgacaaataatgaatgggcatctcgaaagaacaaacccaatagaatcctcgcctacatagctgatattttccccgtggacaaaagaattgaggatgttataggctctgttctattcgttttttttccagatttttaccacagattatgttgctccacgcttataaaaatacgattttttttaaaaaaaaactagtaaccaaatattctaaattactactttgttccaggaaaaatcaaattctagggcattggacaaaacgtacatctagatacatctttaggatttgacagggtatttgtgatttttatatgttgcatctcttcacccgttttcctctatcctagtacaaaatatatatgcttggctcaattattatggtcgtacttatacatatcataggttgttttttatgaaattaaatatcactgttggacagcggcaaatcctcattttttccacgactgagtgagatcaagctagatatatatacattaaaccatgtatttcggttcctcacaaaccaaaatataagtatgtatttcagttgacaagtcagttggtccattttatacaatcgctgatgtggttaaccaagcatgacgggcgattagattgccattttggcatgtcattttctgaagcacgactgttatatccgtaggcccacttgccagtgactaggttggtcgaacatcctgatggttcaccctcaataaccagggctacgctaatcatagttggtggataggtcaaaagaacgatcgatctgaaaagcctgaaaggtgtggctactaatcagggaattaattgaacaatttcaatccaagaacttgtttaattagcaactaaaacaggggtatcacgaaagctgattaattgttgatgcttctcttctttacatacgggccccctgtttttaagaaagaagggactttgggaactttttccatgactcaatccccagcctcactatgcataaagttttttttggataccccacaaaaaaaggggttttttttgacaattcataaactagttggttattcacgtgaattaaaaaaatctaaagaaagctcgagagtacaaaatggtcgtcatattacatatgtataagtttaaggttattgtaatttcaattattgagccagattactataagttgaattataataagccaacacagaataaactataagctatttgtttctttagattattagatgtttgttagctgttagccacccaataatctaaaaaagcatagttagagtggattactatattatagtaatctagcttatagattgtaataagctactcctaataacccagattattataatcctaagctaaatcaaacatggccttaactgggtcaggatacttctttgttgaccttttttttctctactcctagcttgtagtattatattgtattcttgtgataaattttagaggtaagtgaactagtgctgacattatcttattaatgtgcctaaatttatgttgagtaaataactagcataaagatagtgcatcctccaatgttggtgccatgtgcacccaaatatatggctgtttcaatttaacccacacttccattatgcttagcagaaggttatcccataaatcattaatcatttatgtatccttaatcagttactattgtttgttattgcgtttttcatgactttttcagcaggtttagccgtgatgagcataaattgaccgtacaatgaaaaaccaaacccaacagaaaagagtcgattctcttggttttcggttggtccggttattccagcttggtttttgtgttgtggtagattttttttaaaaaaacagtaatatggcaataaagtaccgctgaggagtgaggactcatcccagtcaactgaccacgtcaccggttgccgtagcttcatttgaatcccggataaaacaggagagagagaaagatgaaggggtgaacgaaaaatgagggataatttgattcaagtttttttataaatgtattgaagaaggggtaagtggtgatatatttcactttttatttaaatataatagcatatgcatccaaataggctagtagaaataatttctttttaaaaatcgaggaagttgtaatggcatagatcccgttcgaatctgcttaaaaggatgattaaattttagattaaagtggcgcgtttttcaaactgctaaacggtgcgtttcgtgcgaaaattttctatatgaaagttgtccttaaatatcatattaatcctttttcaagtttgtaataattaaaacttaattaagcacacgttactaccatctcattttgcgtgaaacacttaatcttcatcttcagaagattcaaacaccacactaattaaccctaaaacgaaaagataatccagctatggcccatgaaacattaggcccaccagccgccggcccccaccaccaccaccactgccactctattcacttcacttccaccgcgcggcggcgaggcgagcctggctgcctgcgcgccgccgccaccgcccgacgccgcggcgtgtgttggcgagagcgagaaggccgccggcgagcagccacaggagttcctcctccccgcagaatgcggccgccggcaatggcgaatcgccgccgccacttgagtccgccggagaccccggggagccgtaaaactcgagacgaagaaaatttcaccgctttgttttttttccccttcttgtctcaccttactctattccaacccttcctttatcactaaagttctcaaccaaaaaaaaaaacttcctttattccttttttttcttctctcgcgctcgattcgcttttgtttgttgggtgcaacagcaacaaaataaaagaagaaaaaaaaaatcgatccgcaaatgcgtcggcgttgcgtgcgagctccgatctcctaaacctcctccaattccctcaacgaaatctctctctcgatccgactctgctctctatccggcctcgatcacccccaccaacatcctcctccgattccctcgccttctccttctcctcctccaacttctcgatgacttccactatactaagctagctagcccccgccgatccccgcggggttttagtttagctccgcgccacccaatcgccgcaggtgatctttcccggtcaagaactcgcggtaaatttttcccaaatctttgcttgtttttactcgagtcgagtcgcaatcgttagcagcagcactggtcggccatcgccgccgccgccgcctagtcgccttcgccgatgttttttttttctctttttaaattcggtttgcgactcgggctatctcgcagattcgggggcggatacggaggaaggaaatctgtggtggattcggatcgagctcttcgttttcttgctctttgtataaattgcgatcaggggcggcggaaacaagggttcttctctgtctctcttcattagcgccggcgacgaggtgaggtgaggtggtggtggaggcgatcgaaatggggtcggtgctgtgctgcttggccgacgacggccgccccgtctgctgcttccgcctcccatggccgatcttcaacgccgctcacaaccacaaccacaactcggtatgattctacctctgcttttttttttttttgcttcttgattgtttattttgttattacttttgcgaaattgcgcttctattttgtgttcagattgtaagcaacgatgaggcgctgattcacgattgagtttagtttttttttattagtttctggtgtcggtaatgtgtgctttgtgatcttgactcttgcacgcgttaggtgttgtgtcccggtgttattgaggtcacattgctgctgagatgagcttggcaaagtatgtaaaaaaaatgtgggtttgaatagagttcgcattgcattggtatgggaaaggaaagagtgattgcattgtggctttgaataaagaaagggttgattcgtgtgtttgcatgttaattttgttggatactttctctcagtttttgtgcattactattaactttaataatccagcaatcgataaattgtatggatatggagtactactagtatcaactcgctgctatttttagaaactggaattgcacaactgtcaactgggactgaataagtaagatgctgcatgttctcaaataaatattcctgcactagacttttcctgcaatttctacacatcattttgtcatctttgctcattattttagatcttctctctatgcctgatctttcaaccatgtgctatccatactcactctgttctaaatggtttctctacagggttccattgctcgtccaagagcggatacacgagttgcgcctgatcaaggaagaattagtctcactgctccatcacagcatgattcgatggatactttccgctgcccgccaaggcccttgccttgggatgatcctcgattcagccatcatacagagcatcacccactagtaggaggacatgacaaagcttcaacaacgttccacaaatctggtagccttggagaaagcaagaatgctgatagcatatctaattccaaagctgtcaaggatgatgggccttccacagctgtgaaggatgatggatcatcagtaaaacaccattcagatggtctgcacattggcaaagagcaagtacatgatcttttcgactttgaggacgactgtccaatatgcctagaaggttagtgaaaacagtaccactactcttttgttcatacatacactatcttatctttttctcagcagatagtgtttactatttaaatttctataatgcaaaatattaacagcaagagaaaggggggagcattcaaacattgttatgctgtagcagaagatacgtgttcatgttgtataattctagctaatgaacagtgttcatgttgtataattctagctaatgaacaatgctcaattgtggtggatcactacattgtgaccactctgctgccataatgtcagtgccatcataaaagaaagctaaatttccgtcaaaaaaaataaaagaaagctaaatcatgctcaggtctatttgcttgcatgattttggtgcttgtgtcgtaaagatctttttttttctcgcagagtatgattatgagaatccaaagatgacattacaatgcaaccacaatttccatctttgttgtatttatgagtggatggagagaagtcaagcttgcccagtctgctcaaaggtacttgcttctacttcacttttaacttcacctcagaagtgaagcgtttagcttgactccatcgacattaatgatacctttctcactacaggtaatgctgttccatgaggattcatgatcataatgctgcaacgtttctgtgatgttggagagtggagactcacggggactggatcacctagatttgtgtacatagcttgacgaaaatcaaagtcgctagattgtttgctgaaacttccagcggcgcaaagattttttattatttttttgtttctgtagagcatataattcttttctcatttttcagaaaaaattggtagcttgtgtcaatccacatatcacatttcgattggatgttacagatgcgcgtttgagtgattgcatttgcttctgatgctgaaatacgaaacttctgaaagccctagcatctgaacttgtgcttcctgtttgagatgacgagagattctttgcattcttcaggtcccatcgtaataagccaaacagcatatttgcaaacgaaaaatatttgtgaataaaacttttatatacgtattcttagcgatctaaaagcaaaggctgaaaaataaacttcaataaaaaaacgttaaaattagcttcaaatttaaggttgaaaatttaaattttgtctaacaagtataagcataaacgaaaagacgaggcccgttcttgccatgactgagttaagtccaatgaacatttctactattcctactttgtggacctatctaatattcctgcatttttcattacaaaactatatcacgcctgcttgctctctctcaaaagaaaaaggaggaataatcctgcttgctctctctcaaaagaaaaaggaggaataattgtattgttgcaaccacaacaaataggagtactaattttcgtcattgtaagctcgagtgttgttaatttagccaaaaaaaaaagggaatattttgagctttcatgcggaaaactggtcaggaactgttttaaaatgtctcaaataaagaataaattgcaaagaaaaatttcctgctatgttactaccacttttcacttcaaattttgtagattataccaaactggatttcaaaatgccttcaaacatttgtggtattcaaaaggttccaaaaaggcaaccaatgaaaaacttatccggatttggagctatagtctaaaatcctatataattatttctagaaagctcagcccaatagcaacatttttttattagccgcatgcctaaacctttggtccatgattggtgaaatcgtccatcaccacacatgtgatgcttccaagtccttaatatttcgttactttcttgttgtattgtactcgaacggatactcttggaactttataggactctgctgaactttgaattttactatttcatcaccggcaatctgtgagcaaaggcatagctgtcaattacgatggcagatttatgcaaatagagcatcgcaccatctattctttagttcttcagttgcacagaagaggggtgattttttatttttgagctaggaatgtaaatcggcacacaaatcattgcatcaccattcatataccgacaattttccgtaattaggtaagtgttcgcaagtccattagaattcggttcagatttcgtaaaattcaacctcttcagaccaggttaaatacaaaaaccactaggttcaaactgaattttaaattttcaaaatttaattagattctatcagcttatcaacagattccacgaaatctaatgcagaggattgtgaaccctgattagaactatttgaaaatgtacaacagcattcagtaagatagttaataatactttaataattttcagtaattaggttagtttgaaaatgtaagcatgtagtaatatagttaacaccaacattactactaataacacattgaagctcgcagtcagattgactagcagatttataaacacaatgaaatagataactcaggagactatcatttaggagatatacttaaaaactaatcataaccagctcacagagcattcgataactgaatcatttcttcatctcatcacaggcaaatagagaacagcaacattgcttctagaagatagttcactggtttcagaacacaagtaccaaaattttaaaagtgcaaacagatattatcaaagtctgcaagggttggattccacagtaacgtaacatcaaagcacataggcttaacgataacggcgaagagagacagtctggttgcgcttccaggtagccctgcgggacggcctggccttgtggtgagtgtgacccttgccgcgcagaccacggtacttcttgccagcagaggtgagaccacggagctcacggtgcttgtgcacaggcttgcagagccagttgatccttgggtcattgcggatagcactgtgagcaacatccacaaggatgatctcaaagtacttgtaggtggagtcctgcattaaaccaaagaaaaccaagtcattaatggaaggcagatacattgttgataatcatctttgaaagatctcagtaaagtgaaatgtacctcgttcacccagtaggagttgagcaccctgagtccgcccaacttgcgcccagctctctcctcagcaactgacctcttgttcctctggaacttgagctgggtgataccctggtgcttgggcttgccgtagacaatacccttgggcactggcctcttcctgccaccacgcctcacacggacacggtaaaccacataaccctgaggaaaggtaacgacaaatagttaagcacaatattttgattacaggacaaaatattcaaatgtgattatataaattggtaaataaatgggagcacccgtacaaaattttgctcagagtatcaatgacaaacaatgcaatttaagttcaactacggcagcaaactgcttttgcagtaagtaacgcaccaaacaacattacctatgccaattacaagaaaaggtctcaagggatgatactacaatggcaagcatctaccatccaatcgaatctaatggagaacacaagacaagtgatactgtccaagaaagcactaaaaacagattaactcaatgttctactaacagttaacaaatggcagtaacaggttccaacaaatcaacagcacagtcgttgaacctaaatcagcagaacgataacctagcagagtctagatctagacaaaaaagtaagcctccatttctacaggacagatcaatacttcaaacattaacaccatcatcaaccgcgggcacaagagaacatctggaggaggggaggtaacctgcttggccttgtagccgaggcggcgggccttgtcggggcgggtggggcgggtgaggcggacgatggccggctgctgcctgtactcccagcaccgcacgcgctgcacgaacctcatcacgtccgactgcttcctcctccatagctccgacacgtacttgtacgcacctgtgcacagcaaaacgacggaggacggatcaggagagagatggaggtggaggggtgggaaactggagacgagagtgatggagggaggcggcgtcggaggaggagctcacccatggcggcggcggcggcggcggcgagcggcgagaggcggcggcggggaggtggagcgggagaggagactagggttcgtgcggaggcgcgtggcgagaggctatatagaaggaggcgggggcgcggtggccgtcagatggggctagggtttttctcgtgcggttggatgttgcccggggaaggaatggatgggttactgatgatgggcttggcttgggccttattaagtgcagtggtgccgcacaagactcagcccaggagccagcctgctgctctttctcagcctgattaaaaaaatagagaatctattctatttattccactgagttggttcgagttcatgatttgccatcaacattatcactttctataatatactggtgaatttatcaattgttatacaatacgctattaggctgggacttgttttaaaaagtacccaaaatacccttatacacaaacaaggttaacaattgatttatcttattagaagtttcaaaaaaaaaaataaaaacttttatgtggcatccttacacaacatggatatttatatacaagtttcaattttttttatttttttagaaaaatatataacttatttgttatatgatacataaaatacttttttattgttgtttttaatataaatcatctttcatacactatataagataattttttgctattatttcttctataaaaaaattattttgcatacaccacataaaaatattttttctaaaaactaaatataccagaaaaaaattgaaacatgtatacaaaattgcatgttgtgtaaagaggacacataaaaattttcatattttttgaaacttctgatgagataaattaattgttaatcttgtatgtctcaaaggtattttgggtatttttgaaaataaggcccaacccaatgacatattgtagaacaattgataaagtcgctggtatattatagaaagagataatgtcgatggcaaatcgttgaactcgaacaaactcagtggtatagaatagattctctctaaaaaaataaatgatactagtagtttgttattattctttattatttattacggtcttggagatacaactttgaccccaaattatataagtgtataaaattacttcggaagttacatctaagaatatcatttttatgttttcaaactaattattttattaaaattcattgatacatattgatatgatcttatccaaagcatcatataatttccagtgaaaagactaaccacgaaattagtatgagtaatagaatgtgttggaacagcaataaaatgaaatagacaatcaatatattaataaattcagaacaccttgttgttcacataaaaattgcttgatcactccaacaattcatctcctaaatttaagccttttaatcgtatacatggtggatattgagctagcttagcttgggttgttattctaacgagataaaaggttgggtcgacttgatctgtttgctaactcaagctggcaacacattggcgttggctggacctcataaaaacggcaggctccatagcaccagagctagtcaacgaggacttttgtgatggtgccaaagctcgtcaatttttcattggagcatggagtcaaacgaggcgtcggagctcgtcaatatgactgctcagcaatcggtgaaggggatggcaactggaggaggagagttagaaacggatccaaggagctagcatttgggcgggcaacggtgaactaggggtcactagtgctagcactgccatggctaagcaaggacttaaccatttggcaacaggctaggattaatggtgttggcactgctacggacagccaagaagagcgaactggtgactagagaaggggatcatctggtgttggcgctgctatgaatgggtgggcgacaaatgaaagtgatgacgacaactagggtgcgaggcagagatgattgagtcatatatagaggtggatatcgagctagctcgattcagttcctataggaaccggtattgttcatccattcaagaaaaagggaggaaactttcctaccatgctaatttggtagaaaactgcgtgaaaaaaaatcgagtgcaacatctttttctgttcccattgcataggatcgaggcaaatgaagtcttgatgccactaatgcaaggattaagcatcatcaagcttttctactttttattatttagtactgttatttagagataagaagctaactctctaatcaactttgcatgtaccgttgcttcctatgtttttcctatggtttatctagtgcatttctaacctattcttatgtgttctttctattcatgtgtttttttactctacattccaaatgagctcttaatagttagccactaaatttgcatttctatgtttcggcaacatgtctttataaaaccacagctaaaacacagggggagaactcgggagaaaatcggtgttcaggacaaagtgctacgtttctcagaagagaaaaaaaaagggggcacagacgcacagtgcgttgctgctcctctggcgcttatagggcctttggggcttcttgggccatttggttggtcgttttggttgcccagcccaacatgatggtgttgtgcagcagcagtcaagttaggatagttttaagttgggcaagtcaaaaatggtccaactctttacatatcctcttgcagttacaactttctaccataaccaattcaacttatcaacaacaacaacaacaacacaaggtcagataccttggtcgaaattattacagaagagcaaagatgagaccttttacagaagcaagaaagatgagaccttttacttttacagcaagggcaaggtgcaactggagcagccgtaattttcacaggagccaaaaaaaaaaaagccggtgcgtgcatacacttaggacatgtattttcttcacagcgttctcaatttttcatggctatatacagctgttaaaaatgtagaatattatcatcatcagattacaatagattcaagtacctaccgtgtagcaaccatatatcagcaactcttattctttcctgcaaaccagcttttattctattttgcacatgctttaagtaacctataagtgtttcccacacgcacaatcattgagccccatcttttgcagcaacatcaaaagcccttgtgaatgcatttggaggctggccgccgctgagctgaaatttcccatttatctggaaagtaaagaaaaaaaaacacagtagtttgaattatcatggacaagtatccagtcactgaccaagtgataagataaaaagtgcaagagatgatagatatgatcatttaattagtcctcataccacaaagtgaggaacaccagaaattccagaggaatatttgttgagttcttccttgaccttttatccccaaaagaaatgttaggatatttgattcgattgcatctgtcacaaaaagatggtcactagaagtgaacatcggtggaaatgtacctcatcgactcctttgttagaatcttgaagaagttcttctgctccttctatgcccacctttcttgcagcatccagcagaacttgccttcaagcatttggaaattattcacaagattgaataatattgtataaaatcacttattgtcaacataaaaatatatatagggaagcaggatgggtagctaagttggcaggtggacatgtttgctgaagcaaatcaagaagataaagggtacttttcttgcccaaacatcaaaactcctacaaaaatttatcattgatagatagcatggaatcatttctgactgcaactttgcataaagaaaaggtgcctaaaaagggacatctaggaaaaaacttcagcagtatagtaaatgctgagaaactattcacaacccttacgcaccagaacaaagaaattggttggttattttcatttgccaatactgaagcagcacatgtaacaatggaaaatgcacaacgtgctatctgctttggtttaacattctaaataactcgcatccatagtagaatgtgataatctagataacgattccaatatgaaaaggtctgacatattccttttcggaatttcatcagtcattcttcattttagcaacataaaatgagtatgtttattacgagtttgtctcaaggagtaatatagcacagaaaagaaaaatgcacgcccttcaatgtaccactaccaacaggaaagatgtattatgcatcttgctgaaagcctcatacatagaaaaacgattaagtatggctgatttatgtgatttctcatgttgtcccatttctgacatgttctaaatcaataatagtttgtcacaaatatatatgaccgaatatgcagaattgacaaagaaaaataaagtgcaataagattataaatccattcctacaatcttgaatacatactcaccgatcaccaataaactttccatggcaaaagtaactttggaataattcttcaacaagagcactttgtttgtcataaccttggtgcccagcaagagttatgagcctatggctgtccattgtatttccactgtattaagtatttgtatcagcgaactagccaatgatgcatgctaaaaaaaaattcaagactatagcttacgtcaacccagacatgtcatattccatcccaagtcctctaaatatctgcaaaaagagcaaataaaaggctgaatatgatatatatgatgtgaacaaactctgcctttgcattgttcaaatgtattaacctctgtcatacgagcagttgcatgctcaaactgaatagggccaaacttcatccggtagtaatcagatttcttgatgccttccttaggtgcattcggatttaaaaagaatggatgccagcggacctaatcagcaaaaagacacgctagttttacgctgtatgaccatgaagttggacaacaataattttgaagaagtgaaacctcgaaatcaaacttgtccttgttttgctccatagctttctcgaggttctttttcccgacaaagcaccatgggcacaccgtatcagagctcacatcgatctgaatgagcttcttgccagcgtttgaagccatgtaaatcctgcatgtgtataattcacaaagaagctaatcagaaatcggatcaaggcgcctcatggatccggaaagcaaggactgaaaacaagtaaatattttgaatggttgctggtacaggccaagatcctaacacctgtcaagctagtgatccgaatttttcatcgaacacacaagctagtgatctgcagatggcctcaaaacacggtttatttgctatgcgatctgcaactagaaacagcaaagacatttgatcttcaactgtgtgggagaaaatcaccaaccagagtggctgtcagaaaattaaaagagttggggatgtggaagaccatctcaatgaagttctcatatacagttggcatatgtgggaggaacatgatatgaggacctttcaaaatgaggagcttgaggcccatgcggtgtcattcttattaacgagaacattgataagtggaagtgagcaatgtaacagtttggtgtaatttggtgacttaattattcgatgttatatcgtcctcccatagcctcgtaatggccctagcattttcttttggtttttggccatggctactagctgcttatccaagtgtttgtaacctaaattctattacatattaatctttaagagagaatcccttatatgccactagaatttgaccagttcccttatatgccactcaaaattggcttctcccttatatgtcactagtttaagtttttccacccttttatgccactcccaccactatagtgttagttgactgttagtcaaaggttagtttttttcgtaaatgaccaatatgccctctcaactaaaaaatgtgtaaacttcaaaaaatcataactaatttattttaaatcctttttgagtaaacaaaattttatcagaaccagtgaaaatgctctttatattaaaaatattattggaaaactgcatatttcatgcttacattgaaaatttatttgtgatggtaatggctaaaattgcatgtgatgcaaaaaaaaatcaattttcatatattgtatccagtagctatattagtactaaaatacatattattggttgtatactaattctcaaggacaaatgcgtctttttacaatgaagttaacggtcaactagcggtggactggcggcaatggcataaaagggatgagaaacttgaaccggtggcataaaaaggagaagccaatttgaagtggtatataagggagccggttaatttggagtggcatataagggattctctctaatctataacagggttccttcctttctttgaaaatagaaattggctgaaagtttcctctgcaaaaaaaaaaggctgtacaaactgtgattatgactccatggttttgttatcactaagctctacgccaaacaaacaaaaagcaaaattggttttagaaaacaaataaaaaggaaaaataaatttaaaataactgaaaattgacttaggtgcagaattggggattaacatggcttgtagaaaatgaaaatggtagttcatcttctcctatctttgctcacttgctctaatttttctcaccaatgtattaatctagccaaccggttggcaatatcaatgataaatcgatgatcatcagtctttggaagaaaatgtcttgtggcatggcatcagcataaatagcaagaaacagcgcctgttctctgctatgcctagtataaaggagaactatgaaacacagaaaggtagtaactatcaaagtatcaattgatcaatcaattaattaaagatcagtttcctattgaaatatagtaattggcaagttcccctgttggtttagtaaagaaaaaaaaacacacagtaaagatcagtttcttgcatccctagagagcaggaaacaactaacaactgtactggaagaaattagaaccgcctgttttcttgggatgaacagaagagcagacaagagtatatgcaagtatgcatcgatggtttcattcaaaggggagagggagaggataggattgagctggagggttgatccgaacctggtccagttgtggggaggggatgcggcttgcgcgaggagacgactccaagaagaggaggggagggagacctctgccacggaattttggttaactttgatttggggatttgatttgatttgattcatgtccacgtctcggtggcggtggccggggacggggaggtaggtgaagctgcccggtggtagaggaagaggggaggtgggcgttggtgagcttggtctatggagaccacacgcttgaatcacctcaccgatcggtgcgtcctggacgcggtccacaggacggcagtgtgggttggaataaatggcccaggcccaatttaactcaattaaaatctcaagagcccataagtaatgttagagacaacaatactgtcttgcaaatctaggtggaagaatctcaacttaaatagggtgatattagagattccttgttgaccggttgaggtgatggttgtactgccacacgcgcgcgcgcgccgattcggcctcggccgtgggcatggcgaggcgaggcggccgactgaagctgagcctgcttgctgctctttcgttatgtaacagacgagaataaagtcaccattaacaaatgagagattcattgtgatgtaaccttcacgacaaatgagatttattttgtggtaaccttcacaacaaatgagatttatttgtgtggtaatggagatctttctctatatataatgcaaggcaaaggctctcaaagaacatgtcttcctcctgctattgttccttggtgatactctccttctgttcctgcgatgtctctctatttccccagttctgttcatcccgcgcgcacgggtgatcgaaacgagcaggtgcctccgaaactccgtccgcttgagaacctgcacgggtaggcgggcgatcaagtttttgggtaacgcttcaagcgcaactgctccgcatcatcttcaccaatatgttgacaaccagcgacaacaacaacactggagacttggggagcctcccgtcaacaccaacggaggcaatactgcctcaaactccagtgaagggccattctcgaggtataatgtttcacaattactgtttgttcttcgtttcctacaactgtcagtcacaatattattgcgttctcttgtctatgttaatgcttattctatattaagcatgctcatgttgtacacatctagcactgtcactagatctactcaaattacaaatgtcatatttattgtcttaatattttggattaaaatatgctgcattatgaccaaatttcgattaaaatatgccgaattatgaccaaattttgattaaaatataccgaattatgaccaaatttccaacagtgtggatgtgcgccgctgcacatggcttgccgctgtgttcagttccccactcacaccaacggcacgccccgccccgccctcgacttccaggccgcctgtagccatctccagccctatcatttcgggtataagctatacggtatatttgcaaagaatagataacttgtaaataaaatttttataagcgaaaagatgagtccggattcttcgccgttcctgcaaagtccgcatcgacgccgctacccgctatctccgtggctttagcttttttctttttttttataagaaaatcatgttctctccatcggattttcgtttgctccgttttgggttctggcttcttcactgtacactccatacacaaagaagctgcgctgatatgtggacctgtgaactatgaagcttacatgtaaaccactcgaatcaaactcaaaatcaaaggacagtaaataagaggatttggttcctccatacagccatgttctttctccaatagaagttggataaagttttggatactcgtggcacgcttttcaaactgctaaacagtgtattttgtgcgaaaactttctatatgaaaattgttgtaaaatataatatcaatccattttttaagtttgtaataattaaaacttaattaatcacatgttattaccacttcgttttgtgtaaaacacttaatttttatcttcatcttcatcttgagattcaaacaccaccacaatattgacgacatatgtaacgagtttttttgggtggataaaaaggataaaaatgctaaactatatgggtatatgtgtagcttaattctcataggtagagtacgtagcaaggttgggcgccttcttttgaaataaaagaaataaaagtagcagtacacaatacgtgtatgatctacaccaagctaagatttggtgtaatggttgtcgtgaatagaataagaatgttgatcataacgctttattaacatcatagcttgtcttcagtcatttctttctgacttcgaaatttcctctatttatccatgtcaatgcatttgcacttagataaaaaaaaattctcttagtattgtaagaaagatccaatcttattgggcttcttcacagtgtccagctaagaaagtagttctaattacagtatacatgaccccaacgtaaaatagtttctccaaatgctactttggatagtgtacttacttttcttacaaaatgggagcctaaggctaatctaacctgcacgatggacctttacttttggacgacgatggtgccagagaatataactgttgtttgttttgcccttctacaataaaacatctgagcataggaacatttggaattgtcaccaactttggacagttgatcaatttcatttcttcaagcactggaattgtgaatacttctatcacctcatcttcttgccacttttccaagcttggcatatcacacaggataagactcttcaacctccagaagaatcgataatagctgacctcaatgttgtccatcgatacattgtcgcaaaaaagtgtgagactgtccattccttcaagatgtaggacctcaagtgatggaaaatactgcacaggaggaagcctcttacatcttgcgcaatctttgatggttagtttaaccagattagcaagagtttgacctggccaccaaattggaagtatgctaccagggtatcgccaaaccttgagtgtctgtacacacataggggttctaagagcctccatcacttcctcggcattgtatgcatttacctcgtcattcctaaacataccccaacacaacaacatattggacattcttgtttttagagataaatttgcggcctcggcttttgatttgtccctcacgttcttcagattatatatttcaagccgcccaccgagatccatgctcttgatctcttcaattccatacccatcaccattgcccactatgtaagttgtcagtgtttgaaggttctgcaattgtcccatatttgacggcatgttttctaatcggaagcagccatcgatataaatgtgccttaaattctccataaacctcatgttttctggaagttgctttaggtaaaaacaatcggagagcctcagagtttgcaggttatagatcatgaaaaagtcctctggaagcgacgttatccaacttcttgacagatcaaggtacctgagatgcttcatatcttggcaactaaatggaacactggcggacaagagaccatgcaggtctaacgctctcaaggagttggatttccaaaaatcaggattagacacacttattcgacatccttctccttgtgacaacagtgtgtggataccccatgcattgggtagaatcatatcaacatctaaccctgaaccaaccactgacaagtgatggagctctggcatcacttctgtaagttggtggccttgatgtaggattcggatctcttttccagcagctgacgttgctatgccatgaacaagagggtgcatcttatagattgttactccattgtaaggttgactgacatcttgaagaaatgatcttgactgtagcctatctaacatccaagcccccataccttcagtatcgtaccataccatatcattagccatccaccgctggatcagcatatcgccatccacttc

SEQ ID NO: 46589 - DNA, 9982 bp, Oryza sativa
  unsure (1)..(9982): unsure at all n locations
attgaccaacctggatgagctcgggtttgtcatctaggccacataacattcgctgcctcattatggaccatatctcatcatcactcattggtcccagctcaatgatgccagatgcaggtgcttctaaggttcttgcaacacaaagttcacgggtcgtcacaatgaccgtgctccctgatgctccagatgccagtgaggttctgagttcttcccagccattggtgttctcatcacaaacatcatctaagacgagcaaaaaccttctttcatgtaaaatgttctggaggtaggattgcaactccttctcttccttgtgatccatttgtgtctccaatggctcacaggttgcaacctcaataatccgttttgtgattctcattgcatcaaattggcgagatacattcacccatatgcacaatgagaaatattccttcacattgacttcatcaaagattaattgaaccaaggcagtttttcccactccttcaatgccaactacacataggaccttgaggccttcatgcttgtatctgtccagacagaatagtttttgctttatctcttgcttctcatgcacccttcccacaatattattttgcattaccaatggcacgtggttgatgaagccattgatctctgcacctagtgcattaagttggccggtgatcattttaagcttcctcttcatgcttcgaggaagaactaatggaatatacatgttgcgcatcatcctgttcctgtgcccgtcaaccaaagccttgttgtgctgagcctcccatctcaactcctccagtagatgctcaactttgaaggtgagtaacctcaactcagccattgaaaatcttagtgtcatatctttgttgttctgtcctgccaacgatgaccgttagccaaattagacatcattgagtacaaaaaaaaaactctagcttgacatattatcgtagacttgtcacttgtcacaagttaggcatattttaatatcaaaagcacatcggtccatgaataaatattaaaaaaatggcaacaaactcataaaaccatgatatgttctttaggtatatttgaagatagagagcacgtcagttcaaagataaattagaagaaaaaaaaggtttttatagagaggcaactgcattatcccccttattttcaactcaaatgatgattttacccctgcttttctaactttgtgattttgccctcatttttttgaactgaagcttgtgcttgcccccattccgtgtcatcttaacggtgtcaaaggaacgtatgctcttgcagatttgcacatacttttcttaatatttttgtgattttgcccttggtttgacatcaagcattttgacatgaatttttgcccggttttcacttgaattttcacatattcgatttgaaaagatgagggcaaacacaatcttcaaatgaattttgcccctgtttttatatgattttggacattgttaagaggagacaacaaaatggggataaagctcaagcattagttaaaaaaacagagacggcaaaatcacaaagttagaaaaagtagtggtggaatcaccattggagtttaaagtagcagtaagatcgcaattgctactttttaatggtataccaaatttgtcatattgtttctatttatccgagtgttaatgttgctttctcatgggtggtaaagttcatttatatctatcttaattattaaggaaaatggtatctattactacactatattaaggaaagaaacatgttttttttattattttagtatcaaaataactctctgaaaataagaaaaataatattataaaaagcaatattttctagtgtgtatatttacttggagtatcagaaaactttatgagtattataaaaataaaaaatctagcatttacatagatagcatggatattaacatagaaaggataactatgtcttgttactactttccctctttcgtggatgtatttgtggaagaaggcgataggtttttatttaggaaaaatcgtaaaaaaaatatggctgggattttgtgaaagctctagctcgagagagtagatgagtcacttaaaagaactaggaaaaaaaaggcagcaaatagagataacaaaataaaaacatgtaatgcattaatatgaaaacccttgtgtaagaagccatgggcacacaagtaaaagattggttacgaggcgataaataaaacaggggattaatgtacctttttatttatttaacattttcagatgtatcatttcatagcttcagcatttcatattcctaattgtcatgtgaaaatgacattaatagatctttcatgaacatcttattatatcatcaatttttatgaatgacaagtaaaagaacttcatatacactagttaaaaaacgattttcctggacgaggagctatttagattacagacggaccgttttcacgtccgcccgcaaaaatcagcctcccattttcacgtgcggacccttaagaggtctgcacgcgaaaatcgattttcgcgtgcgggcctcttaaaggcctacctacaagtctatccttactccttttttctctcctcaacactttaaaatttcatccttatccacccatcatgatccttatcctctctcactctctcacctctctctcactcccacactgtctcctctctctcactctctcactcagtcgcggctcgaggatggacgtggccaacggcatcatgcagctcagcgacaggcgcggtcagcggcaccgcacgactcggcagcgggcgcggtcgtcggcaccgtgcggcttggcggcgggctcggcagcgtgcgctcggcggctggcgaccaggagcggacgaccgccacccgctcggatccggcggaggcggctacccctttcccggatctggtggcagcggccgtcccccgcctggatccggcgggcgggcgggcttggacggtggggaggcggcggatccggctaccgcgacggcgacgatggagaccgcgacggcaatgatgatgacgaccgcgaggagggtagtggcgtcaactttagggttagggttttgtttttttggatttttttcggttttttatttttgcgtgcgggtgacatagccaccccgtagatttttgcgtccagatgcgccacctgtacgcaacaatagcgatttttacagatacttcgttacagacggttgaaagatccgcacgcgaaaatcgctttcaaccgcacataaaaatcgttattttactattattataccagtggcttctatggttagaaaagaaatagctgaagttgtttattgtaaatcatggtgatgtcctaaatgacaagtagaaaacaacacaaaaagtaaggctataactcgtttcttttctagattttgtttctgaaacttgccttttgttctcaaatactagatttcttatagggtttcaagcgctgtttttcccaaatgggccgctttcaaggaagtaagcactaaggacaagtcaggaggcttttaattgaattgattaataagcatcttatgttgcgctgaagtctaaacagcatcttaaaaataagatgtagagtatccttagatgcatattgtaatttgtaagaactattaatccagagtagccgaataagttggccgattaattatagcatattaataacgtgacactgtttcgcatgatgactaaggtggtgtgtttgcaaactactccctccgtccagaatgtaacaacctattcccattctaagacaatatatctgggtattgtcctaggttgctatgtacgttctgggacgaaggtagcagtagacttcagcaatctgctgctgcgcccttttttttttgcatttcattctttttcattttccagggggaaaaatgatatattattctctcaatgcatgcatatactacgggcatgtttgttacagctctaagttctaaatataacnncanaanntnantnnanannanannngnnnannnncntnannncagctccacaactctagtacattttgtgagagagctccacccaattccactcccagttttggtggagttgaaactgtttggctgagctccagctccaggaggggtggagctggagctggagctgtgccaatcagacccgtaccctctgtttttttaacatatgatgcccttgacttttttgacaaacatgtaaccattcatcttattcaaaatttttatacaaatataaagaatttaagttgtgcttaaagaacatttgatgataaatcaaatcataataaaataaataataattacctaaattattaaataagataaatagtcaaatgtatataaaaagtcaacagtgtcacatattaaaacagagagagagtacctgcttattggcttttcaacagtaccagaggcaacctggttcatgaagtttacatctgtaaactcaaaccctcgacaccccccaccctaaaaaaaatccaccaacaccaaatatatgcctacagtatcacagaataactatttgattgagccgcacagaaacacatgaatcagatgagaaagataagctcaaaagaaaagtttccaagaggttagagctcttgctaaatttcctctaaaatatttgtaggattgtccattctatgataatttcaaaggatataatgggacttaatcctgtttcaaagggttttatagaaaattttttctataagattaaaatcctccaatatccctacgtttttcctccaaattaaaggagccctaattgttgattgagccataggaaaaacacagaaattgaataagagaaatagggttaaagaaaaaaattttcaagaggttggagctataaaattatccatttcatataaatctatataatcctttgttttaaaactcctcgtagaaaattcttttatagcactaaaattctctgaaatttctattttttcccaacaaatcaaagaaccaggaggggtgcatacataccagttcttccagcggattcagccgcttgtcggagcatctgcagactttcgcacagggtggagtactcgcgggcgatcgtgaggacacccatgaaacctctaagaaatttgtcagatgccttctgtaccaggctgttgaggatggccgtcagctgtccgcccccgtcgttgtcgtcgtcgtcgccgccgctggcggccttcgtccgctgcttttccgggcgaaagccgcctctaaagcaactcgccatggatatttcccgtacgtgctcgacctcgttctcgtgcttactaggatgaatggcaggatgtgggaagaggcaaacagatagtagtagtacatgtgtactactcctatgtatagtactcctagctcttacgttggtgtttggatcagagacttaactttagtctttatatttagacactaatttagagtattaaatatacattacttataaaactaattatataaatgaaagcgagataatttttttaagcctaattaatccataattaaagaatgtttactgtaacctcacataggctaatcatgtattaattaggctcaatagattcatctcgcgaattagtccaagattatggatgacttttattaatagtctacgtttaatatttataattagtatccaaacattcgatgtgataggtactaaaagttttactcccattcaatgtgatagggacttaaagttttactcctatctaaacaggtctaattccttctcccaaatatcggagcagaaggcgaagaagatgcgaatgcatgtaccagtacgaatgaaggcaaatccaaaagtcaaattttgctacttagtgtttacacatactagtacgaacagaagtaaggcccgcggtttagttccctcgcaacaaattttataccctatcatatcgaacagttgaacacctatataaagtattaaatgtaggctaaaaaaataattaattgcacatattaggactaatttgcgagacgaatcttttaagcctaattgctccatgatttgataatatggtgctacagtaaatatttgctaatgacggattaattagatttaataaattcgtatcgcgatttactaacggactctgtaattagtttttttattagtgcccgaacaccctcgtgtgatattctatatagtaatacctgatgtgacaccggaaatttacatcctggatctaatttcgctaaatccaaaagtcaaatttcgctagctctaaaagtcaaatttacaccctggatctaatttttaaacacccctaaatccaaaagtcaaatttcgctagctgttggtaatcatcaccgacggagaccgaccggctatcgagaagagatatgattgcagcatttatttttctttcctttcattccttccaagatacttactccgtcccacgatataagagattttatctaatctagttgtttcacgatataagaaattttactatactacttgtcacatctatcaactctaattcaaatttttatccattttaaccatcaactacccactcaccaataagcaaatatcatttaataggggcattttagtatttttttttgttatccttaaactaccaaaaatgaataatcccttatattatgggatggagggagcattgctatcttcttcctccatttaaaataagacaacctattgaaggatatgacatctagaaagggataaatgattgtccagattcgttacatctctcttgtaggttgcttattttttttatgtagagagtacttcattcatcttagaatataagaatttaaaaccgaattatactaatattatagatctggagaaatagtttgttctaaacaaaagataaacccgcatgtcgttatactacccacggtttatttttctaagacggatagagtatacattactgctagtcaacttttgcatgcgcaatctccaaaatccttcaaactgcagcgatgtgatgtacacaagtgccaacttaaaagctactacctccgtagtgggctagtgtgtgctattggtcaacacacggatcacctggtcaagtagccagtgcaatatttgaagagcaaatttcttcggagagttcctttgacagctaatatatggtttaggtggtgtttagattcggggacttaactttagtccctttatttagatactaatttagattattaaatatagactacttacaaaactaattacataaatgaaaactaattcgcgagataaattttttaagcctaattaatctataatcagagaatatttactgtagcatcacataggctaatcatggattaattaggctcaatagattcgtctcatgaattagtccaagattataaatgggttttttactaatagtctatatttaatatttataattagtgtccaaacatttgatgtgatagggacttaaaagttttagtcacatctaaacagggtcttagttccctaaattttttttctcaaaaacgttatatgaaatctttagacacatacatagagtattaaatatatgccgggtttagttcccaactttttctttaaacttctaacttttccatcacatcaaaactttcttacgcacataaactttcaacttttttcttcaaactttcaattttagtcaaactttcaattttggcgtggaactaaacacacccatagattaaaaaaactaattgcacagttatggaggaaatcgcgagatgaatcttttgagcctaattagtccatgattagccataaatgctacagtaaccctcatgtgctaatgacagattaattagattcaatagattcgtctcgcgatttccaggcgagttatgaaattagttttttcattcgtgtctaaaaacctccttcgacatctggtcaaacatccgatgtggtatccaaaagttttcttttcacgaactaaacagcccctaaacaattgttcaaagaacacaagaaattttacaacatatgattgagatttgagaaaccgtacgtaggaattcttgttccatcatgagctttgattgtaggattgcctccaaaattcctactcccccattctaaaatataagcattttgaggacattgataagtcaaatatttttaactttgaccatttatggaaaaaaatcaatcatatttaattgacgccagacttgaaagcgcggattacagaagcatcggtgatttcggggatcgtatttttgcactcattaaagcgccgaatatagtccctcaatgactcgcccggattctgcgtcaacgcgtgtaggttgtcctcgatcgcgtggcgcttgtatgtttcttggaagttagtgacgaactgttgccacagttctgcccacgaagaaattgagtagggcagaaggtgaaccagccatgaacgtgcagatcccttcaacgcagccggcaagtagttcgccaatgcgttgttgtctactccggcagcatagagtactgtggaatagacatgaagaaattcttcagggtcggtgcttccgtcgtatttctctattgctcccggtcgaaacttctcaggccatcgaacatctcgcagagtacgagtgaaagccctgcacccgctgccaggggcagtaggttgtcggcgatcatacgctcgtcgcggatgtctgtccgatgaagatgacgaagatgatgatgatgatgatgagtcacttggttccggggcgcggtttcgaggacgacgctcgagtatgtgagccttgctgtcgcccatcgttgttgtcccggcgtcgatcttcgtcgtcgtcattgtcacggcgtcgacctcgactggtatcgcccggcacccgctgctcgcgattagtatgttcgcggcggttgtggcgatcatcacggtctcggttctcgctcggatgtcctccttgtttgccgttcttgcgatgtcacgaagagacgcgatgtcgggaatggttttcattatcttgagtgagtcgcgcttctcggcggccatttagatggttgcggagatcactggtgccgcaaggtggaggggtagcttgacgcagtggcgtccgctaatcaggctgttccccattagcgtcgccggtcgacgtttgttctggtggcgccctcacggcggcctctgcgaatgcgttactaaggttagccactgattcccgtagtcgttctgcccattgatcgagatcagcgttcaggacgggatcgaaggggctttcgctcaatatcgcattgagggttctgatatgttgggccagcgtcggcgtaaccgattgatcctccattcctgtgttgccgcctctagatgtgctggttccatcgatagcgtacacgtcgcgtggtgtacttgttgatgatgaggccaggtcttcgagtagatgtaggacagatggctcgtggggatcgatatcgattaccccgacgaatcgatctaaagtagtcgccgcaccttgttccttgtccgtatctctaggagagatttgtgattgctggaccttaggggatgacaccttcatggcgctgagaaggaccttgcagcttgagaggtcgtgagtctttgccttatagataggacaatagacatcacgagttggagaaatacgttgaattccacgctctttgcaggcacagatttcagcttgtacgctgaggaaaaccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46590 - DNA, 2066 bp, Oryza sativa
  unsure (1)..(2066): unsure at all n locations
attcctgcagcccaaatggatagagcagatagtgacagggggaagtgtagctgtaaaagtcaacgatgaaatcggaaatttttttcaaacaaaaaaagggttatgacaaggggatcccttatcaccaattttatttaatttggtggcagatatgttggcaattctaatcaataggtcgactgaagaggaatgacacgaggtgtaataccgaatttggtagataacgggttgtcaattttacaatatgcagatgataccattatctttatggaaaatgatgtagaagaagccaaaaatcttaaaatggtactaagtgcctatgagaagctttcaggcttaaaaatcaattttcataagagtgagatgttctgttacggaaaagccaaggaagtagaaaaagcattttcttttctatttggctgcaagatagggtcctacccttttagatatctaggccttccaatgcactataaaaggctggcaaacaaagactggaaggagttagaggatagattcgaaaaaaagatcagtagctggaaaggaaagtttctgtcaacaggagggaggttaatcctcatcaattcagtgctaagcagtctagcaatgtatatgctttcattctttgagatacctaaaggtatcttanagaaactggactattatagatccagatttttttggcaatgtgatgaacataaaaagaagtataggctggccaaatggagtgtactttacaaaccttaggagtgtggaggtttatggattcagaacctagagattcaaaataagtgcatgcttagtaaatggatctctaagttaatcaatgaagagggaatttggcaaaatttgcttagaaaaaaatatttggcaaaaaaaccattctacaggttcaaatgcagcaaggagattctcatttctgggctagtctcatgacagcaaaagaatcattccaattacttggacactttaaggtgagaaatgggaaacaagttagattctgggaggattgttggatgggaaacaaatctcttgagaaagaatttcctaacttgtacaacctggttcagaataagaatacagtacttgctaaggttttggaaacgataccgttgaatgtgtcctttagaagagcgatagttgggaaaaacttggcagattggtatgtcattgtctcgaaagtggtaatgttaacctgacaagtcatcttgaccaattcatatggaaaactaataaagaagggttgttcatcgtaaactctatgtataagttacttatgtttgatggagtaatacctaggaaatctttaatttggaagctaagaattctattaaagattaagattttcctatggtatttgaataaaggggtgattctaacaaaggataatctagctaagagaagatggaaggatagcttattgtgtagcttttgtaactctaaagagtcgatacaacaccttttctttgattgtataatggctagatacatatggagtgtggtttattttactttggggattagacaacccagaagttgcgctcatatgtttggtaattggttgaatggttttgaacctaaactcaaaagacaaacttgggagggcatagcggcaatttgttgggccttgtggcttagtaggaatgacatcgtctttaatggctataatcatatttctttcttacaggtaatattcaaggcaactcattgngcaaggcttttggtctttgcttcttaaaaaagttgaaggagaaaaagctcaagtcaagtgcaaaattttggagaagcgagttatggagttcttctctacctttggatggatttttcgaagaagaattgaagtttagcctccatttctctttaatcgtttgttaaacttttatttgtgtgtccctatgtaatgggaggagtcttatgtactcgtgactattgttttggctgtgtacaccctcgcaagtgtaaagaccggttttatataatccatatctaaaaaaataatacttagtttaacccaaagttaaatatttctaaattatatatatgcgatgaccatttcacttaatattatt

SEQ ID NO: 46591 - DNA, 10086 bp, Oryza sativa
acggttctctttattcaaatcatgcatccaacggttcattttatttaatgacgtgactcattctggtggaatcttgggatccccttttcactaatgtagataatatcaaactatttacggaaccagactatatcattatatggagtatatgatagtacaaagtaatgtttgtccgttcgtgaaaaatattactgacgaaattatttagcagtgtattatacggtgtagattttgatcaattgtcgactttacttgatatttttcacactcgacactcggtcagttagggggtatcaattgatgaaacttcgtcaaccttgcctcttctatcttcttatccaatgacacacaaatctcccgcgacttctttaaaaaaaatcacaatgacatatcctctcgcatttctactaacttgcagtgatattttaatttcatccagtggttcatgcatgcattagcacggcaccggataatccattggttcacttggtcaagcactggactgatggctatatgtgtgtacaaatcggtagttcaactgtagctttagcgaatccgagtatgcaataaaactaactataagttgacttcgagactttagcccctctctcaaaaatataagtccctcccctagggacttatacttttgtaagagggattaaactttagtccctagtttccaaacaccccttagacgatatatctcagcatctctatctccaacataaaatgtactagtagtagcaaggatggaatgggtaccctactacaacattaatttctgagataaacgccgctctcaccgaaatttttgacccgttatagtgtgcaacctgtccatttttcgttcgatcaggtctctttattttacttcccaatgcgctgtttgaaattaatacgccaaaattttcatgctcctgcaagaatttttgagatactttataataattgactgtagctttgatgagcaaaggcaggaatgtttcattccattatcttaaaaaaaagaaattttgagatttttttcctaaatagaccaacttatacctctatatagacacaagcacacagcgctgcctaaacactagtattcatgcatgcatccatgcatggttgtccattattactctcctggatagttggattgtcactgctcaacagtcaccattgcatgccatatctgatactgcaccagcgaaaagtttaaaccaatcagatagctaatagcttttagataactaagagcagtaaccacaagtttaatttgtcaaatgaagtggattgactaggacatttatgaagtattgcactcgagctcccgatcaatcgcgtgcagtagtgtctataaaatcggccccaaattaaaatttatatatgtaaccgaacacagaaaaacgttataggatattcaaacttgaagacaacaacgaaacatgatatttgttaaccggttcaaccaatatacatatccccataagctgactatagatgctccttttgtatcaggatttccatgaccatcgataggttaggtcactggtcggtcgtctctcgcctatgctatattattggcatgcggttaaaataacgcaaaaactatttcgagaggcctctcgatctggcgctatcgcgcgacgccaggaaaaccgtcccagccattccaccacgcatccacacgtcattgtcctcgtccattagcgtgcgagaaaaagaaagagagaaagaatgagagagacagacgtggcatgtttccttagacgtggcggaggtttcaaataaaattttctcttaaactactcatccgatctacgatccgattataccgttgtgttcgtaacaattaaatctttataacaagatctcacatgattatattttgatgaaaaaaaatataaattacttttataatatatctaaattacttttagatttcactgaattacttcttagacatataaaagtaaatttagtaactttaaaagtaatttacatatatattataaaagtaacttaatataaaaccgaagtaactttgtcacggcattagaagtaaattcgttgtagggataaaaatatgactctatatagaaattaaatttaatcagcatagattagcacatgtaagtttaacaatttttaaaagtaacttcaatgttaattggaagtaactttttcattgttcagaagtaactctctataaatcaatttaatcacctattgtttttttccttttatttttgtttttcatgtagaatgagaaaagaagataaaacctttgatggattataaataacattggtggaataactaatgagaattaattatgtataagatgtaatagttccttcatgataacatggaagttactttctaacatgtaataaattacttttaaattaataaaatgtttgaatatatgcaatatggatctcgttttgtcacatattttgagtggagtacaatgatgcaaatagatcttaaaaacaatatgtgatttaaaagatataagttattaaagagattaagaaaagatatatactattgcatttttcaagtaaaaggagacactgaatggagtgcctaccactaactgtgtagtcacgtcctatgaaaaaagatatgcattaaagttactttctttttgttataagttacttctataatatatgtaaattacttttaagctttattaaatttacttttatatgtctaagaagtaacttagtgaaatctaaaagtaatttagatatattataaaagtaatttataatttttcatcaaaatataatcatgtgagatctcgttagaaagatttaattattacgaacacaacggtgtaatcggatcgtagatcggatgagtagtttaagagaaaattttatttgaaatataggtggatagaatctctcataaatagagtggtatcaaactagctatcactagttgtgtagtcacgtccttaaaataagtgtattcctctatttaaaagagaacttacatcttcaagttgtaaactgtaattgacacaaatactggcattccaaatggaaccttgaagacttcgtaaccaacttgactgaattgtccaacatatatttggctagcctttcaaagtatcaaacgacgccaggcctcattgatttctcaaattataagaagaaactgatcaagaccaaatttgaaccatacagcaacgacgagaaacttaacaaagcggcatgcgcgcaggtgaggactttcttttagctaccagccagttcaatacgagtatcatctcatccaaaagttaaaaaaaaaattagtatatactccacccagtcaaatatatttgatgattgggatgaaataattttttttacacataaaaatacgcatctatggatgatgtaccatgcatcgtcccacatgtacaaattaaagaagaacatgtacatatacacacaagcatttaacttagctcatcaaatgaagagatgaatcatacgcaagcgaccggtttgtcgcaagccgaagacccgcatcatcgcgttgacgccgtgtgggaaaaagagagacttttgcgttgcgcgcggtggcgtggatgagtcgccactggcccatcggctacgacgtgtacgtactgctctgagctagctccagctagcgtcgccgtcgcagtcgtcgtcgcgcgcgcgacaccaacgacgaaaccccggcccaccgatcgatcgatcgtggtcgtcgtcatcctccgggccggccgccgcgccaccgctccaccggcggcggggcccgctgctcgcagctggctctctcgtgatcgacatgggcaatttgcgcgcgggtgacaccgtagtgcagctgcttgcgcgagcatacacgatcgagagagaccgcttagtcaacgggcgccgtgtcgtctcctgccgactttatctctctcgtcgccgtcgccgctcgccgcctagctggttggtccacgggctttccatcttgctacgctaagctttctactactttatacagcgacgacctaattaacagatcggtccatactctgatgtcgtcatgcatgagatgtatggagcatgtatatgttcggattcagtatttctgtattcttgcccgttcgcccaaattaaaggctactccggattaaccgtccactgttggtcacccaacactctcaagaagtgttcacgtttcatcactcacagtccaaaatgatcactctatcgactgtcttcagttgtgtatcgatatcaactccaaactacaatttactcgttttgtattaacacgttttctaaactgctaattgctaaacagtgtgttttgttaaaacttttctatattgaagttattttttatataaaaaaatcaaataaatccatccttcaaatttataatcgttaatactttattaatcattcactaataaaccatccagcattgcgtgttgttaatatggagatatttaactatttgccactcttacaagtggcaattaaggatttatcattggacccacatgtcatagatacaggagagtctatacgtcataaactgtgagtggcaaattcttaattgtcacatcttaaaagtggcaaaaagttaaatgccccgttaatatacgctactccctttgtcccaaaataagttcattaattatgtaatcaaaatttggctcggtaatttatatatgtttaataaaagaaacaagttacaagctgtatatatagctcgaagtgtattattcgttggtcttattgccaacagatgagaccaactggcaactttgtgctagacaagtagacagggatgacgactaaaatgtgactatctatttgccttgtcggcagcatcctcgagtttggttgacgttctggtgcaaaggaaaaaaatgaaccaatacacatctcaggttgaccagtagagagttgctggagctgacagttctggcatatggccggttacttgccttcacatgtcatttttctattggtggaaaggttgaagataccaacgcattttttaactttgaagaaaaaagtgataaatatagtttgaagaaattccccaccaaaaattttaaatggcataagcccataacctagctaacaaaggttaaggacttgaggtatccacatgtggaaccactttatctttttcactaaaaaaagcatttttgcaggcggccaaaagtagttttctcaagcggggggaaggaccgtctgtaggggtacaactgtgaaaatcctctagaaaatccccgcgcgtcgtcgtcgccaccccgcgctgtggcccgccccgcgcctcgcctcgccgccgccgctgccgccctcccctggcctccctccggccggatctaggatgggagccgccgccgccgccccctgtgtcgtcgtcgctgccccgcgccgtgtggccagccccgcacctcgcctcgccaccgccgttgctccccctccggtggggagggagggagggaggggagggggacgacgggtccggtggggagagatgtgttgagggagagagagagagagttgagagggaaatgagtggtggggagggggttggaggagaagataaggagctctagattttttttttggtagatacgatttttgcatgcggaccacataagtttcacctgcgaaaatagatttttgcaggcgccgcttaagtggtctgtctgcaaaaatcattttcgcatgcgccgcttaagtggtccgcctgcgaaaatatattttcgcaggcggacaacgaacttcaccccgatttatatttatgtaggcggtcatttggcttcaagggtcatgtccgcctgcgaaaaaaagacccccacattaggaaaaatgatttttctagtagtgtttattaattaggttgattttacaatccttacttcttatacttaatttattaatagacatctctacattaagcaggtaattagagtatacaaagttttcactaactggttgaatgcacgtacgtaattatggaattaaaaaagagagaaaatcacattatgtgatagagagggcgcctgagagaaaaaaaatcgttgatatgatgtataatcaattctcatatccggtaaatgaattatattgtgtctattgcgcatatcattacaatggattatcgttttgattatacataaattaaatattttaagaaataagcttattaaatagtttaaattaagagtaatgctccggtgcaatctacttgcagtattctactccaagtagaattaatcttgaccgtttattttgaagggcaggtaagtaatctcctaatatcgtttaggggtaattttggcatgggatgttttctttggttcgcatcgcattaggtccggactccatcacacgcagtcacctcgctattcctcccccggcctcgccgccttgtccgcccccaccgtcgccgtccgtatctcccaccgtcgccgccttgtccgcctcctcagtcgcattgtccatatgggagcggacgagtgtggcggcgtccgagcgaggatcttgagcaggagttctggcggtagtaaaaattccgacgtgggcttcggcggcggcggcgtcacgcacgcacgcaacgtcatttgcgtggcggcatcgtctcggctcattcgtcttcttgccgttccgatcactgcgttgtttcatggattatatggatcaattaagatcttgcacgaccaactccgacgaggatgacatggtgttcgatctatggattgtaaaatgataatacccctacgcgaattatttttcctagacgaaaacacccctccacatttctacttccactaattctggtgggagtagaactagatcttaaccctataattaaatatgattgagggtccagattactttctactccgagtagaaagcaccggagtgggactgttaaattaaatagtttaaaataaatgatctgagcaaatcagtataagaaaattccttcagaaatcatattttccaaactgtagagtaaataattcatttcaataatttgataaatagtctgcccatatgtcttatataggttaactaacttttgaaaattatgtgattcgcacaacattttctccctagtaaacgttgcacctatcaaatttgtgggagatggggatggggtggtggcaggccaccctgccaccatcttttggaaaggtaaaaataaaatagagatatgacaccatatttaaaaaaactaatatatttacactaaaaattatctacatttacactggttgcacaaaaacgtgactttatataaaagtctatcaaactttctacaaatacttctaaaccatcacgtggtatcctacatatgctcctaagccatcacatgacattttaataaatttaaaaaatcataaaaattatgataaaaagcaaaaacatctcatccttaattttcacttaaattgatgacatgttattttagggccaaactggatttatctcatcgaaagagaacaatcggggcctccaccgttacatacttacattagattgatctaattaattagagccttaagcggtcaagcccatctcacctcccccgtgcatgcgatgcacggtggaaaaaaaattctatggcacctccaacaattgcaggagatcgctgtcatggtggaaaaaaaaagtttctttgacgagctacattttatattgtatacaacacaacttcgactttatgaagatggatatgtcttgatttatactgtgctgtgctaaattattcgttgcctaaaacaaaccaacaattgatatatacttgagcatactcatagaacaggccatagatatatatatagtaccatacataaacaacaaacaacttggagcgaatttgttttccggcgagttcaagcaaactgattttacgtgtgcaccaccgggacatagggccgtgcgatgcatataaacggaggtttaattagaaggaaaaatatatagtatgaaccacatatattgcaaacctaaaaactatcacatggtataaaaataaaactttgagatttactcacgtcatcacgagtaaaacttttacttccagtgtacctatgccatcttatagcaatggacataataaactaccatgattatttaaatgcctaattctaccaaacaaagaagataaaatagggtagatgttgcaggcttctcattgaagattatgcacaacctgcatgagcacaccgtgcaaaccagctggcacacacatagatatatatcactaaaaattaattacatattgagagaaaaaaaaaacaaaattctaagacatttatactccgaagactattagaatttaaggtaatactctacacgtaagtgtaatactaaacgcctaatgcacgttagctaaaagaatgttacaaagagtgattgtttggagtatataaattcctaatgtttaatgaaaaactttaaagtaaaaatatttaaatcatgatggcaatcatgaaaagcccacactgcaataataattatgattgcagagttatttttatctataaaattatattcgtaggctatgtgaagtctcacgcactctgcacgaaacttccacaatccaaaatcgatttggactcaactagacttttttatttggaatatatatagtgtcactactcacatgcaccaaggcatccattaatcaacattaagaaaatgcagcatataggaaaaaaatcagcaggtgcatctcagctgcacgatacaataataagttataaaagatctagccaattatgctacataacagaaagaactatcaatttctatcaattgttggcaaacaataatatgggcacaagtaccattactttcacgtagggatttctaaattattaattgtataaataattattttcatcatactactacacaaatggtttttgcgagtattcttttcacatgtggctcaaatgtgcagcctcgtatgtggcgagcctcttgcctcaaactcaagggacatatttgaaaataacttttgccatccttttacagataactattttagtggagtgcttaacccgcaatgtagcattgaagcttttacacataaaactattttattggagcacttaacccgtaagatagtattgaatcaatctactcttttcgttatagaaaaacatagctcattttatatcataataatattttattctttcaaaatttttgtatttctcttcataaaagtcatattaaacaatccaagagacaaaggtcaataacaaatcaatgaattcagtaaattgttatccttcaaagtagctccatgggttttaccacaacctgcatgtatgagcctctaaggtggcaattcaaaatcagtagtctttcttataataatatgattaaaagctatattttttcctaataaattgttattttaagattcatattgactaggtcttttctttaaaatatattagagtctcacatattacagagaagtgttatataagatatgtatatttgatcaattaaaaagattgctaagtaagtgttaacaaccaaatttggtagcatgtgtatcaggaaaggggatttgatcaaagaagagttggaggcggagatcgagttctggaacagagcaggaatcggctggagtcctgattggctatggctaggatcggctgagattgagttgaactagataagctgatatagccgatttcgacaatacgacccgtgtgcaacattgggttcgagttgatgtgcttcaagatgattgccacgcatagatagagtcctgagaaggcaattgtatctattaattaggatattttatgtaacttccttagagatatgtttgggcaaaagtctaccgcaaagacttgtgatattttagagtttgttagagataagagtcgtgtccaatatggacatatcttgtatttctcgggaataaatggaccccgagccctatgtaaaaaagattcaatacacacattcaatacaattccggcgcatcgccaccttttgctttagttttatttcgacgagttcttgctttcgggttgagctgcatcggttccgatcttcaacaagaggtaaaacttgtcgt

SEQ ID NO: 46592 - DNA, 7262 bp, Oryza sativa
ctgccacccagttgtcgattagaatagcatcggagtttcagccgatcgtatctgatttaactataattatctctatttgcttcactgatatgttaaatctaccctttatgccaagatattgttgtatttgaatatattaggtttttgcttgatattctatatttgttttaatatcctgatatagagtagtatcggagtattagccgatacatgctagatctatatgatcggctatgctgtaaacttatatagtcctgttattaatatatatttcggtctaagtgatttatactgtctcggcatggcgaccgatctatcccaatcacttgatttaagtatatatcgatataaggagtatataccgttaacatctacagccgatcaagtaggtttagttttcttccttatttattcacgattgccgatcgatgcacagatgacatcggctaagatataaatgatatgtcatcggcctctggccgatcggctatcatttatagatttaactatggctcctttgtctttatttcttgttgattataggatcaaatcaactggcacgctcatacatccgaaggcgagttttggacctgcactggagttaagcagatatctcaggcctcatgttttctgtcaacacgcttttggcacgcccggtgggacctgattagaagttaggcgttagttcttcctcatggccgagaaacgagcaccactaccatcaagcccaggctccgttaaaggcaaattaccgaagccgggattgactgacatcattgatgacaatgtcctgccgatcgatcccgagaaattcacgcctgaccagaagcaaaaatttgaagcaatgatgcagcaagcacgggatcagtatctaagctcgttcatgcaaacccgcaagggaatgctggttcagaagtacaagttaaaactggttgctgacaaccctggaaccggttcttctaaagatggagaagtgaaacaagctccagatggctcggctcagccgagcaacaagggtgctaccagtggttctataggaaatcaaggcgataaccctcaagaagtgcacggagctccaggtgatgctgctcaagggccgcaaggaggaaatcttaatcagaatattgagctagcacaagattttttcaacaacttttaagatcgggttgattacgcggtgcatcatgctttgatcaatcaatccggggtcttagtcaatacactgtcgaacatgatgaaaacgatagccgatggctcgatagctgagcatcaggctacaggcccggcatacttgcaagaaggcatttttccgaattatcgaactttgatcactgatgctcagccagttgtgcaggcgactccatctgtcgaacccacgactcaaccaacagcgccagcatcaacgcccttacctgctacatcggccacggcgtcagcttagccgatcaaccctcgattgctaatgagggaacatccacagcttgctggaaaagcctcgaatcagccgactcaagatcaggttgctgctatgttttttccaccaccaccagttgttgattcagtgcagcagcagccgatccagcagacgtcatcaattcagccggttgtacagccgatccaacaacaggtcgcgcagccagctcagcaaacaccaccaattcagccggtggtacggccgatccaacaacaggtcttgcagccagttcagcaagcaccatcaacgcagcagcatctccaaccaatccagcaaacaccgccaaggcaacgccttcagccgatccaacggactccggtacgacagcaggtcgttcagccgattcagcacctggggccagccaatgcatcggctggatttgcagcacatggggggcaacctgcgcagcagtttgtgaatcaagttatcccggagcatttggttcatcatgcacaaccggatggcaccttagtaactcatatggttcctgagcacttggtgcacaacattcagccgaatctgcataactaccaagggggtaacttgaactatcagtatcagctttcatctccgcaagcccaatatcaaccagggggatcggcacagcaacagttcgctcctcagtttggtcagtacgagcccatgcaacagcaaccacaaggagcagctctgtcacaccccgaagttctttcccaagcctaaattgaagttataaatggtctcaagaaaataccagtgtaaagcaagagtaaaccttaataaattaatgcaagtaataatcggaattggcatgtggaatttttcttgagttctacatgtcgaaattcgctaacaagatttttagtggaattttcagagctctcgaaataattttaatcaattaaaattgagcacaggcaatatttaaatccctgggaattcctttcttcctttttcttttttctttttccttagtgggccgccggcccattccccctcctctctccccgcgccttgctgggccggccggaggccacggcccaactcagcccgcgccccctcctctctctcggggtcaccgacaggtggggcccacctgtcgggtcctcccccaacctccagccgctcgccgccgcacccgcaaccgccgtcgcgcctcgcgcccgcgcctcccgggccacgtcgtccacgtcgccttcgcgcccgcgcctcccgcgcccacttccccctctctcccgctcgcccgcgctcccgagacggccgggattcgattttcgaatcccgcctctctctcctctcccactcccccacgtcggccggcgattcccgcctctcccagccacgtccggccccctctctccctatttaagctccgccgccaccccctctctctttttttccccatttcgcctaactctctcgtgctccccatcgctcccgcgccgtgcacccatccgccgccgccgctcccgctactccggtcgtctctagccgccgctaggctcgccgccgcaccgtgccgtcgccgccgttgggttcgcgtggtcgaggtccacccagtccgcccctcctccatcgaggtccgtcgccggagcccgcatcccctcgcactccggtgagcaccacctccatcgccgccttcggccatggtttccgatcgccgtggttcatctccctccctctaatttctctcttttcctctcttagggcatctcggagctcgtccgtccgtcgccgccatcctcccatggctcacagtcgccgttcgccgtcgtcctcctccgcgccggccactctcggtgaggcatctctcctcctctattcccctccctctccctcctagccgcgccgggtcgagccgccgccccggtcgtgcgccgccacctttgcgccgccatctcccgtcgccggttgccgtcgccggcaacgcgcgcgcgccgccgcccttgccatggccggccggccggctttgtgccaagccgagccgagccgagccaggccgccaccgcaccgtccgatcggccccgggccgatccgggccgtcgatcccgtggaccggcggtggaccacccgcgtggtcccagtccacgttagaccgaccacccgtgcgccgctgccatatggggcccgcttgtcggcgccgccccctctctctctccgtgatttatttattgcgcaataaatcaattaaggatttttccgtttatagtaaaaaaacagtgtatcttctaaaattcataactaattcatccgtgctccgtttaagcccatccaagtctcagtaaatcaagaaaaatttgtccattaaaaatggttttgttctctgtttcagtagtcttatagcatgtttgtattgtttgcttcgtatgtcgcttagattttggttcttccgacgctccggtttacttcgagatagtcgccgaggttcctccagcagcagagcaaggcaagtcatgcctgtcacttgaatatgttgatcctatattgcaaatgctctattgtttttcttcaaatactgcattgttttataatgttactatgggatgttaacctatcgttacagccatgctatttcgtaccatgttcctttgttagcttgggatataacatgactagagattggactagggattccttagccatgcttagttcaactagcacacaatgagggagatcctattaatgtttagactgtaggttctaatggtaatgttggattagtaccaccgctttggtgttgattaactaaaatgaatcacatggtgggctatgggtgcatggttttgctagtcgcacccatggcaattaaggaccggttcgcgggaaaccctggaagaattcctcgtacttaccacaagccagcgtgggcaacggctggacttgtagtgtatctttcctctagctgacgcattcaggcaagggtgggcgtgatggagcgggacgggccctgcgacggcctctgtcgctttcggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcaccgaaacgtgtcgtggggctgtgtcttgtgggtacagttgtacacctctgatcagagtaaaactattcgaatagccatgcccgcggttatgggtggtcaaccagattcaccgtgattagtttcaccctagtgtagtctaatgaaattggatagtttaggtggatgattgggcctgttgcaacgtgggatagcattggacagtggatgattaatattaattaattattacaactgtttacttctttcaacttctgtttataaatgctcgctttatgcaaatgaaccactctagctctcctttgataattctctgcatcatatccctattccggtatgacttgctgagtacagtgggtagtactcagtcttgctctattttccccaaccccagagtatgagtatgtgtcagatggtggtttctccgaggagtaggcttcgtccgtgccgtcgagaatgcctgtggagtggtgttcccgccgcagatcaagtcaaggcttagctccagttatcttttgtttttccgctgcatttatgtaagacttttatgatatttgtaagacgtggatctgaatgtcaacattgtcgtttgtgtaccccggccggtcctggacggggattttaatgcacattctgcttggaattctattcgggaatttctaggagtgataagttggtatcagagccgaccttgaccgtaggacaagccaaatggaaaaacctaagagccctctgaatccttttcattgcatatgttctttgcaattggatttgttccgggaaaattgggatctattcttgtggttcaagggaaaaatctttgtcgctcgtttaagcgagatttgtcaaaacaagtcagtctagggttttagtaaaattatttgaggtttattcgtcagtcagttgggatttgatgggtgaaatgcattgggtcctagctcaggaatatgggttgcaaggtatttatgcttttattgttattattagtatgtatctaatttccccattattttatcgctatgtacgtctgtcttatttattcgctctcatgcaaaatgatctatgcataaaatttcgttcttactcgcttctcttatttgagtcctttattgccttatttaaatttggatttgagcatgcattgatcctactcctttgtcttctctagatggccgaccacccacccaaccaccgcggagaaggcatggatgactttgtggcataattggcacgcatgacgctggtggtgggctaccccaacgcgccagagtacacgactgttccaccgctcagtggcgagcttcctcaccgtgtccacctggaagtccatggctacgtgggtacctgcctagctaatatggtggtagaggcatccggaggcacagcagatcacgcctgtcaggaggcagcatacctgatgatggccagactacgggagcgccacaactacatcttccacaacacggcgtaccgatttcaccctcgtcgagccagcggtgatgatgtcagtactttccgtccgacagtcggcgagaacaacaccacctttggtcacatgtgcgccgtgatgagggggatggacaggatgcactcggatctgcacaaggcgtccaaggccttgaacgatgggaagctagtgaggatcatagctctgaaggatgagatagcacgcctgaagaaggagaatgctcagttgaagggtctcccagcaccaggaggagtccggatccgcaccacgccccgcaagtcgacgactgcacccgtgcgcattcagcttgcgcccaagaacccacctccgcccgcagttcccgcagctccagctccagccccagctccagttccagtgtcagctcctgcatccgctctctccttcgcgccagcatcagccgtcaggggccccgccagggcaacgggggttggttgcctgctactcccagtggtagccgcgaccatagaagcagcagttccagtggcacagagccgggcagtggcgagacgtatctgccagactccaggagccgctcagagggacctggtgacaagcaggaggacgccttcgacttcaccgaccgcaggagctgttccgagcattaggctcgctttctattagtttatcgactgtttagcttttgcctgttagtttgtgtgtttaggtctgctcgcttgtgggtcagttgacggtcgatatcatgtgcctatgatatggctgtcttaataaggatttttgcttgatgtttaagtgttttaattcagatcagaacaactgcagtttaaattcctatataataaagcttagttcttgagcatctgtttttcttcttttcccccgtctgcttctcctccagatggtctacaccaggaatggcacccgcaccacgggcgagggcagcaacggcgaagagcgcactgatggtgtgcatcccaatagtgattccggcaatggtccgccaccactccccgagaatccgacccttgcccaagtaatggctcatcagacgcagatgatgacagccatgatgcagcaaatgcaacagcagcaccaacagatgtaccagaggatgcagcagcaagccgagcagcaccagcagcagtttggcccccctccccctcagtccaaactgccagagtttctacgcgtcaggccacccaccttttctagcaccaccaaccctatgaaggcaaatgattggctcca

SEQ ID NO: 46593 - DNA, 19313 bp, Oryza sativa
  unsure (1)..(19313): unsure at all n locations
ggagcccattcacccgaaagcgattttgctaacgatcactcgcgtgatttttttctgacatttcacgtttttttcaggctcgtcagccggcgcgtcggacaccagcacatcggccaccgtgtcggagaagcacgatgacacagtggcctctgaccggcgagccagccgccggtagcacggccaatactgatcgacgagagacaccgtctctcttgtcgttgtcgtgaaatataaaattacaatcctatataactaaatttacatttgtaaattcagttgatttgacatgtaagtgcactgtaattttgataaaaaataatgtttaagtaaatatgtacatattattttctttaaaatataaaattacagtcatatataactaaaattacatttgtaaatttagttgatttgatatgtaagtgcactgtaattttgataaaaataatgtgtaagtaaatatgtacttattattttctttaaaatataaaattacagtcttatataactaaaattacatatgtaaatttagttgatataacatgtaagtgcactataattttgataaaaatattgtgtaagtaaatttgcattagttattttatttcaaatataaaattacagtcttatataactaaaattacatatgtaaatttagttgatatgacatgtaagtgcactgtaattttgataaaaatattgtgtaagtaaatttgcattagttattttatttcaaatataaaattacagtcctatataactaaaattacatatgtaaatttagttgatataacatgtaagtgcactgtaattttgataaaaatgttgtgtaagtaaatttgtattaattattttattttgtagtccgttggatgcaaatccaaggaaagaaaaaatctcaaaaatcacccgagtgatgcataggcggccccctcgaaagaggggaaaagaaaaacatcgaaccgacaaggaataagtccattttgcctccctcaattcttcccctttgtcgaattatatccctcaaccacaaaaccgggtatattacctcctccaagtgttaaaaccagtacaaaacaactcccttggtggtttttgacagtggttttgctggcgtggcatcctagtcatcgaaaaaaacttaaaaatatgtgagggcccacatgtaagtggcatttctattcttcctctcctccaccactctcctctctcctcccccttctctctccccaaacagagcacggccaggagaggggccggaggcgcgggaggtgtggggaccgccggaggatgcgggcgcacgccgcaagggagaggatcaccggccgcggcgcccacgcggggagggttcacctgccacggcgtcgatctgctcggccggcaacacatcctcctgctgtctatccgcgccgccaacctccagcaaaatacataagctcatcaggctacctttcgaagagcatgtcatgtgctgactgtggagtgcaaaagattaagctttcacctaaacacttggagggggataaactggcgaccatccatggagcagcaggagtaacaactgaagatgatcatgatccatcccaacaagtcgccggagcaagtggtagcctctttcgagcttcgacacctcacgaggaacaaatcagacataaaaaacctcatgaagaacaacccaacagtaacaaaagcatcccccctccattagctgcatgtccttcctggaattctatttttcttctccaaagagacaacgtgagatgcatggatgaacaattggctatgcgcctactactgcccggactcctcatcggactcgccgtcgtagcgctcatcctccccgtcctcctgctgctgctgatggtgttggtgatggtggtgcgggtgcggcagttgaccggcggcatcggcgctgccgacctggtggtagaactggctgagcgactgtgcggcgagcacgctgatgtggccgtcctgtgagagtcctagctctagccccggcatggtgcgacggatgtcagcgccgacaccggtatggtccccgtccccgtggcggcgacgattgccggctccgcctgctggagcagccactggacggtctcaccgtcggacttgtggccgagctcccacgtcagctggaagatccaggcgacgcacagcaccggcatccggatccgccgtccccgggcgtccaccttggtgtgccgggtccttgttcgagctccgcttcggtcctagctcctgcatcctcctctcccccgctgcaaccgctaccacctgcatctactgctgctgacagcggatcctctccctcgcggcgtgcgcccgccgcatcctccggcagtccccacacctcacgcgcctccggcgcctcccctggccgtgctctgttcggggagagagaagggggaggagagaggagagtggtggaggagaggaagaatagaaatgccacttacatgtgggtcctcaagtattttttaatttttttatgactaggaagccacgtcagtaaaaccactgtcaaaaaccaccaagggagttgtttttgtactggttttaacacttgggggaggtaatatacccggttttgcggttgagggatgtaattcgataaagggcaagaattgagggaggcaaatggacttattccaaccgacaacgaaacgaaacggtccttaattactcctatatatataaggcaacctattattgcctcttcttttgatcttttcacgtagacgtagtaacgatttgatcgaggaggagccataatggatacgaaacagccgagaatcgacgcaatagggctgcggttcaagaccgtggttcacatcacgctggtggcgtcgatggcgtacgcggccttcggcgccgcggtcgcctacccggcctccggcgctccggcggctctggcgctcgcgttcgtcctcggctacggcgcgctcctcttccgtctcccgttctccgtctacgcgctcgagttcctgcggcaggagttcccgatcgcgcggacgccgctgtccgtccaggcgtgcgtcgcggtcacccccgtcgcgctctccgtcgccgtcctggcggtgctcaaccaagcgagggccggcggcggcggcgacgtcgccctcgccacctgcgtcgtctgggccgccgacgtagccgccgtcctgtccctcgcgtggtgcctcacgcacggcggcgccctcgccatggctctcaccaggaggaaacagtacgaggagagcgggaaggcactggagcggatgatgaaagggtacaatcccaaagaccccgccgcggtcctcttcgccctcgacctgggcgagatccgcgatgcgtccgtccgcctcgcggcggctgtgtcggccgcgtgcgcggtcgctggcggcgtggcggtcggcggcggcggcggcggcatgtcatacacaggtctctcctatgccgccgcattcttcgcgctcccaatgctgtgcctctcgtacttccagaagacgtgcgcctacccggtggacatgcccaagcacctcgccgcctacgaccggccccacctgaaggtgatccgctatgcctgcgttcgcttcgtggccgccgtgtcagccgcaagcgcgatagccggcggcttggtcgtcggcggcgtgtcttggataggcctctcctacgccgccgtcttcttcgcgctccccatgtgcctcctctacttcagggagaagtacggtttctccatgtccgatatgcccagcctgctcaagtggtgcaacgtgtcggtgcctatggcggcgctagcgctgctgttccgcctcgtgacggcggcgcggcaggcagccgcaccggacgttaggctcgtcgccattgccggcaccgtgtgggccgtagacgccgctgcgattgggtttctcggctggcgcagcacgagggagatggccaagcccatactacgggcgaacgcgtcggagattttcacgtcgttcgtgatggtttgcctacgatactggctgtatctgcacgttttctatatccttggcaacggttcacagagatggttcaattcattatagccgttctagttgagaattatcaatgttatgctcaaaagtacactttaacattaatataatataatgtatttgtctttttttctaagtatgcaacattgttttgttttagtcactataaaaatgatttttgcggacgcacaccctattttgttacatgcgggctaaaagaacatctacatgtaaaaatattttggatgttgtttggttcagacacgtatagaaaaatcgtttttcgtaaacaggcctctcaaagcaatgcaaaaatattgacgaacccggcataaaaatttatctatagtggactatgattcttaatgtgttagattgcccctatgtcaatggatatctaaccctacttaaaaaattgtaattttctattcgtcatactccgtttcatccatcatccaagtccgactgcctttggcctcatgatcatgatttctccctatgcctctatcgctcctcctcaccttccctaaccttcgccgccgcaacgccatggcctggcgacctccacttcgcaccacttctcctctcccaatcctaacccatatgtcttctttgtctctagcctcaccttctcgcgcgcacggcaccgataagcaggcacgggtgtgtggacagccccctcttcctcccaagtcacaacccagccctagccttctcccttgtgtgccatgtgccttctcatgtgcatgcccgacgacctggtttggagctaggggcaacgcagccagcatctggcctcctccaattgaccatatgaaatcgaattcaaggtgagcatgaagctccaactgctgtatgcgcgggaggaggtgaagagaccgtcgatgcccaccacgctcctttgttttcttgcgtgccatttgtgataagtaacagtaacctagggtcctggagtctcccttcgacaacatattcaattctacggagaatctttctgctttaaatttatattccagatcatgaaatgaaataaataagttccggaacattgatccaacaataaacttagctatacaaagaaaataatttgtaacccaccaagtgaacaattatgaagctcttggattaaaacaaaacaatgttgcatactataaaaaaatagatattaatgtacattttgagcaaagttaccatttacagaagttgatgtgaatattactcaactaaaatggctatagtgacggcgcatggagcggccgctgggcgatgccacgtcggataggaacagtgcgcggagtgaaaatttttcgaaaaaaccctctgatttatgcgtaattagatctaggttccccacaaacagttctcctgaaatgttattttacataggggtccttctaaaaaccagatatgctgtgcgaaggacttaaaaaatcgtgaagccggatatatataaggaagaagattattaaaattaagcaataaataataaaaaatcattataaaaatgaccatcgtcttcaaaattttcacaaccacatgtaacgaagagtttgatcacgcgtctctcgtcatgttgtccacctaaaaaccatacacagccacttgtgctactagccttgtataaggctataagcatatcaccggtcactgacacgtggccccataaaccgccaccctgcccccgcgactactggcgcgcgccttctggactcttcctgacccttttttggcgggcgacgcacggtgcccttgacgtccacgtcgaccgcgaccaccaacctctgaccccgtcgccctccacgtcgccgcctccttctcccccgccgacgtggccgccgcctccgccaccaccaccgctccccacctccccgtgaccttctcgatctccccgcctatttatgctcgtctcgtcacccgcagcagcagtagcagcagaagaactgaagaagagtgatctagctagctcgctcgcctgagttctttgcttcaattcgatcctcgctaagcttcctccagctcgatcgatctctctctgcgttttagttggttaatttttgtgtttgagttatttgcaatggcggccgctaccatggcgctgagcagctccttcgccgtcgccgccgctgctgctggtggcgcgccatggcgtggtgtcgtctccgctggccgcgccgcgcctcgccggcgtgtcgcgctcgtcgtcagggcccagtccgaggtgagctgagcatgccacgcttgattgacttgatcactgtgtgttctggtgattgcttcttaatttgctaacttgggattgatcgttctgcagccggaggtggagccgacgaaggaggagacggccacgtcgtcgtcgtccccgtctccggcgacgaccccgactccgagccccgcggcggcggcgcccaaggcgaagccggcggcgagcacgaagctgtgggacgtgctggcgttcagcgggccggcgccggagcggatcaacgggcggctggcgatggtggggttcgtgtcggcgctggccgtggaggcgtcgcgcggcggcgggctcctggaccaggccggcagctggagcgggctggcgtggttcgccgccaccgccgccgtgctctccgcggcgtcgctggtgccgctgctccgcggcgagaccgcggaggcgaggagcggcggcgtgatgagcgccgacgccgagctctggaacgggcggttcgccatgctcggcctcgtcgcgctcgccttcaccgagttcctcaccggctcgccgctcgtcaacgtctaatttaattaattaattaattaagctgtacgtacaatacgtgcatgtacgtatgcgtgtactgggtagatagctagggatgtgtatgtatgcactgtagccaatagcaagcttgatagtgcttggtgtactaccttggaatttgaaaaaggaattcaaattttgaaactcgcaaaatattcgtgggaaatttggatgtttgatacagatccatctcgcataggggaaccaaatgtagtggcaaccatatttttggacactacgatttgaactctgatgtgaacagtactggtggatagagtaacgtagtacaaactaacagctacgataaacaaatttcaattgacactgttttaggcatcgttgtcttcgctctcttctagagcacaattcgttcctagagcaaccaaaatatttccatggcattttttaaaagaatattcaaaccttcaatggctctatgaaattaatttatatctaaatgctatacatttcatgaaaaaaaatggaaataaagaaggtagattgtaattagtcagttataagatgttacgctgagatggatgccatataattctacacatgtttaaatgctgattgaagttatccataactaagtgtaatgcagcaaaagccctctgattaattagtcgaattataagagggcttattcatactccccccaaccaaaagtttatagcatatttcttttatcacaaagaccaagtagaaactaacttatttcacatataacaaagaaaaaataatatgcattcatgattcatgcaactagtattacaatgtttgcttgaattttagttaacaatttaatttagcattgtaaaaagtacaagtccttcatttaagtctttgatgcatatggagacgcatatctcatttggagaaaaaaaacagaaaataaataagctttaaaacttttggacgaatggagtaatgaaaaaacttttacaggatttttatggacacttaattgaaaaacattaaaatatcccataacattccttcgttaatcgttataaagagatcccagttttacacccgtagctaggttatcataatcaattaagctagcatgcacggcacaaattaagctctagaacagcgctaaagaaaatgatggaacaaaacgccaataaaacggtcactaacattgttttgccgtctcctctcgagttgtcgttcttgcatgcggaaattgctgccactttgttggccaaatggagatggaggctgctaactagccacgccgggtggtgcatgatcagtgatatgacctcttcgcggtggcctcgatgtccacgttgagcaaccaatgaacatggaccccaatcaccccagctaggctccatgggcaattttggtttgaagcttgtcataattttgtcttttttttaaagacaatggatatatagaaatgcgatcttgaaactcattttggtttaaagcatgccataattttggttgtttcacgaagcgggtgcagcttaatgggttagttcttttttttaaaaaaaaaaaagaagtctatccactcgagtttaatttaattttctaaacttagcacatgtacttgtaatttagtgatagacgctaactatggtgtatgtgtttatatggtcacgtgtgtttgtacaatattttttaaaagaaaaaatagttgtgtcaaatcttaagccaactttagatagatttgccccagctaatattgattccaatcgaaatgactacagtctataaagggtaagaattggcaacaaaccaaaatagcccgatgcggcgtgactgacgacccagcctcactccacgtaggtagacgtacaacacgtacgattgttgattgttcatttgctgtatcaacgatagctcagtaaaatcgtattacctgtaaggtacaaagaaataaaaatgactaaaatgtccatcactttaacaaatcctaatgcaattgtctctcattttaacaaaccctaatacaaatctcaatgcaatcgtctattattttaacataccccaatatatgtcctctacttttataaacttttaatgcaattatggcttaaaagataaaattatttagagacaaataaaattatgaataaataaagttattttgagacgaaaggaattatgcgtgaaatgggaaagcaggcaggcaaaactcctaccatcctcttcacaacgaatttatctagttctcacaacacaaatggatcaggacaagttacatcaggaaccagcttaaccatgccggtcgctactactagtaactagtgttacacagaggtacaaatggcaggcaaaatcatcacccgagcttgctcctcaactgctccggcagtgaggctccgaacacctgggcgagggccatcttctgcctcttattcagcctgcacagctccagtcccccgcaggacttgccagtcagcagcttgcgcccatcgtctacagctttccttctcagggagcacagctgtgcagatggttcggttgtgatcgcactatcggcatcggcttcggcttcagcttcatctgctccccagtccaactcatcgtcggtcatacccttcgaagcctcatttgctgattcaggggcttcaccgttatcgtctttcgcaggtgtggtctccgtgtggctgtcagtcccccaccatttcatagtttgcaaagacaagccagatgatggaaatccgtacttgaagtcgtccatgtaggttgggatgcctttggtttgggtaccataggacaagattgctgatccacccaacacattttgttttcctgggggtgagacttgtcctgccttcgaacttccctgttgagattttgccactccttggaaagcgcctggtgatctatcaatatgtccagatttaagtgtcagaacaaatgctgcaaaccgcttcaatagtgacaatagatcatcatatggtgcttgatgcagagaactgagaaaccaaattagactacaatagtggtaactggtaacaacagagggaaagttgatagcatccaagtgtgaaaacatagaaacacgcagcctcgggtcagagagtcccacagagggatggtctaaactgttgttgtggtcaggtttacctggtaccaacccaatgtcccactctactgccccagcatccatactcagacagcggatggtcagtagaatcctgagcaatgaaccactacaaaaacacactgtatgcaagtattgcgcaaatattttttttccagctgaaattcataagcacaattatccatgtccacagctcaaagtagccataaaaggaataatagaacacctaagggtcatgagaccaacaaccgagtttgagcagttaaatcagacaagccaaaagctagtagcagtaaaagtttactaagcagaagctacaagtacaattaaaattgtcatgtgcttttagatttataatacagattagcgacaagaaggcagaatgagcatatcattaacttcttctattgcactacatagcttaagttaatggtgatattgtctgcagtaaaacgtgcatagactctcaagttatacaggatccagagcagaaatcttagtagcagataaaaaaaactgggacaaattcttcttaaaattaataagtaaatttatgaaaaaacagattgtcctgtaaattagttccatcccttatgatatatgtattacttggccacatatatgttcatcactgttgtttacaacatagtgcattcagcataacttgaatctgctggcagtacaagctacaatcagtcgcaataggaattaccataggacactgccataaaacagccaatattacaactgggatggagttggactgtaacagaatatccagatctaccatagatgataattatcagtccagatagataagagaacaaggaaatgctggaatttcaagtactactttcttcacatcttgtactagttaagcgtgatattacactgaaatattcatgcgagtagaaaaagctttgaattattccatcaactacctcagtatactctgttgattatcaagaaaatagcactagcaagcagttgtcgtggctaacattcagtgagaaccaagcatgtccagttaacatttgcagaagagagaagacatatttattattgcacaggaaacaggaataaaatatgggcatcaacacaatcaagttaaaacgcactactcacactgttgatagaccagatgcgcttagagccttctgttttgcaactttagatatctcaagaagtcccttggctttctctctttcagcgttttttgtgtcatcaccagacttcccagatacaagctgcaagcatgaatatttaagaaaaataatataaataattggattgcaaagaagaaactaagaacaaagctgggaaaacataatcaatatgcggaagagaagacaacatggggtagaaatagctttcagactgtagttgttctatgtttgcatgcagaatagagtaaataccatcttcaataacagtttgaaccaactcactatgggcattcgaatagccattgaacaagctttaaccaattatgcagctagacagcatatttcagttatcgaatatttaccggaaggagtattttattagggaaatttaactattcgccactcaacagtgatggcttcaacgatttgccattttacagatgccaattaattatttgccactaaacagacgtgcactcttaataaaatgccatgttacctattttgtttactatttcccacctaaacacaaggattcgcctattctccttcctgttttacccttcatcctaccatgtcctcagtctgttttctccatggcaaaggctgccacctccagttctcaatcaaggcacgcaccaagtgcatcccaaaagccacaggtgctgtgattgaagcttctgatgatggccttttgtttcttagcagcagttctgttagcagctgattgtggaataaaataattcatccatcttagtaactagtcaataccaaggaattagacttatatttcttcgatgtagattatacttgatatattcggcctgtgtcaggaagagctctgaattaatggatgattgccatggcggagcaaggggtggtcgctatctgttctggttagaggcagccagcatgggaggacaagggaggtggagttttactgagagcgcacatcaaatttagtggaaagcaatgaattaccacctacataatagggcttctagggcatagaatctagcgcctcttttcttccttcgaagcaaacttcaatctttcatgaacatcttcaagtagccaacatctgacataattcattcgtctccttgcttactttttgggatacgcttaattcaactattaagataagcctctgatgagtacgatatcagttcctaaagcagtctaccttgtaaattgttaaagccaccaactgctgcaaaatatataagcaaagagagcaccatgtttacatataggatacaaccactgcatacttctctttgctcaaatagccctaaattagaacaagcatgcaagttctcatcggcaaatagctttctttcttccttctcgcaccagtgatttcctcgtcagttagacattcaacacaatcactcaaaaacacaggaatcagctcatgaaactaatctgctgaattcctcgtcagttctgacattcaagttcaacacaatcactcgagaacacaggaatcggctcatgaaacagggcaaaacatacctttcgatacggccacctgacgatgccgtggctgcggcaaatcctcttcaaaacgctggtgcaaacacctgcaaatcccccccccacccaaaagttcgttcagctgctgcgcggccctcaaatcgagccaggcgacggatctcgcccacatctggagaaggacagagagagagagcgagggcgggcgggattaccgaggatggaggctgcctctgcgattggtagcgagaagagcttggagatctcctcgtacgacaacgataccctcgtcggcttctgcggctgcgcctcggaagccggaggagccggagtcggcaccgccgccgccgccaccggctgctgctcctgctgctgctgcggctgctgctgcggctgggcagtggaagccatgggagccgcgcacataacagcgcgggtggcgtgggaatcgacttcgcgcgggatagatcggggcgcgcgcgaaccgaaccgaatcaaatcgaagctgacgctaagcggtaaaaggcggcgcggggtttgggatggggatggagtgggagagtggaagagggcggggcgcagcgcaccggtggcggccggatgcgtgggtgggtgggacggatcggatcggcgtgccggctggctggctgggtcgatttcgatttggggatttcgccttcggttggtgcgcgtgtgtggtgattggattggattcttcttttttcttgggttggattggattctctgctgcactggagggtttggttacacagacaggtgggccccctttaatctgggaataatttacagcattttgggcccggcccggattggtagaagtcctctgcaaaatttgataagcgagtacttcagtttcggtcacctatatatttgtcgaaaaaaaatttcctaaaattttaatagacataattttaaattttcaaaaatctctccgtaacatgctattttcgtgaaacggaggtcgtgggaacgaatcctctcacatatgtgcacgcagtgacttttttcttcttcacttgcataaattttgaaacaaatctaacggtttaaaattatataaaagttatatgcacgttacgacgtaattacattataattatactgtaattatatatgttaactttttaggaaaaaaattgtcgacaaatatatagcaaaattgcttcaattttaggacataattctaggttatttttgtgcatatgaaaagagtgtggcaataatgtttaaaagaccgcgagtggtaacaggtgtgatcccctactccctagccctcgtcagttcatcaatgggttccgcttaggggtggggattcggtctaaccaaaaaatttcggtgtcggtcttcggtctttcggtctttgaaaagtgaagaccgaatttcagcgcaaaaaatgtcaggactgacaaattcggtctcggtctcagtcttgaccgaaattcaacaacattttcatatatgcaaagatataatggaaatttcaacacaaaaatcacaaaaaaaatcataagcacttataagtaaagacttttattaggttgcatgccttgaagaagtagggatgtgaaaattagaatttaatcctattaaacatagtggattgtaggttgcatttagactttttttttataatttgatcttttcggtctattcggttttccgaggagactaaccgaattgaccgaacaaaattcggtttttcactacctagaaccaaatttctcggtctcggtctttttggttcggtctttttctgcccacccctagttccgctgtcaacggacacggttggcatagatgttgattctgtatttttttagcagactcatcatcggatgtgagtgaatacagtgatcaggaggtcaacgaggttaccatgtcgaagctcgttgaagcgttggctctaccctgctttgttgctcgcactcaagatgaaggttttcataaggttatcttcaatactggttgtatgtcagttatttaaagagttaaatcgtcattgatgggctgatctccacttctccagttggtataatggttgtagatatccaaggagacggatttcttcaccgttagttttttctcatgtttatcatgtgtcgaatgtgatggctcatttgctagaatactcttgtgaacacctacagggaaaatgaataggtttcctcgtgtgttctcattaccccagctgggaatggaggattgcaccacatgaaaagtgcacagaattttcatttaccatttggaacatataagttcaaatatcagctaacgcataacgtttttcccctatgccaggtcccaaggcaaatcaatctatgcaactccaagtaaccgtaattttatcacaagtttaagtgagagcatcaagtttacttatttaccagcttttacggattccgcctacgatttcaaacaccccatctcactgttatcatatgtttcgccaatcctttgttgagtttgtatcacattcttgtggttttctcccctatttggctatttcctcttctgatttcaaatggccaaccgaggtaatgtaagcgacattaggcccaaactagaaaactaaacaggcccagttttcctgggccacatagcccgcatctcactcggcccattgcgttagacaccggttagctcttcgcgcccagcttccggcacagcgcccacccgcaccgctgctgctgctgctgcggcggctgagcaccgcaccgccggcgtctggtgacgccatgcacgtcgcacccttccgaattcgcggtctcttcccccttcaggagcggcagccggtcgaacgccgccgcgacgaacgtggccagcaccaccaccaccggcccggcggcgacgagccctcccggcgcgacgccgccgccgagcacgccgccgcgcggcccggccaggaacaccgccgcggaagcgcctccgcctccgggggcgccctctgccgccgcatgcggcggtggggacgggaagaagcaccccgccaggcccagtatctccatggtgccgcggagcaccaccgccgcgggctcccggagcaccacgtccgcgacgcgcccggacgcgcccagcaccagcgcgccgcgccgcgcgcggcgcgccactgcggcgacgcacgacaccacgtctcgccccgcggggacctccacgacgagggcgcgcatcgcgctggggcactcgtgcgcgatcacggccaccggcggcggcttcggcgccccgcggcccttgcaggggcacagcgccgccgccgccgccctgctcggccgccggagcttgcccggcgcggccgccgccgcgtcgttcgcggtgaccacgcccatgttcgcgtcaaagattttgcccgcgtcgtcacgtacttgtggatgcttaattactgtgatttttagagcgttttaaagggcagatgcccgtgttcttcgaagtagctcagctgttaagagggaaaataagcgtgatgcgtttttaattgttaagtactcgaacatcctaacaagcacccaactgtcacggtgctcatgtcctgcaaaaacattaaaaaacaaggacccaactgtcacggtgctcatgtcctgcaaaaacattttctgcaacatgcaagtaggtaaagtacatgttgaactaagcatttggcatgaaccataatcatgttaatgaaggtgaatcagggctccccttaccgtttttggcgcgcttatcgcactcccgcggtaaccgcgagacataccgtggttacaaaaactaaaaaggttaccgcgcatggtaaccgtgataaccgcgtggtaaccacgcggttttgtaaaccctagggtgaatcagtgaattgcctcttctaaaatctaaatatcccttcttcaggaaaaatgtgtttaaaaaattgactgcaaaagattcaatgactgaaaccattttgaagactttgtttggaggttgatcctgggtgtatctggatcccaatgcattccacttgatgtggtgctgaactgctgattcaatttatatttaccagttgcagtttgaaaaacttggccatttcagcattcactgatcaatttatcttgcatataatgatgcagcaacaggcaaaaaagtaatgttgttgaatagtactgtggtgtgctaaaatcaaccaattgattgaggtgaacgcatacggtatttaataacttaaaagggacatattgaataagcctgatctacatttggagtgtgtttcagaagtaactgatggaatcaggatagaacactgaaaacagctctggaaactaaagaaatatcaaaccggttaccacgacatctcttctgttcatgaatcaagggagttgccgatgacaacatgggacaaacctaagcagaatcagacggccatgttggcattgttaagttcagaaagtgcacaactaactgtatcagtagccatggccaagtttcatgtttcaataattgcagtcaaagactcaactcgaagtacaaacatggctgctgttagtaccactaatttagtatccctccaccgtatcagtacttgcaatcccccatgatccctgaatatacaatacacctgacacacttgttttgattttataaacctgacacactcgatcaattgatcctcctactgaatctatattgtattccgcataggcatagcccaatagtctgaacagtgacgcggatactttcagaaaaaactcgacacatcgcggagagtcagtaagcagagacagcggtagctagcgagtagctcttgacaaaatagttgcccatccttttcttcagactagagaagttcagaccaagctgttcacctcatttttcttttccaagctgcagagactagtgagccatgttttttttctcagagaaaagaattaagtttctcttcctttccaactcgaacagtcgtcgacatcgccatcacgcctataaatgcaaggcaaaaaccgatcgatccgggtctagacagacacagagagagagagagagagcgtctactcgtctctccaatattcctctagctgctttgcttgtcgcttggtggtgacgacgacgacgacgacgactagtggtggtggattggttggcaactctcgagcccacgtggttgtggagaccagaagaaatatggggggcgtgaatcacacacacacacacacagacaatcatatcccgcggtcaatgccgtccatgctcttcaaccagcttcctttcgtcacctgtacatcatcaaaaatctgtcttgtattccgattcccaagtagtagtactaggagtagatctcagctttctctttccctattgtcatcaaactctcccatgatttgatagtcggtacctgataccccatatcttccattttgtcatgtgaggtgcgtatgtaaagaagctcccactaaaattaccgcgggcacgtttctaaagctacgaaatggcacgtttttgtaaagaatatttcatcgtcggtatttttgaaacaatttattgaatccgtgtttaacttcgcaacatataatactcaccataaattttccataaccacatattttacttagtcgtacttacgtaattatgctgtaattagccggctagtcaacttttttttttaacgaatttacgagcccgccaattttattgattagagagtaagagagctgtacagaagaagacttcacaaaagccaaaacagatctgcaaccctgctgaaaaggctaattacagtgacagccatgcagcgaggcttctcgcacccgtaacgctccacgtttttacttcctcttttatcttgggctagtcaactttcatcgttgattacctctatcgttgttataggaaataatcgagttataggtatacaaatactgactctatcgttattaagcatcagctgaggtgttttcaaccgtgttgggagaattcaagctcgaaggcaaaatcacggagagagtgtttgtgacacccaactcaacgtctaataaggaacaaatanagcagaagatgataggatccagatcctctgactttaggcactaaaggtaggggcgtacaataaaataagtctgatggtacaataagaaattgtgattttgcatatattttctgtagcaacagtgtaaaacagtaaaatatatagcatcgcatcactgttttttcagtattttagcatattttagtaatcgatctcgttcgtttgctgtgaatcagacagctagaaacacctcagagtcatggtattattcctctgcttataacccccaaagttagaggatctcattcttaaggtaacaaggggcagggtaatgaggatgatcaaccgagctgataaaggaccctatactaggctcgtaggtacagtgtgcacgtaagaactgggccggggtcactcacaagaagaaattctgcatcactgcaaataagaattttcttttcttacattggtcaaaagggctaaagaagattgattctccttgtttttcacattttccattctgggggagataggagtagtaaatcacaacaaaagacgcttggaagtgtccggtatgcatggattcccttttggaaacctttggaaaaagaacaggcctttttctgcgtccgatttgaatgcattttttgtagctgaaactcccagctccctcgccaagtagccatagcctttcccaaagccaaagccttttgcactttgcagtttgcactccagttttcttctccaattaggtgaacctaattgatagtaaatcaattatcaatttccataggctgca

SEQ ID NO: 46594 - DNA, 880 bp, Oryza sativa
atattcttacgtgggtgatactgtgatagcactttattccaataaaattctatggtttaaatatcggtctccataattttagctcatgttagttcagtttttacaaaacttctttttttttttgtttagtaataataataatattttccctaacaggtagttggggataaagaaggtgcagtttttggcggtttagttgaggctccattgcagccaaccagtgcaaagaaatatcaggttccacctacacattctgaatttctgataccctttttttctggtttaattaccttatgcagattatgatggaatcttaatattgcaggggagcaatagctgctttgttttcactaatttacacagcaatcctagtatatatcgaccgactggtaatatttcacctcctgttttcatgttctttgcataagaacatcaaaagctgcgaaataattttgttccatttgaccctaccttccagactactagatgtatttctctgtgtagcagtgacttatgattgtttttgtcccctgattcctgttcaatatatataacactagcatactcctacaaaaattctgggggatcaagttgctgaatatattactgttaacactagcaaagacttaactcaggagagcccctgagcattcatttctggtattgcaggtgctaataactatttcacagtgtgctccaccgactatttggcattaggaggtggaggtcatttcgcactttatctagatgccgacctgtaatctcccacctcttaagcatgtctttcacgccgtcaaatctgctggttttattgccttttgtcattgatagctctcatcttttcttctgggttaccctttttcaggttgagtggttcaag

SEQ ID NO: 46595 - DNA, 7480 bp, Oryza sativa
  unsure (1)..(7480): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatactgttgaccttaacactaatacccccccccccccccccccaaaacaacaaaagcagttatgcagcacatctttgtgcatattcagaatgagcgcgttcttaaacactcaagcaacagctagcattcttatgttattgggttcaaaacgatatgggattgacacttggaaataaaagcggatactgaacagccaaacacacagcttatactcagagcaaatttacctagatcagtcatatgattttaaatgtattatggacaaatgtttgcctaaagacatgcattcatatgcatcctattaggagatgatctatcaagccaactcagttgaggagattgtctggtaacagcacagataacaaaaagaaaagatctgcatacacagaacccatggggccacgacattctgtatatgttcaggcagaaattgacattgtgaatttgtgaccagctgtactgatttacctttcctcatgaaacatcactacaaaactacagctacagcattccagagcagccaatcacagtacgcaagaagtaatgaagggacagaggaacagtatagagactacattttatctagcatcctgtttgtagatgcatgagatatgcttagtactatgaaaaatgaatatatatgtgcccatttcaatgattttgctagtgttcaacgaaattctgaaagcacatgttaaaaccctctctaaacacataatctgaactttgatccataagactgttctacgacatccatgggcctcagttgggtggagtaattatttaagcacgaaacatgtgtaactaacaaccaccacaccttgagagcaatgtaaagcatcctttagcactcgaactgatgatagtccatataatgtctagacctggactgatggcaaaatgcggtacaacagtaactgacaaggtagctataattatgtatatctgaaagtttctgaaagcatccactactaggacaaaggtaaccacagaaataagcaaccccaggtgaattattagctaaaaactcttgcctaagcagaggtcttgcataaaactctaccattcggcaatttagcattcttctacagaaaaaaaaacagcactgcagcagtaagcaagaagaaatgcaccatgctgaactggaggaacagtccgtggaagcgacggtggaacctcccaaacgcggacgaagaagggaagagtaccaacacttggcgtcttggtcagtggatcatcccgaagagctcgtactccagaacctccctccgcgccgcccaacatcagttggccctggaagaagtagatcacgtcggggtcgttggggtgcaagagcgccagctagcgcggggaccttgcgctccatttcgctcctcttgtacctcttgccgtcccaggtctcgacaaagggcacctcgtactcgcgccgccaccgtgcgtgcactcgatcgtgcagggtccaaatggtcaccacctgttcgtccggaggaccatggatctgcacgtaccgcatcttgttgcccgcgctcgccttgatgcagcggggcgcttggcgatgtcgccctcccctccggtggccagctgcacgcagaggaagtagctaggccgggaagaagtcggggcggagtccgagggccgtggagtcggaaggctccgccgcggccgggccatggatcactcagaggaggcggcgaacgcaggggtccgcgccgcggcggcgatgtaggggtagttcacgaggctggtgggcgtcaggggtgatgcggcgggtcgtcaagcgggaggcaagcgtcggttcccggcgggaggtgctcctctgagtaggccattagcggcacgcaggccagtaccacccacgggccacggctgcaccggcggtggcgcgctccccggcgtccccgcgcggcacgacatgcccagagccccagagcatgctatgaagaattgggagcggaagcggggagaattgtcagggcaggggaaatggtaattttgggattaatttgtttcttttttacaaaaaaaaggccgtgataaatcgctgcgaaacgtgtcatcgtcacgtatgagtttcactggcatgtcactttgcaaataggattcgttaaaatatcacatttaattctacacgttagaatactatctataaccaaattaccctccgtttcttttcttcctctctccaacgccagtagtggttgccagcagccccagtgcgtcgttcccagctaagtggacgacctccctcgctcccaccactgcttgagcgcaagctccagcattccaatcccgatcgcaccgtctatccaacgcccgtccattatcaatgcgttaccttccccgagctcgattaccgcttacgtggttgttgtccctgtaattgctccatccccaagctcagctttccagagctcgaccaccactgtcaccgagctcagggtggagtggatgacgacgacagcgatgagagggcgagctgctgcgttgtggtctcatgtgtcggagccttattcaccatggcctcgtcagagctagtattcatatgttgttatgcttgtgctgctgcatgtgttgccgtggaggctgcaccaaccgatgacgaccgacggaggttgaatcggcggctcaggcacgatggcttcatctcaaagtggcgacgctcgagctcgaggacagcatgagcaacgactgtggcgtccgctggtcgagcttaaggacagtgcaattgacaacaatgatgggcatgcttggaggtgagctaggcggcgacgacgacagacagacatgctcgggaaaggggcgtcctcacgtgggtgggcacacggcaagggacaaaccggagttggaaaagaggatgggtatgtaattaagaagccaacggtaattaatttgctcatgtatggtattgtagcaagtagctattggtcaatagtgacattttatcgagtccacttttgtgaactggtatttcaaaacctacttaggaaaatggcacaatgtcaaatttgttgatgcctatgagacaatcctaattccttcatccaaaaaatacaaatagaggaggtttgtttatttcaaattttttgttgtcttcttcaatttttatctttttttcttttgtaaaaaaagtaagggcccctttgatatggaggaaaaatatagaaattttggaggatttcaatcatataggaaaattttctatgaagcctttgaaacaaaggattgaatcctatacaatgctttgaaattcctatggaatggacaatcctgtaaagattttggaggaaatttagcaagagcttcaacctctcagtaatttttctttgagtttatctttctcatccaatttatgtgtttttcctgcggttcaatcaaacggccattcctgtgtttttcctgcattttacaatcctatgttttacacttacactcctatcaaaatcctacgttttctcaatcttgcgattctaaggggcccttagatctttcgtcgcaatcctggtctctctctccaatcaacttcgagttccgacttccaagtaaaaaccctaattcttccccaattcctccgaattgagccgccgtcatagcgatggccgagcttaataacagcgcaattaacaacaatgacgggcatgcttggaggtgagctaggcggcgacgacgacggacatgctcgggaaagggcgcgtcctcacggtgggcacacggcaagggataaaccggagttggaaaagaggatgggaatgtaagaagccaacggtaatttgctcatggatggtattgcagcatgtagctatgggtcaagagtgatattttatcgagtccacttttgtaaagtggtatttcaagacctacttataaaaatggcacaatgtcagatttgttgatgcctatgagataatcctacttccttcatccaaaaaaatacaaatacgggaggtttgtttatttcaagttttttttgtcttcttcaatttttatcttttttcttttgtaaaaaaaaagtaagggaccctttgatatggaggaaaacataggaattttggaggatttcaatcctataggtaatttttctttgagtctatctctctaatccaatttttacgtttttcctacaattcaattaaacagtcgtggttcaatcaaacggttattcatatgtttttcatacgttttacaatcatctaatttacacttatacttctatcaaaatcctaagttttctgaatcttactattctaagggcctttagatctttcctcgcaatcctggtctctctctccaatcaacttcaaattcctacttcccagtaaaaaccctaaatcttccccaccagttcctccgaattgagccgccgtcgtagcgatggcgaaccccgtcgtcccgtgcccttccgccgccgcctacggccccggcggctgcgatggcgtaggctgctcctccagccacaacgtctgggctcaccgtgtccgccacaacggcggcgtctaccgcctctgctcctcctgcgttctcctcggccaccgcgacgccttctgctccgtttgccttgacgtcttcccgggggacgcgcccttccaagatgatttctataaccccatcgtctcatgctcctgctgcggcgtcgagcccgtcgccgccgcccacctcgcctgcctcacggacccttcctacttcgtgtgcccagcgtgcgccgccgccgccgagggcaggaccttcacttacgccccctcgagcggtgccccgcacgcgctggcggagcgcgtgctcctcgtcgcggcgcggctcgcgcacgagtccgtcgcccgtgccgcggcggcggcgcgcgagcaggcggagcgcctgatccgggaggcggccgccgccaggaagcgcgcgcgcgacatggtagacgtggcctgccgcgtcctggaggcggaagccagggacgccaaagagcaggccgcggcgcccccctcacccgtgctgaccaagaagacgaccccgaagaacagcgcagcaaacaggagcagcgacaagcctctcaagatcaattcaatacagaagccggcgctggcgttcgccgcagcggcagccgcggccgccgccgcggccagctcaacgccattgtcgacgccgtcgcccgcgggggaaaggaagccaatgaaacagggaagaggtgagtcaacaagtagttattggctgccgatgatgaacagcaattgtgatttgagacaactattttttctctgtacagtactaattgccgtgtaattctctcagcttcagcaaacagaggagcaaaagatgatcaaaggacactgtttggtgcctttcaaccgtgatgactccatgtgttttttgatctttgaagctaagtgacattgaatggtctgggctattggccgtgcagtgtaaaaagaatcccaagtttagatctaataacagctagcaattggtgtatctatctacttggtgttcatattattaaaatttatttctaatgattttactgctgcgcaaatgaaatgcaattgaatatcccaattcaaaagtttatataactgatggcttcatttttcttaggaggatcaatggtggcagaatttgtgcttaaactttgaactagttggttttctaactcgtacatttcaaccaagcataagatccttaggtccctacgtgtacaatgtacattgttgttccatggtattacgttgcgaatgtacaattaattttgcaatatcaagaaaataggatcaatgttgtgttttactattatgttaaggtacaattgttcttttctatgtctcaaaaatttgctagaattgttctttggctgctctaaaccgtggttcggacgttctgtaattggtaactgagataactaattgatcctaattgttctgtactatactaatcgtcattgtatggttctagcaggttcagcaaaaggaggagcagagcaaactaaaactgaagagttagcctgaacatttattcactgatacacagtattaaaactctgtacgcacgtatagcagtgatagtaaagataagaattcacagatccaaaatttaaattctcaaccacgtgctagttcggaaatgtaaacaatcatccatcgaatatacgagaattagaactcagtgtaccatcacgaacaatgtcatcagccatccaccaattaacaaacactggttgtgtaagatagcagagagttaagccagatatctaattaaagacactgtccaacatcagtcagggtgtttggtttctcaactgcctagtaccgtggatatgtcaaacagaggaagcagggagaagaaacaagatttccaaacaaaactttcatctgaaactcaacactgaactattcatacaatactttcagctgaaactcgaggaactatgtttgaaccgtccatggagacatgtgacacgaagtttcgcatcagacacaatgcctcatatgcgtcagtagccttgacaatgacaaatgacaagtacctgatgaatgaaaaagaagataacacacacatgaggttcagtgaagaaaattctctcttgtatgcgagtgcatgtgaattgaagtggtcggcgatccaaagaggatggaaagaggctcacttaggaaaagcagtggcattcctcagttcctggaaccttggattgatgaagagccttccagtggttgacagcagttcgtcagctttgtcactcgaaaagttcaagtcaagctcatccgtcagattctgcaaattaacacaagcaattctagttagtcaaaaaatggtaaacctgtgttcaataacttgataggaacttagcttatgtatttttttccagaagctaaagatgcaacagtacatgcaccagtaaatatatgtctatattatactcagtgattttcagacttcagggtcattaatacaaacaaacgaagttgctgttatggaatatattctataagtattccgtagtgttaaatgacatacagatacatggccaacatacagcattactacaacattgtaactactaaaatgtagaaggtactaaacatgcaaattcacatatagtccttgatcgattcccattaatttacaatgtcaaaagaactatacagtgcaaatctgtatctgctagattagatgcaccctctggtgtgcaggattaatcatgaaccggccaaatgagatgtgcagaccatgcccagcatcaaaataactcaaacatgaatagcacaaatgg

SEQ ID NO: 46596 - DNA, 13339 bp, Oryza sativa
acgagttccgcgaggtgatctggaagaagaacaccacgccgagctccttggggtggaggagcgcgagcaccggaacgcgccgcggcatcatggtcttccggtatgtcacgtggtcccagatctcgtcgacgcgcacccggtggcggagcgaccaaaccgactcctcccccgcatcagactgctgcagcgtccacatgctgatcatgatcgtcgatggcgcgccgcggccggcggcggtgtcgtagtcgtggatctgcacgaacgccagctcgccgtcgctcacgttcacgcaccggtgcttggcgtggtccgcgtcgctggagtacggtagcttgcatccctcagggagcggcacgaagcgcatgtctggcttcgcggcgaacacgtcgcaggtgaggaggccgaaggagaggtccacccaccagagcatcccggcgtggacgatgacgccgtcgccgcaccacgaccggcggcctggcgggtagttgacctttgttgaagcccaccctccgagctcatgggagtagcgtagtagggtggcgcggtggatgccattgccggactctatctggagctcggccaacaagcggatcgggtggtcgcgatccgccgttctgcggatcatgccgacgttcccggcgcagaggagccggtactcgtcggagcagggcgggtagaggtaggccatgcggagcgtagcgtggcagaggatgtagccgccgtcgttggtgcagctcggtgcagggtcgaatccgagcgcgacgccggggccgaaatcgtgggcgctcctcctggcgccgcggagcaggagtccgccggcggagtcgacggcgacgacgtaggggtggtcgtcgcggtcggggcagaaatcccgaggcgcgggggagacagggacagagtcgctctggcgcaaggtgaggagggagacgcccggcgggtcgcgccagtcgaaggcaaggtggtcgccggcctcgaagtcgctgtcggaagaggacacgctcgggacgcaggccaggatcacccacgtggcctcccgcggcggcgccgccatcctctcgtcccgccggaacttgggcgccgcgccgtcgaacaggtgcgggctatgctccatgcgtctcttgctgctccgaacttccgaagcggcggcggcggcggcggcgttggagtggtcggtggcggcgatgggcggggtgggatgaactggaaatgggctgctcccctcgattggtttgccgctttaacggagccagaacccggaggggcgagaaggttctaaattctaatcgcatcccggtgtttggcaattggcactttggcttgctgaccaagccggttagttacggttatcaccatctaaccacctacagtgcggtgattttttttcactaatccatgtggttataagctctgacggtaatttttcgttaatctcatgttttttttagacaaaaaggttattaaaaactagagcattgcaaagctgtggatcgaggaggattcaccaaaccaaaccgcaccgatgtatcgtggtagtccattgtacgcttgtttgggaccatggattagtttcagtctttcagagaagaaaaaagaatgttacgcttgttgccttgtttcctatgctcgacttgtcgcggccggagattgcacggtgcgccaggccgccagttggcagatgccgtttgtgacggacgatgtggtgcggtccgtgtatggcaaaaaatggagtgaagctaagccaccgcgcgtgcacttcccaccgatcgcgattcacagccgcacgggcacacggcacactagtaccagtactactcccacgcgaacgaatcatcggaagtggccgtgcgcgcgttccggccgctacatcgcgccgcggcagcgcgcaagccgtggaagaggccaagcgtcttgtgcggctgctacatttgcctccgctccaaatagagacgttggtactgtactaccgtgtttttcaggctcaccatcagcagtagtactctgtaacaataggcttggacggctgccccaagttatcggtttatcactaatcaggttctctaacctcgaacaaatccccatcttatatgagatttagcacgcatcagccagcacacacagttgaggaatgccgtgaacaagacattaatcgatgaactgtttgtcataaacacgtggtttatgacaatatttcatcaatttgtcatacagaaagttcaaacagtcgatcttatttgatcctgcaagctaacacaagcaatgctagttgataaaaaaagggtgctaatttatagtatttgatagtttgcgaggaactagtcatctgtaaaaatgttaacaaaaacccaaatcaggtaaatgctatatttgtcacgtgaaatcaagcttcaaacccccagcagttgcaagttgcaacagtacattaattctattatacggttgcaccagtacatattacattcgctaattttcagacttcataactatggtagccactaacaccaactaaatgaggatatgctctacatgcagttgatgtttccatgatgaaataaaccagccttggtgctagcatcagtacacaatcatagtactaaaagtccctcgcacttcgtccttttttttagatggatctttgaatacttttgcacttgcattattacttattagacagcgataactgtctagcatgcagttttatgaatcagagtatgaatattcaagatcatatgaaaggagcaagcatgcatgcagcgctgtagcctttcaatctgtacggattactaattaccagcttattgttggaataatcctcacacttgtgtattttcaacacaaaacaaacatattatcaaaattgattcaacgttagaattaataaaactaatttatattttagatgctgataattttttctataagctttatcaaacttaacaaagtttgattaggaaaaaaagttaaacggtttataatatgaaacggtgggccaaaagtttgctagaattattctgcggctgctcaaaaccgtggttcagacgttctgtaattgtaactgagatagtaactaatagtctcctaattgttctgtacaatactaatcgtcatcgtattcgtatggttctagcaggttcagcaaacggaggaacaggagcaaactaaacgagttagcctgaacatacattcactgatacatagtattaaaactctgtacggaagtatggcagtgatatatagtaaaaatatgaattcacatatcataaaatttctcaaccgcataccagttaggaaatctaaacaatcacccatcaaatatgcgagaactagaactcagcgtaccatcacgaacaatgtcgtcagccatccatcagttaacaaacactggttgtccaagatagcagagagttaagccagatatctaattaaagacactacgcagcatcagtcagggcgtttggtttctgaactgcctagtgccccggatatgtcaaacagaggaagcagggagaagaaacaagatttccaaacaaaactttcatctgaaactcaacactgaactattcatacaatactttcacctgaaactctaggaactatgtttgaaccgtccatggagacatgtgacacgaagtctcgcatcagacacgatgcctcatatgcgtcggtagccttgacaatgacaaatgacaagtacctgatgaatgaaaaagaagaaaacacacacatgaggttcagtgaagaaaattctctcttgtatgcgagtgcatgtgaattggagtggtcggcgatctaaagaggatggaaagaggctcacttaggaaaagcagtggcattcctcagttcctggaacctaggattgatgaagagccttccagtggttgacagcagttcatcagctttgtctctcgaaaagttcaagtcgagctcatccgtcagattctgcaaattaacacaagcaattctagttagtcataaaatggtaaacctctgttcaataacttgataggaacttagcttatgtattttttttccagaagctaaattgcaacagtacttgcactagtaaatatatgtctatattatactcagtgattttcagacttcagggtcattaatacaaacaaacgaagttgctgttatggaatatattctatcagtattccgtagtgttaaatgacatacagatacatgatcaacatacagcatttacaacattgtaactactaaaatgtagaaggtactaaacatgcaaattcacatatagtccttgatcgattcccattaatttacaatgtcaaaagaactatacagtgcaaatctgtatctgctagattagatgcaccctctggtgtgcaggattaatcatgaaccggccaaatgagatgtgcagaccatgcccagcatcaaaataactcaaacatgaatagcacaaatggacaaagcacatcagcatgcagcgatgagacagagcaaagaagtgaagaacagcgcagcgtacgtaccatctgtctcatcatcctctccgcggcagatcgaatgtggcagctcccaagcgcggacgtggcgagaggagtggtacatcgtcggcagctggggcatcttgtacttcttgcactcgagcacgattctggtgaccaggtcgacggcgaacatccacgagttccgcgaggtgatctggaagaagaacaccacgccgagctccttggggtggaggagcgcgagcaccggaacgcgccgcggcatcatggtcttccggtatgtcacgtggtcccagatctcgtcgacgcgcacccggtggcggagcgaccaaaccgactcctcccccgcatcagactgctgcagcgtccacatgctgatcatgatcgtcgatggcgcgccgcggccggcggcggtgtcgtagtcgtggatctgcacgaacgccagctcgccgtcgctcacgttcacgcaccggtgcttggcgtggtccgcgtcgctggagtacggtagcttgcatccctcagggagcggcacgaagcgcatgtctggcttcgcggcgaacgcgtcgcaggtgaggaggccgaaggagaggtccacccaccagagcatcccggcgtggacgatgacgccgtcgccgcaccacgaccggcggcctggcgggtagttgaccttcgttgaagcccaccctccgagtccgagctcctgggagtagcgtagtagggtggcacggtggatgccattgccggactctatctggagctcggccaacaagcggatcgggtggtcgccatccgctgccgttctgcggatcatgccgacgttcccggcgtagaggagccggtactcgtcggagcagggcgggtagaggtaggccatgcggagcgtagcgtggcagaggatgtagccgccgtcgttggcgcagctcggtgcagggtcgaatccgagcgcgacgccggggccgaaatcgtgggcgctcctcctggcgccgcggagcaggagtccgccggcggagtcgacggcgacgacgtaggggtggtcgtcgcggtcggggcagaaatcccgaggcgcgggggagacaaagacagagtcgctctggcgcaaggtaaggagggaaacgcccggcgggtcgcgccagtcgaaggcgaggtggtcgccggcctcgaagtcgccgtcggaagaggacacgctcgggacgcaggccaggatcacccacgtggcctcccgcggcggcgccgccatcctctcgtcccgccggaacttgggcgccgcgccgtcgaacaggtgcgggctatgctccatgcgtctcttgctgctccgaacttccgaagcggcggcggcggcggcggcgttggagtggtcggtggcggcgatgggaggggtgggatgaactggaaatgggctgctcccgtcgattagtttgccgctttaacggagacagagcccagaggggcgagaaagttctaatcgcatcccggtgtttggcacattggcttgctgaacaagccggttagttacggttatcaccatctaacctccctacagtgcggtgatttttttttcactaagggatgtacagtggtgtttaataacaggctcttttcgttgtcatgtaagtaaatttggtgacgtggaagaaagagaaggaaggaatgagaaacatcgttgctacgcatgacaacggctcagagtcgactctttgcatttattaacagaaagtttgttgcatgagggtatagaaaaggaaagaagtataataaaaaaatatttagtgtattaatggtttagaaatcttattatctctattattatagaaggatagtctctagtgatattaattaatatagagaactcatattagtctctacctttgtacatgttctaagccatgtggttataagatctgacggtaattattcgttaatctcatgttttttggggaaaaaatggtttaaaactagagcattactcggcaccgatgtatattgcaaagctgttgatcgaggaggattcaccaaaccgcaccgatgtatcaatttttgcagtaatctaaatgtcatacattagtatactcacttaattactctaatcagtagcagtaactcgaactctcgaaggtggataaaaggtaaaaattattactagcgaatccaaatctacccgtcggggcccacatctggtggctgccgacgaactggataccatatcccatccgcagtcgccggcggactgtaagaattgccgaatcggtggcgattgtgagggggaataagttcactggaggtccctcaacttaacagcgagattttttgagttcccttaaccataaaatcagaaatcttgactcctaaactatacaaaacgaccgttcagtcaaagtccgtaggcagtatatataggacgtggcactagttagcaatttttttaaaaaaagtacatgggacccacatgccagctgcacgtttttttcttctccttctcttcctttttctctcttccctcttcccttattcagtgaggaggccggcggcgggcggagcggcgatggcggcgtgcttccgctgcgcgccgtccgtgacggcagcgtccgtccccgcggggcccagccatcttcctcccgacgggacggcgttgtccttcgccgtgcacgacgccgtgaccgcctcgacggcgaggatctcctcctccgccatgctgcagggcacctggccgacgaacagccgcaccctctcgccgtcgctatcctccgcatctccgaccatcaccgtgatctctctctctctctcccgtctcttttccttttctgatggctatgcaacctcctgtccgtcctctcctcgttcttgcctgcgtcttttgcctttctatatcggacgagcactaaccactgattgattgattgatcagtatcagtgtcttgagtacaagttaattaatcgatgagtagtaccaagtcttgatctcgagtagcagtgaatgtttttttttacggaaagtagcagtgaatgtgatcgaatcatctgattgagcgaaaagcagcagcagcattgatgcctccacctcgccgtccagtgtgacaacaatgtcgtgctcagcgccggactccaggaaccacgccctcgtggaccagcacccacacccgacgaggagacacttggccttccgcgtccgtccctgactcctctggcggcagcgcgggacgaggcggttccgcgccgccggcgaccgccgcgtcgacctggcgtgggacctcacctgcacgcgcttcccaggcttgggttcacccgagccttcccgtggtgccgccccacagacgcagcaattgtgcggctggaacagcggcgccggcctcttctcctcctcttcctcctccggtgagtatagatggacggactacgtcgatgttgtgcgtgcatgcatgctgcaatcttggcgtctcaatttcatgcatggatcttacgaaggtcgggggaggacggcgatgatggcgtgcctcgacgtcgagatgccattcctgcgggggatcgacgtgaactggccggcgccagcgggggagacgacgacggtgcgggggcggggggggaggggggcagctgcagcgaggaggacgaggagcccggcgcgacctcccccaacattacggcacactctccagccggcaacaacgacgaggactccggcggtggcggcggatctcgtgtaccgcagccggggcagggatgggagcagcagcagcagcagcaggagggagaagagaagagagaagagagaaaggagaagaaaagagatgaaaataagatatgcagctgacatgtgggctccacgtgctttatttaatttttttttctgactagaatgccacgtcagcgaaaccacccatatatactacctagggaccttgagtgaacggttttgtatagtttaggggtggagatttctggttttgtggttaagggaccttgaaaaatctcgatgttaagttgagggatctctggtgaacttattccttatgaggggggcgcctgcgaggaagacgatgccatagctggctgggccaggctgcctgggccatatcgcataaaggtgtaaccaataagttcacttagggtccctcaatttattgtcgagtctaatatttatccctagacaaaaacactgaagtatagctcattccccaactcacagtacaatgttaactttggttccttggtagtataatggccggttttagctgacgtggtgggtggaatccacgtgggtctcacatgtcagcggccaactcttctccctcctctctctctccctctctccccttcttccctcccttctccatgagggtgaagagctccgggcaggagggaatcgagggactcctcggcacgtgtgctcttgcagcttggcggtgcgggcgtggaggccggtgtccgagagcgtggagacctcgggttccatggagttgttacgcgccacggtgtcggcatacctcttccacgccgtttttctgtcgccacccccagccccaccgaacatgcatcctagcacgcccccagccctgcgtgcacgacgacgcaatccccacccagccgctgcggccctggaggctctgtcttccacgctgaaggcagcagccgaaggcaccaccgaggtcgggggagaagaagatgatgaagatgaagcgtgagaagtaggggtggaaacttaggtctcgattggtattcggtttttcgattaattcggtcattgaaaagtgaagactgaatttcaacataaaaatatcaggaatggtaaattcggtctcagtttcagtttggtatttatccggttttgggcgggcggggttgctgcttgctgctcgttgcttgacagtttccgacgatctcaatggtttaaccttgttcaattatacaagtggaatttcaatttaatgtttactccctccgtttcaggttataagatgttttgactttacttcgagtttgaccaagttatagaaaaaaaatagtaatattttttacccaagataaatttattataaaaatatattgaattattaatttaattaaactaatttgataatgtaaatattactatatttgtttataaacttagtcaaacttaaagcattttaactttgaccaaagtcaaaatatcttataatctgaaatggaggggtacaagtattcatgataaaatcaaaactctattgctagtacgtatatttctaatcctaatcctagtagaatgcgattagagtcaacacacggtatctcggatgggagagtcgcttatttggttcatcgatctttccgtgtgttctcgacgtgttccccggacaggacgtaccgtattctcatcaatatactatacaggcgaaaatctgcaggtgagagaggttgtcaaatttcttttctgcttttcttttactattctctctctctctttcgcttgatattcccaaactatatatatacacaacataatgacatgcatctaggaccaaattaaactcatcgcatggaggggcaacatgaaaacgagttacaggaaagacaagcaaatcgccccaagcggaggagacggcggctgccgtggtggtactcggttcagatcgacacgaaacggcgaataggcagaagaaccaggctactcctgagagaaaactgcggcctctactcgatatgccagggtaggtacttaaaattcacacgcctgggctcccatcgctctctcgtcattcgagcgaaggaactgcaatcctcctactaccaccgcgtcctcgaggctgggatggagagctgggaggagtacaccgtgcaggacagggaggaggtccgggcgctgatagacgagatcgtcgagctctaccggagatcgattcccaggccgccgcacgacgtggttcgcgaacgtcgacgacgtgggcatcgtcggatcgtcgtgtcgacgacgacgttcgccgccgcagttgcatgccgtcgtcgtcgtcctgcgtgtttgtggggggcgctgtgtttctcattgttcttatggggtggatctttgggcatgtgtttcttcttgtttttttctcgtggatcttaagctttgtttgtttcaactcaaggtttcactaggttattgtaatctaatataaaccagattactataagctggattataataagttatgagttttttctctagattattgggtttgaaaagctaatgtctataataccctaagctattgcggagtgggaggaggatgagagacggcggcggcatggcttgggaaggagccggagtgtagggtgggagcttagggaaggatttgcacgcgactagggagagagaaagcagatgcacgtgcggccgagggagattcgcgcgcgactggagagagaggaagcggatgcgctcaacctgataggttcgatggtagtggtggataatttgcataaaatttttaagggtagtgggtctttagccggacaataatatgaaaaaaaaacgtttagatgagactaccagattatactaatctggtttataaattataataatctatcataataatccacttatttgcttcatattattactaataatccaaatcctatcttattatatagttgatgtccactaactactaaagcttaacatgtaactgttccacgtcatcatccactagcaattattatctagagtattttaaatcacatgcaagtgtaccatatcatcacccattagcaattattatttagagtattttaaatatcatgcaaacatgacatatcaattataattttgttgtatttttagaactcaatatgcaagcaatattaaatcgttatatatctctacaccatttttacattattgaaacatatacatctaccatttcactccataaatcatgggattagctaaaaagctgtcgagtattttttaggaaaaactttcgaatctaactacattatataatttcattagaactatactataataataataacttgtatatatgtattaaaacaatatatgcaactttatatcttatatagagataacaatttagttatagtgtagttacactatacttacaatataagtatataacaatagtataactacaatgtagttagcatgtaactagaatgtaacttagatgtaacttgaacaaatctgccataaacatgtgatgatgagactagcttgtgaaaaagagggtttagatctgatagcaaaatatctcagcacaaatcttagcgcggaatcaacgaccaaaaaattgacagttttcaggattgaaaactatcgacagttagctagcaaaaccgtaaatcatatatacatgcattaatccacatatcccgcaacaaaacgcggggtatcaactaataattataataattctaagctgaaacaaatagagcatcagtctttgtcaactattgtttcggtgatcctaaaacaaaagttgtatgtgttccttaaacgacggtgttcagggtttttttttggcttgatgcgacctatcatggcacaaattaaaatatgaggtggtttattttatatccggagatcataaaatgtttgtcacgctaggtcatttaaggggtgtttgggagagaggggctaaatttgagatcagggacttttggttttgagcaagtttaatagtatagccaactactagctttaattcatttatagtcaatctaatagcttttttttcggggaatctaatagcttattcatacaatagttacatactacactaataatacctggccccacctgtcatacacacactgcgtcttggagtccgtgctatagctggctataaatctgtagcccgctgctcttctctctgctcatttatctgtttaaaatatatttgcagctggcttatagcatgctattgtacctgctcttacggtcgcttggctggcatgttttgagggggaaaaccgttacgaggttgggccgcgcgcggccggcgtaccggcgtctggaagccgctgtgtgcttttaccgtacaacaatcgccgcgcagccacacaagcacgctttttagctagtacaccggcccgtgcgaacgaatcgctctgtaaactcgcatacacgaaaacatggacacattttccaggtgcagacaagttaggctgagccttttgggctagaaaaaaaaaaaaggacatcccggcacaaaccgtgccttctcagccgctcacgacgcggccacgcccaagcgttttcacccgagccggaccaacctggctctggctggtataatacgcggtttcagatcctgatgaggcagcgacgacggcgacgcaggaggtgcacacaggctcctcgactcgtgaggcgaactctccctcggcatcgctacgtgaaggtaattaacacgcgcgctggggctccctcccacgcgcatcgccctcaccgtgcgcgccgatgagctatggctaccgcgacgtacgtcccgtcctcgtggacaaaggccgggatcgaggagtacacaccgagcgggacaggggagtacacaccgagcgggacaggggaggaggtgcagcatcgtacgtggagatcatcgtctgtggtccgactcggagatcgtccatggccaaagccaccgccggacgccgtcgttcgcgaacgtacgtcgtcgacgtgagcagcgtcgggttgccgacgttcgagggagctcctccgtgtggtctcgcgtgtttggggggggtgggtgctcttaattcgacttcaatataatcgtagacggtggtgttgcgagtgaaattcgaatttaaggattgcacgtttgcacccttcgattagcttgcctccatttttacagatttacagggtcatttttatcaggaaaata

SEQ ID NO: 46597 - DNA, 1753 bp, Oryza sativa
gaagtcatagagtgtattccgttccacaactaccccctccttaacagccttctttaccaaattctggtacctaaatatattgaaaagattatcaaatgaaggcccataaataattttaggattgactgtaaaagatgatgaagaccaaccagctccgaagcttgtcagactttggcatcttctgtattgtaggatgacaatataaaacataatcgtcacgctttgtagatgggcaagtccatatggaacagcttacaaaccctcgtttcttgcagaaatccaagtagccaatctgggggaaaacagattggaagataatcagaccaacatgagatccataaactgaaatcaagatcaagaacactaagtgtttaatgattatgcattctcataccaaaatttcatgatacacaaaggtacggagagcttctccactggccgacttgatttccggtctgaagtacttgacagaatcaatatatgcaagataaacgtgcctttgatttggtgatgggcaggctgaaccatactcttgcacatacatggcgaacaggcatacatctacaccttcattcttttgaaacaagagaatggcctgcacaagcacaaaacacggaaatggtaacccacattatccactaaataatgaaagcataatttaaatggatgttataataatagcattagtaaagtataagtatcacataatcacctttgatttgtacggaaattccccaggatattgttcttttttaaaaaaatccttgaaacgtggttggacttgcagtgttctatcagctgaagataccactctaacagtaagaccttcaactcctggtacctaataattggaccataaaagttcgcccaataagtttctccagtatattacagtgtaataaaaatcctagaggcagaaaaataacattaagatcagcatagatgatcagataagactaagcaaagcatccacaagtttatgttccaagtttgaccatgaattgtaatatgacatcttggtcagctaaatcagatgaatatgcagaaccaacttttatcggaatccaataaaatgcaaggaaaaagaagaaaaaagtagtttcactaaaaaggatactgaaacgcaacaaatatatggtcatcaacatgtgttccaaagatgaattcatgtgtaatcagctgcaatcctgaagccataaatacacattgctagatgcaccaagagaagtattaagaacatgattaagtgaaatgccatcagtacattgtaaaaaataaaaagaaacgtatgacagtaaagatgcattcatgtaatgaattatctaagtcaacttagaagactataatataaggactaacatgttacttgtaaccttcaatccagcacatagagcaagaagcacaaaaatgcaattggaaagacgtatgtaacttttggctgtggttcaataggttaacagtgaggtagcctgttcaacggtagcagaatgcaacaccagcatattctgtacacgggacaaggtataaaagaaaagcataacacaactacctcatcaacactttttccagaagcaattgccctctgttgccgctcctgcacaagccgctcagaaagcctttgctcaatatgatcacttagtctagttcttggtaactcgcgtgctcccagaatagtagatggctcaagtgaatcaacatcttcattatccttttccttcaagaaacattttgcacaagtatattcgggctgcag

SEQ ID NO: 46598 - DNA, 14134 bp, Oryza sativa
  unsure (1)..(14134): unsure at all n locations
caataaatgataggtaagtagaggttaccatcaagctacagcaaataatacttgactacaaatagattgcaagtaagactaataacgttccaacaatcctaagatgacacgtaatgctttaataaataacacaaaatctaagaataaaagcaaaacaccttgccatcaatttacacttaaactggtggagcaattatattcaaccattatattagatctatctaagtaatcccttgctcctaaaaacaattaatccctccctatatacgtacatacacaagagatgtaaaaaaagagagtgtatctaccatttgccctgtatggtaggtttttttcagcgttagctcctagcgatgttatcaaggaagccatgtcatcctggcaccacttgacaccaccccgtcaattttcatgaatgtatttttttactaacgactatgtaaaaaccagttgggtgctcatataaacgcctatgcataaccatcttatgaatacacatacaaacattatctcctacaagaggaaaatatttgtaaaaaaaaccaagaaaaattatatagatccgagagactactatatattcaccatgaaaaacatacatatgtgcgtgcgtacgtacgtacatacatacatgcttacgatcgaaaatagcacgtggaaccacattatatccctttataattatgccaatatcatcttaataatgttaataactagcataaacaattttgacaatataaattattctttcgtatattacccatgaaaatgcagaagtgattagatgcataataaaagaaaaaacaaaacacatattagctcgtatgtttgtgaaggatgatgataataaagtgatatttgtttaaatataatagacattatcatatagtatatcaaagtttatggtctattttacggaataaatattttttttattctaggtaatgattcttatagtgaatatggtgagatatcttttagtattctttttataaacagtaagtgaattgcgcgggcttccttgatgcgcgggcttccttcctagtttatgtaaaaaaaataaacaatgaaaattcaattaaaaaggaaaaattccatactttaatttcaacttattttgttaaaattatttccgaaacaaaataatatgtatacccgcgcgaatgtgcgggctaccttcctacttatactataaattttgttaataaatttccaatacacactctatatataagagaattagcaacttttgttttatatttccaatacacactactagtttctgttaaaacaacaataaaacgagaaagaatcatattatacccaccagcattgtttttttttactgccaacttttattctagcaaaatctgttagaaatgtcttgaaaaaaatgatcattatcacgccaataaatcctagcattattattgtgcatattagcctcaaattcgataagtacttgatcgttctacagcgcaacagttgatgtaaggccaaggtgaaagtcagattacgctgctgatcgagatcacctacatggtgatgatgatatgcatttcttgattaaaggatatagctttatttcatcaagtgaaaggtatagtaatatatagctagctatgtgtaaatgtttcctaatcagtctgttgatgagaacgacatgcgaaagctagctagcagcctaggtagtacaatgaaaatcatataccggctactgcaaatcgcctgcatttcaccgtggttcgttggggcctaggccctagaggccggtgattcagaaccgataagctaacaatagacgatcgacatacgaaagcgcttatattactccgtacctgaaaacttctccacgctgtttgacaattcgcgtgcacagtttccgttttacatatcgttgaaaccccctctcacgcccggcgccgcccgcccggccggcagcgccagctgaggcgtagacttcacctggaaaaaaaaattcccgtggagtcgtggacggacgacgacgcgcgccgccgtaaaccccgacctgccgccccggccacgtacgacgcgcgcaagcgaccgtgcaggtaacgccaaaatacaatcaacccagagccggtggatttttgccgtcgctcgcgtacgacgcgtgggccggctgcgcgcggcgaggaggatcgatcgaagactccacggccgtatggcgaccgcgtcaaataacgaactgtcacgtaacaggcggtaccgtaccatcgcgaggccggccgcagcgccgactgagactccgacggcttccgtgtcaaattcgggtgcgccccacaacgccgagctccccatgatttctcccgcatccgcacggcggcgccccacatttttcccgtgcgtcgccgcgtgccaggggaaaaagcccggaacgacttatcagatactccctccatctacttttaataataatatttcatcttgacacacagaccaagaataagtaattctacttatcatttatttaaacatgctactagtcattcctcgtaaacaagcgattcaataatatttacatttctcaaagcccatgtagctaatcatgtgtggaagaatggagagtcacgcattaaattcgagaaaatcattaagatggtaggttgttggattgaaatatgactatcaaaaataaaattttcagatttagaaatatgactatcaaaaatagatagagggagtaataactcaaccactcaactgagagctgacctgaccagtgcggtgcggcagtgcctagtagtacgtagtaccatcacttcttctacgtctcacgagcttatacaagtactctgcgttatatgtgtgtgtgtgtgtgtgtgtatatatatatatatatatatatatatatatatatatatatatatatatatatatgtgtgtgtgtatgtatgtatatatatatggcccatgccgatgtggaacacagtcaatacaggaattaacatatcccgtgttcaaagccaacgtatgcgtaacgttgtcagtatatgcacagtccaacggaagaccggtaatagtacaaatacgtgacgggccaggctaggctagctagctaagctgctggaaactgactgggtctacgctggggtctcctctaaaaaaaaaattacggttcacagatatcgcattcacatcccagagccggcccgggcctggccgtgactttgtttgaaaaggccaatgagaagaaagcgaaacaaaacaagcgatgaaatttaagtgttagatgaaaaacaatctgaggatatgaacaaacacgtagaaaagagggatctagtaagctgtcattgtttcttttgttttgttgctttgacaagtgtacataattctcaggaagatgctattattatacttattattgtactgattattacttactgcgaagtatcaacagctgtttttgcggtagaaaaagaactaagaaaaagcaatgaattaatacaactttttgctgctgcaaaaccaggaaagtggagaagaaaaaagaaagtgtataccatgtgcccactgcacagctcggccgagctatcgaaaccaaaggagagaaatcaagaacctatcctgaacaaagaagagtaaaaacttggaaatctatgtgaaaattactgatccgaactcgtttttactgcgtctcgctgttggtgttgttgctcgtcgtgttgttgctgcttgtgttgttggtgttgctcgtggtgttggtgttggtgttgttcgcgttgctgttgccagctgccgccgcgtgctggccgcctatgatggacgtgatcgccgccgcgagcgccaccgtgaagttggggtcagcggtgatcgccgccgccgccgcgctgacggtgtcggagagagggccaggcagctgcccgatcggcggcctcggttgcgcgaactgcgcggcggcggcggcggcggcggcggcctcggctgaatcggaggacatctgcaggccggagaacttggactggttgtacagcacctgcggcggcacggcgaacgccggcgccatccctccgcctggcagcggcacctggaactgcggcgccggcgcgcccggccgcgcggcgttgagcggcacggcgttcggcgcgcccggcggcgcgtgggtgaggtcgagcgtgaccgtcgggaacggggccgacgccgagatggtggccatgctggacgagcacggcagcacggtgcgcgccaggaagttggagctcatgagccccgcggcgccgtcggcgctcggcatggaccccgacagaagcatcgacgccgccgccgacgtggtggacgccatcgccatcgcggccggcggcagcgggtggttgtgcgtgccctcgtacgtggtgatcaggatggaccggtcctccgcgcaccgttgcacctgttggtcaattccgtcacgttcacaaagttagaccaatcaaacaacaccccttgcctacacggtagcactgctactcccagcccttcgtactctctacttctgagttttgacccgtatctcagtgagtcgtcgtgtccggtcattacctgcttccgcaccgggcagccggtggccatggtgcagcggtagtacgcgcgtggacaagggtttcccttcgccatcttctgaccgtacttcctccattggcacccatcggcgatctgcacggaaccaaaacgatttggaattcagcacgtctcgatgagaaaatgcctgtgatcgatgtggttgctagtggtggggtcttacgattggcgcttcggatcgcgcgcgaacggagacgcgggccttcctcatgttggcatcctgggcttgctgatcatggctcttgcccgccgcgccggcggcgcccatctgcggcgccatggcgcgtcccggcaaccacgccgccgccgtcgacggcgcgtccgggctgtcaccacgttcttggtccttgttgccggtagacgacgaccgacgcgggctgccggcctccgtcgacgagttggacggctcctccgccgcctcgccgccggcgccggaggacgggcccagatcgaggaattgcctcggcacgaccgcgccctcggccttgccatcctgaaacacacaccaaagtgggaaacccggttatttccactccaggtagctgtgtaatactactactaataactgtggtaatatagggtggttttacactaattattttacctggtgaggcggaggtggctccggctgggtcggaggctgcatcatttgaggcctttgctgcatgagcgcgacgagatgcatctgcagcgcctggtagctggtggtcacctgggtcagcatcccccggagccgctggttctcctcgttcatgcggcccagctccgcctgcatcgccgcgagctgcaaaacatcacacgagagagcgtaaatatcgagcgatccatccatgaccaccggtcggggtcagctcgggtcagatccaccatgctcgccgctgagctagcacggtcagggtcaaccccgtcgaataatcgagatcgcgatgacgatgaattttagttagctaagctgtatgtatcgatcaaccggccctgccgggctagctacctacctcgttgctgctccggctcttctcctcgtgatccggccgcgacgccgcgtcgtcgtcgaccaccatcgaccggtcgctcctcgcgttgttcccggcgggaagaagctgcaacgaacacggacgagcacacgcgttagatcgccgtgagttaaacaggtgtctggcgatcgacgagcgaagaaggcggcggcggctaacgttaatggtgaggtcctccttcttgatggcgaggccggcggcggcgggtcccttggcgtcgtccgcctcggcggcgacgccgcccgagacacggctcttcttcatgttcttcttctcgtcggagaagaagtccacctcgacggacctgcgtgccctgccgccgccaccgccgctgtcgtcggcctccatggtcgacctgtggaacggcggcggggagagcaggttcaagaagccgagcgggcgcggcgacgcgtccagagcgagcagcccacctcctcctcctccgccaccaccgaggtggcccttgtccatgcaactggagctcctactcctcttgtccttcttcccggaggcggagaagatagagaagagaagacgacgtggtagggagagagagataattaggggggagaagagagtgggagagtctgaagtctctcaccggtgggaggaggctcgtataaaaaagggaagcaccctcgactctgacatcaggagctgcgtcagtggcgaggcgcacacgtggcgagtccccattggccgacccgggagtcgacgacgactcgagcctggtgccgaggcgaccggatcgtcctttccggcgaggcgcggagacggctcgtttacgtgcgtgtctccactttagctttccgccttttctcttccggatcagaatcccaactcgttaagaaagcgtgagattttttttttccgtggagcggaaagcgaccgacggctcccgtcgtcgcaacgccaaattaaccaaagcgaggccccccgcaacggcgactcccaccccgcgccggtctaccggttttcaacatccatcatccatccatccaccgttgcgctgtcactcgcccacaccacgtagcttgatgaaagaggttttgtgtacatttgcacgggcagatggacggtgcaccgtacacgtccactccgccgctcgacgtgtcgatcgatcgccactactacggttatctcggattcgatctccggcggtacgagcgccgatgcaggtgtgcaatagggaagaaatattgaggtcagcatgtactgcacgaggggcgttttttttttccacggtcagaaggttccttccgtagattacttgccccccaaccgagaaaagagaaagaaacgcaggtctggattggtcagagacgagttcgggaggatcgtgcctgtgattgatcggctacagctacagggtcgcgagtccacacagcggactcggatcttaccctttctttattgccgctactaaaaactttctgagatcttctatggccaggctgggcccaccagtttaacgtataaataaatttgtttctttgtgtattttgctctgagttcgaggagggttagggtttgggtcaatgggtgcagggaccagttcttccaccgttccacgaaacctccgctcccgattgggccgccgggccgatccacgtggagaaaacgtcaacgcccttgactcccgcggcccccaccgcccaaaacccccccgggcccacaccccgagatgcaagtacgtgacacgcagcctctttttttcttttttcttttttctttcttcttcgcgtcgttttcggataagactgtcactagttgcatacttgcatgtcgaactgcaaataagcagggggatatatatacagtgggagaactggagaaatattatgttgtgggaacggtccaagatgcgatcgctggtgttttgttaatacacgaatctagctaaaagttggctcctgcctttttgataattgggataaagtcggtgtatgcatggcatatcagcatatgcttggacaatattggcatgtgtgaactttgagtttgtagggtaagtagcccacaaaagtttctctactttttagaaattaattgtttttgttggagagtggaggaattatataagacacatgcttgaaagagaggttgcaatttctctctcgagtccggaagaaattggtcctaatctggttgagttaatttcaacacgatgatagcacaaagtccaaaaggcaaggcaacgctatttcacatgtgcctatctacttatgctggattgttccaaatgggtaccatataaaagttttaaacagctactagttgtctaatgcaagttgcatactcaaacacactgtaaactaaaggtgtcgtgggaggtagaattgttctttagctgagaagtgatatcagagccgaagagttgaaaaccaagaacatctatattcaagattgcacgatcatgcacgagacatatgaatcaatatgatgggagagattggtgagattaatcccacactgatttttatttaatgtagttctatttgtctccagtaagtcgttataattggtttgtatgtgtgtgtcgtatgtccggcgaagttctggaataaaaccatttccactatctaaataggtaattctaataatgatagtaattttctttcaagaaaaatctagttgtctcatatttaattaaaaaattgataagttattgacgatcgaaattttagaagtttaactaaatattgtcctaagcatcagatatattttagtagagtagtagtagtagtagtattttcttaggctgtgttcgggagtgagggttgtgtgcacgcaaaacgaaatagtgtttagcacataattaattaaatattagctaaaataaatttaaaaaatagactaatatgttttttaaaataactttcatataagatttttttaaaaaaaacacaccatttagcaatttgaaaagcgtgcgcacggaaaacgagagaaatgagttgggaaagtgttaggctgtgttcgatacatggggttgggaacccatctccttcgcacgaaaaacggagcggtccattagcgcgtgattaattaagtattagctatttttaaaaaaatagattaatttgatttttttaagcaactttcgtatataattgttttttaaaaaaaaacgcaccgtttagcagtttgaaaagcgtgcacgtggaaaacgagagacaggggttgggaacaccctaaaacgaacgcagcctaaaagagaatatcaagatttattgaatatttagtccctcctggttaaattttacatgttatccatgtttccagttggttggatgattttttttttcgaacggtaatgttgttgccgatattttatattaagaagaatgtgtctcattttaagagggttggaagactacttgtttatatacaggttagagctaattctagcctatttgattggtttttttaaaaaaaaatcgtgagttcattcttattgttgaaaaaaagaacatcgtggttgattgactttttttagttaaggcttatctgaactgtgtagaccatagaaatttcaacgaaaataattttctcaggactacaatagtaaaataccctccttgaatcggtgaagatggaaggcatagaaatttcaacaaaaaataatttttctcaggacttcaaaaaaaaaattagcccactgaatcggtgaagatgggcgacaaagtggaggccgccggcgtgcatgacccgcgagtatacgtaaatacagtggcgtgcgacgagtcgacgacgtacccacacgccgagtccgcgacacgacgcccggtccgacaccccgccagcggccagccagtcccaagtcccaaccgactgggacccgggagggagttagagcactactagctctaatttttctatagctaatctaatagccaattcatacaataattgcttactatactactccctccgttttaaaatgtttgacaacgttgactttttagcacatatttgaccgttcgtcttattcaaaaaaattgtgaaatatgtaaaactaaatgtgtacatgaaaatatatttaacaataaatcaaatgatacaaagagaataaataattacttaaattttttaaataagacaaatggttaaacacgtactaaaaagtcaacggtgtcaaacattttgaaacggagggagtattactatatggtctcacctgtcatacacacactacgtcttgaagtccgtgctaaagctggcaatagattaatagaaggttgatattttgtaaaagtttgaatctaattaaaatatgtttacagaggagtaatagacagatattatataagacattagaaattgagagtaaagtatgtcacataaatgaaaaggagcgtatgagtagacaggctgagtgactaccaacaagggacaagaagaaatgtgaaaaagagaaaggagagaaactgtagaaaatgacaggttcaatgcgtattggcgtgtgttggataagtgtatattatggggcgagaaagtaggcaacacgcgtaatatttaatagtgagaaaacggngaaactcccccccccccccccccttgggaacaagttggaagcaagttcaacccccccaaccgtcaagccggccaccggaagttgaccgcgcgctcgatcggatccgcccccgcagccggtgcgccgcgctagcatgcgacgaatccgagcgctctccttgccgccgtcgcgtcgcgtgggcgtggacaccgtcgacgcggtgtccaacgaaccaggcgcgcgaagcgatgggagcacgagggcggacggacggacgtacgggcgggccgggttttacaagatcctagaccctaggatcggtagcttctagagagaatcactgtgcgatcgagtcatggaccggccggcatgggcaagtgagcaactgatgattctttccggtttctacacgagcggccccccggtccacgtctcctctaccggccaaaaggcgcgtctcggcctcccacctctgtagtctttctttgacctcaactgattagtagcagggggtgttttagatctatggtgtaaagttttagcgtgtcacatcgaatatacagacacgtttaaagtattaaatatagactaataataaaacgaattacagatttcgcctgtaaacttcgagacgaatttattatatctaattaatccatcattagcaaatgtttactattgcactacattgttaaatcatggagtaattaggtttaaaatatttgtctcacaatttacacgtaatctgtgcaattagttatttttttcgtttatatttagtattccatacacatgtctaaacattcgatgtgacgaggtaaaaattttgggaaggcatatgccctcgattgcgcagggaaagagcgcacatgcgtgcacgctgcatgccccggtttcggagcaccggtcgtcgttgcgttgagtttgcctggggatcaaggaacggcaaaatcactcatttcaggttgcatctgaagttctgaacgatcttatctgagcttctgagagacttggttttacagagaagagtggtaaattacgagagaagcgtgtgtaactggaggatcagtcaactgccaccgaaatgggcaactatgtgcaactgcatttcgggatggtaggctgcccagtcgcgtgcgtaactgtccaaggctccacttgcatgcatgggacggggatcgtcgaacgcgcacgctgttcggtgttaggtctaagtgagtcacgatcataaaacgactcagaaaatacagttatgtctagatagcggagaaaatgcaatgagctgttgtgtacctttacgtccatgcgccgatgcacggtcggtctcatcttcagtttagtgcaagggaagaaaaatccggttatctacaaactaccctattcgagtagtatataattcctttctgaaattcttgtattccaaatgactcgttgttgtttagcttctgctcctccgagtgggaaagaactagctttaacccgctgacgattgtggaatttagaaacgcagcttaattatatatttaaaccgaacaaaaacaagcgatcaagttcaaaccacgtaccaaccgtggaggattagttatatatattcttccgagttctgacgccggagtagtactgcacggaccgatcgatcgatcgatcgaccgtcttgggcgacttaattacccgcagaattgatccttctttgacttaacctggccgccaacgtagaagatctcaagatgaagcaatcaatggaggagctggtcaatgggggtttcattattacctccccctgatacggattaactggcgtgattaacttgatcgatcggtcgatcgacgcgtgatgattccatggaggacacaaatgtcagcgtaaacaaaccggtcgcccgttgacaaaagaaaggtttccacgtacgtacgtgccaattgtcaccgtgaccacgtacgcatgtgtagcaacgacctagctaagattagtttgtttactggagtagtagtgcattgtccaggctacaggtacacatctggaattatgtgtgtatttttttttaacgtaacgccgccttctccctcgtctgttcacatttctagctagctagtttggtttcttcaacgagattttcacgagtgtgctgacgaattaagctagcatgtggtgtgctgtcacgttcttgcacggtttttgtgtgcagcacttgttgcctcgttggttagttccctgccgtacgtttagtataagcaaaatcaacactgcaatttggatgggagcagcttttatttgtcgggagatgcatcggggatctggccgatgatttcatcgagggaaatatcatatatatttttatgtaaaatttagtatcgtcaattatagttatgtcaagtgtataattttttctttaaggaccataaaatttctcttttatccaacaacatttattggcaacttgttcgagtttataaagaggtggtagatgcatattaagaattcctgcaaaaggcgtattgtaacatttcggaacttctctgcatctaaaaaaatgtttagtatacggggagtcatttagtggatgagggaaaaaaaagtgatcgtattattagctctactccaaaaccttaaaaaaaatcatatggaatagtaatatatagtacaaatataaactaatatgaagcatttgtccgaggattttttttttcttttcaaaagagagccaggggttcatgtagaatcaaaaaatctcaaaaatcctcattttgttttccccagagaaaattactgtaggggtccattgagcatatcgtacaaatatattcctcttctctcggatattaatcgcctcttttttagaccagctattggacttagactgagaaaactgtatatataatacatagcactgattaaaaataactttatttattgattttgcacataccattcgaggatagcaccctcaacgttcgcattttctcgaacaaatgaaattatgattcaaggtgcagctcaatggtttagccccttgttttggaataatgcacgactcatttacggcacatgaacttcataagtaacctacattcactactgttgactttttagacgtagcaaaaataccgcgaaactactactcttatattatcttcagtttttaatagatgacacaattaattttttaatacatgtataaccattcgtcttaataaaaatacataatttttattttgttgtgacttggtttatcattagcttaatttacactctcatatttgcacattttttatacggcgaatgattaaatgtgtgtgaaaaaatcaataatattatctatttaaaaacggaggaaatataagtctcaacaagtttcaaatgaaaacatgttccgggacggctggactatatatgtaagcaaaaacaaaagtttacccgtattataaagcaggagttttcaaaggagctggatttgttaaactcaaattgtaggtgaaatttcctgggtcggcaccactcatttccaaattccaatcgaccacaggaaaaatcaagaatgagaagaagggtcagagagggtagaacggtagaactgcccacgtcgtatcgcactatacggttggaaaatggaggcatcgccccctcgaagcggcatcccctgattggtggatctggtcttcatgtagtcacctggaacgcgacttccgcagctaatatatctactccttccatccaaagaaaacgagaaaccctgatttccgtgttcaatgttttaccgttcgtcttattttaaaaaaaatatgaaaaaattaaaaagacaaatcacacataaaatattaattatattttatcatctaacaataatgaaaatacgaattataaaaaaaatttataaagacggatagtcaaagttggacacgaaaattcagggtttgttttttagctgagggagtagtaattaacaaaattcgccgaaaacctctcccaatccatcatgcacgcacgtacgttctaacgtgtccccgt

SEQ ID NO: 46599 - DNA, 744 bp, Oryza sativa
ttcctgcagcccttttaaaaaataaattaatatgattttttaaaaacaactttcgtatgtaactttttttaaaattgtattgtttaatagtttaaaaatcgtgcgtacagaaaaacgggagaaaagtttgggtggtttcgacctttgaccagctagctgttagtctgttaatgcccacgccctgatcacaatgcgtgatagaatttctgacagacaacgacgcctatagaatacacaatgcgtgatagaatttcgcggctagcaggtcgtcgcacacccgacgaaaagtcccacaaaactgcacacgcatggtacgtacgtagaattagttagtactagtcagtaaggatcaggtttcccagaccgccggcggtaagcacgattatcacgcggtaaccgtaaaaaaccgtgtaaaatttatcaaaaattcaaattatttttcaaatttatttaaatttaagggggttatcgtggttttttattactgtaccccgcggtaagccggtaaccgatggtaatgtaaaccctggtaaggatagatcgagttgtactcggctcgagatcttctagaagttatagtgtactcacgagatctttcagatgtggtaagtttctggtgctgggtttaagttttcgcgtctacgcttacgcaaacgacaccacacgtacacacaccggccggcagaaaagtttatgagatttccatatatatatatatacagtacttgccaatctcggttggta

SEQ ID NO: 46600 - DNA, 705 bp, Oryza sativa
gtcattaattaattttaaattagtgataactaaatggtttctcttatattggccatcccttttcccatcagtaacaaaatgaactatctcatacattaatacatatcatattgttccaattgctattgctacagacctactatatccttcctaacaacaagttccccctgtcccctctagcattcttgctaaatgattggttgaactatggctgataagccgtagaaatataaaagaagaaaccaaaaatattttgaactttttgtctgtattattcatggtttaaaagccatgctggaaaatagactgcaatgaagaaaaacctcaaaatcacctataaaattatgtttcaaaattcaattttggctatggatgataaaccatcaagcagacaataagagttatttacaattgttgcattaaactacttgtgtcaggatgactcttcttctcgggcctccatcgtctggaaaaagcacacttatgcgagcactaaccggcaagcctgataaaaatctcaaggttttgatatttcttatttagtttaatgtagccacctctaacagtagagtcgtaccacatgactaatcactcgatggctacaggtgtctggcgagatcacatactgtggtcatacgtttaaagagttctatcctgagaggactagtgcttacgtcagtcagcatgatctgcacaatcctgaga

SEQ ID NO: 46601 - DNA, 975 bp, Oryza sativa
ccttgaatcggtgaagatggaaggcatagaaatttcaacaaaaaataatttttctcaggacttcaaaaaaaaaattagcccactgaatcggtgaagatgggcgacaaagtggaggccgccggcgtgcatgacccgcgagtatacgtaaatacagtggcgtgcgacgagtcgacgacgtacccacacgccgagtccgcgacacgacgcccggtccgacaccccgccagcggccagccagtcccaagtcccaaccgactgggacccgggagggagttagagcactactagctctaatttttctatagctaatctaatagccaattcatacaataattgcttactatactactccctccgttttaaaatgtttgacaacgttgactttttagcacatatttgaccgttcgtcttattcaaaaaaattgtgaaatatgtaaaactaaatgtgtacatgaaaatatatttaacaataaatcaaatgatacaaagagaataaataattacttaaattttttaaataagacaaatggttaaacacgtactaaaaagtcaacggtgtcaaacattttgaaacggagggagtattactatatggtctcacctgtcatacacacactacgtcttgaagtccgtgctacagctggctatagatttatagcccgttgctcttctctcttattttttatatctcattaaaatatgtttacagctggctaatagactgttattatatctgcccttagcaactccgcgttacgtacgtcccctccctgacaccgggcgcacgcgtcgaccggccgcgtccccacccaccagcgccccgaagaaatgtgctacaggaacaggagagaaaccgtaggagatgacaggctccatgcgtcgttgcgcgtgctggctgggcgtggattgcggcgccgggagagctaggccccacgcgtcatatttactcgtgcggaaacggcgaaactccccccc

SEQ ID NO: 46602 - DNA, 4383 bp, Oryza sativa
ggaaattccgagaaaattttcagaaagtttccgaccgattccgagttctgacagaaactgcccttatcattatcatttccgattccgtttccgagaaaatatttccgaatttgtttccgtttccaaaaaaaattccgaccgacagattccgttttcgaaaataggtccggaatccggaaagttttcgtaccgttttcacccctaggtagcgggcagatccaaggtcgagctctacggcagtggcgaggcctttgacccagtgacggcgacaacggcagatgtgctggtagaggaggctaattgggaaaaccatttattgtggaatttgtgctcattgatatatggatttgtattgtgatatgtttttgttcttagatttgctttgcaatgtggattgggaatacagggctactgcatctgaatattttcaattttttttcaaaacttctttgctggtggttagagagcaaatgcaatgcatattttcaattttttgaaccaaaataagcctcgcaggtggccggcttaatacatacgctagtgaaaattgattgtcactggcagcccacgtaacacgcacccgcaaaaatcgattattgtctgcggccacgtaacatagctaccatcgataatcaattgtcgctgatggttgaagagttgcttgtgaagaccttttattttctctggccttttgtcgcaggtggttagcctagtcgctagcaaaaattgattttagccgtcagaaaaaaaaccattttttaccgtgcacaaaaccttatttggaggagcccatggataaaattattttttactactgtacctcattttccacgcactactactaatactacgatttttttcagtcttgcagctcatgcaagggagcagaagcccaagaggccgaacaaaaccagcagcaaagacagcaacgcatcaaaccatttggcccaagtgtgacccgcatttcagcctctgacgcgtgatggtcagaaacgattgagataagttcactttaagtctctcgtcttaacaccgagtttgaattacatcatcgagccgtaataccaaatataaggtgtctctcaatttgtaaaacgatgtacctgaaatctcagacaatatagtgtccggttttagctaaagtgacgagtaggacccacgtggaccccacatgtcaaggctattcccaaaaaaatagaaaaaaaacaagtgaggcccacatgtaagcgagagaaaatggtgtgggccccacatctcttctttcttttctttttctcttctcttctctcagcgggcgtgcagtagcaggtgggggagaggcggccggcggtggagtggcaggcctgttcagctagcgtgagcatggacgtggccttgtcaggcacggtgagtagttgccacccggggacggtgagtagcgggcggtggcgcgggtggtgggctgccgcggtgaagttgatccaccgacgaggaggcacaacaccgagagcggcgatgtttggtcctcgtcggagtcaatggccggcaggcgcaacccgcgaggtttgtttcggtggcgacgaggcccgggaggcgaccgagagaggggattttcccattttggctcaatcatctcctctctcccgccgctgccgtccctagatttctagccccatacaggtgaatgggatggaatctaggcaccgttgctgatgttgttgctcctctactcgtggtgctcggtgacggcgtcaaggtacaacgggaaagggtgggactgggaggaggaggagtggcatccgaagaggggggaaagggcggttgtggcaaccatgtctgcaagccaagacccgcggagagagggttgttcgtgctggacgaggggcataaggtggtggagttgaagggtgtctagtagggtcgtgcctgtggtacgcggccgtgcccggcggtcgctgtcgtgccgacccgcggcaacgcgactggtagtggtcggcaacctttgggtgctgctgggagggactcgtgccccgtctcccgctgcctgtcgccagcaacctttgggtgctgctgcccgtcgcccgctgttcatcggccgtcgactcctctctccccctttcctcgtcgtcgtccctgcatgccgatcgggctgagggagtactccaggggaagcccttccaagttgcggcgacgacaatgtccgcgcggcgccggcggcactccaccaccggcacaccaagctatggtgggggcgggctcgaatgtggcggcggtgcgcgtggtcaaaacagctgtcgccggaagctagagtagtgggaggtagggcactactcccttcttttcttctcgcttacatgtgggcccgataaattttttaattttttttgactgactaggattcctcgttagcgaaactgcccatatatactgaatgagacctatttttcacaattttatataatttaggggtagagatttctgatattagatattagggaccttagacagactcgacgtaaagttgagttacgttaggcgaacttattcctttcctcatctctcgagtcctgggccacaatctgtgggaaggtctcagcgattaaggctcgtttggagcactggaaagatttgtgaatcctgacagaatcgaactgtctctaactattatcaaacttatgcaaaatcccaaaccaggcagtttttggtacacaaataatctgctcactatcatggcagctagcaaagtttgcttcctgtacttatacaatctttggtagctcgatcgccagaaaacaatcgccttaaacatcgatctgagaactggattgcgcaaaaacaacacttgagtgaaaaaaaaaagtcttcaactaactaaactaaggacctactatgtatatactgtatgaacacatgtatacagtacatgatattctgtacgtatacacgtgctaatcaaccgatcatgcagtagtgttcttggcttgctccagcagcttgacaacttcagccatggttggcctgttgcagggctcagactcgaggcacttgtctgccactttgaacaccagcttcacctcctccgccgggaacgacgactccagcgcgctgtcgaccgcgtgctcctccctcttctcctccatcgtctccttcacctgcacgtacacaccgattacccatgttggtatgttacaaacttaattaatcacgttattatcttgttttaatgattcgttgattaggcccaatagtagtacgtttgacagataattagtatacgcgtatttaattattcattgatcgtgcatgactttgtggtttgtagtacctggtgatgattggtcactgctaatgaatgatcagtctcagcaacaaaacactgtagatgatgtgtgtacgacatgaaatgaaatggatggaaagcttttaagttctgtttgacacggctctggatctaaaatcttttaaactgggtatttttaacttcacaaatatatgaattcgagtatgtgattacgttgataatatttagataaaatcattttgtttcattttaaatgaaatataagattttaaactttataacttaacaaacaaactttaaatctaacgcggatatagaatctggagctgtgtgatcttacccaggtcactagcctcgtgccgttctcaagaaacgactcgtccgtcggcctcatcccggtgaggagctccagcagcaccacgccgtagctgtacacgtcgcccttcgtcgtcgccctcccggtctcgaagtactctgggacgcacacaacatgttcgatcaaatgactgacagtggttcagagaagctggtgatgaggcgaggtgaggtgtggtggtcggacggagacggacctggggcgaggtagccgaaggtgccggcgacgacggtggtgacgtggctatggttgggcttcatgagcgtggcgaggccgaagtcggagaccctggcctccatgttgtggtcgaggaggatgttgctggacttgatgtcgcggtggatcacgtgcgggatgcagtcgtggtgcaggtacgcgagccccctcgccacccccgccgcgatcttgtgcctcgcctcccaccccagcgccctcctcgtctcctccttccctgcaaccacatcaagaactcaggatttccatggacaaaatcgccatagctgcttcgagttctgatgtgtatatgtaccgtggaggatggtgtcgaggctgccgttgggcatgagctcgtagatgaggaggttgaagtgcggggcggcgtagtacccgcagagcgggacgatgttgcggtgcttgatgtcgcccatggtgtccagctcgcgctggaacccccggtccatctcggcgctgccgcggctcagcttcttcaccgcgaacgggggtgcag

SEQ ID NO: 46603 - DNA, 1448 bp, Oryza sativa
  unsure (1)..(1448): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagcacaagcaaccttctgtggttgtttatttttctggataaaatggaagcattcaaaagctatgagggtgttgtcggttatcaagcggccaggaacaaaggcactttggctttggggtatgaggtcatccagtataggtctcaacctattcaccaagcacttagaaacattcttataaattatattgcacaaactaataggtcaaaaatccttcaactccactggattctctattttcaggataaggacaatcgttttgtcattgattccttcaggaagaacacttcttctgaaaaaaagacagcaccgcccttaccacatctttcaaaataccccaattacaatggtagaaatatcccgggaaaccgtctggacccggcactttcagaggcccaatctgaaacatggcagtagcaatttccgaagtcaattgtttgttcaaaaccatcattttgctataacattagctgggtgtaacgacaataatggcaaatgattttatcaaaatgatacaaccatatcctctatgcatttatcataggtgggcccaacttatacccgcataaatgttgcaggttgtcagtgtgttctcggtgttatagataaggtattcccaatacttttgggttaggctcggtgtggctcaccatataccaagttttatcactactacagatttcatttttgcatatggcccaaatcgatctttgcacacaaacgggcggcccgcatgcactcaaaggtctgcaaaaattaggatttttgcatgcagttagcgtaaccgcatgcaaaaaatccgattttcgcatgcgggtccttaagccgaccgcatgaaaaaacaaaaatcgtgaataaataaataaaattcccaaaaagaaaataacccagccccaccgccgccggtcgcccaatcccaaaccctagcccaaaggctggccgctcatcaccgctcacaaggtccgcccgctcccaccgccaccgctgtcatcgccggtcgtcgtcgtcgccgaggtcgccatcatcgtcgcaggatatggcagccgctgctagatctgtgcaaggggagagccaccgccgccaaatccaggtgggggaggggccgctgcccccagatccgtgcggtggatggcctccgccagtcgtcgtgggaaagggccccgtcgctcccggccaccacgtgaccgaggtcatattcgtcgcggggagggtgccgccactggatccgtgtgggggaagggtggccgtccccggatccacgcgggggagggccgccgtccccagatccacgtgggggaaggccgccatcgccgggcgcctcctccgctggactcctcgcgaggatg

SEQ ID NO: 46604 - DNA, 4537 bp, Oryza sativa
atatggaatcatgcctcatatattgaaggtgttccatatttactttttgtttaaatttttaatcttgattctaatgccacgtcaacgccacgtgggacgaggaccaaatcaaataatctacgtaggcgccacgtcaactaaaaccactgttcaaacctccttggggtcttatttgagatggtttttagagtcgagggacgtgttatatgtggtattttggtttaagggcgaataccaaatttgacgacaaattaagggagctaaagtgaacttactccctgtttgaagcagtgacgcaatggtgtataatttgggccttttggctatctgcccataggcccatggagactctttatgggctggatcggatggtgcctcggccataattaaggaggcacagtgtttcgaacgatttttcttcctataagcacatgcgcatgcgcccacctacatgtgagcatgtgtattgtcctgaatttatgtagtatttctaatcaaactagcaggcacaaattaagcaaatgatccatcatcatgtatttgctagtattacagttacagattatgatccaccctgttaatcttcctcctctgcttgctgatgccgcgttctatgtaaaacaaatcaaagattacagactagtatgattttgacgatccaataagcagatggattatatttgaactgaccgctgcagttccaatttacaaaacagaatgtaccacaaatgataataatgttttcattttcgacagcaaacagtcaattaggcctaaacaagttgctacgagctagtgatttgtcctaatgatcagtagcctattaatcgaagtccgatgaaatgacccctgcacacacctgagcttcttgattcgaaatataattacagccgttacgtgctcacatttaaaattagagggttgcatgtgcattcctagatacgaaaattaattggaattttggatttggatgggaggaaatatcagttgcaccatcgccgaagagattaattccaccaaaaccatatgtgtacgactctgcacgtttctttcccctaacaaatacatgtacacacaacaaactcttttggaaactactccatatatataaataggctatgttcattctaatgcccaagtgatggaagagagtatgacgaagcccacgacgatggccatttttctttctatagtgctactatccatggcacagcttccctctctcgtcgccggcaccggccggccaagggtcataatcatcggcgccggcatatccggtacgcacacaagtacttttaccgtcggtgatatctacgtcactcagtattctaagtttaccgtctacgtcactcatagtattctaagtgttactaatagaaatgatgttagctgtaatttatgaatttatatcacacatgttacatgttgttactcccttcgtcttagataagggagtgtgtattttatggctggtgcccaatatgcaagatgtaattttagtttgattcactatcttcctagattaccctttcataatgtgtatgcatgcaaactgccacaacctatacacgcagaaagcatgtgggcatgcaaaccaaccaggcataacactaactcactccttaactaaagccttagaacgctagcatacccaactgatacccacaaatctatctctaaaattatatttttgggatttataatttaattttaaggtgtaaatagatttttatctctaacatatatcttgaataaactcataataataaaaagtagacaaactcctaattaccaacatatacataaacaaaaatcgctctgcatatcatctccccacgcgcaatctctctctatgtgccaccctctccttttgttgtgcggaaatttggagtgagagtgtctctcaacctgtgaagagcaaaaaaggacaaggtgattctaatttttcggataaatatttaacactaccacataaatgattttcccatatggccaaaactcattattgttggcgggtggagcacctacctggagccaggtatctgcaaagaaaggcacttccccatgtggttgcaacaactgcatgcaaaaatgcattcttgcagtcaggcgtcttaaggaggccgcatgtaaagacctgatttttgcatgcaatcaagtaaggatgtctgactacaacgattttcaataataataataataataaagaaaaaaaaaatccaaaaccctagatcaggcactgccgccacaggcgtgagtccgccactaccaaggctgcgccgttggatccgtgaggaagaggaccactgtcgtcgtcatcgatgcagtccgctgcctgccgttgtcaacatcgcgaccccaccgcacccaaagccagcggcggtggatccaagagggagagggccaccgccgctagatccgttagagagagggccctaccgtcgtcgccattgataccccgccgcaccagaggccacctgtccgcctgtcctgaggccgttgccgccggatccgtgagggaggagggcccccgccgtaggatccggctaggagagggcccccactgttgtcgtcatcgataccccaccgcaccaaaggctggtggcggatccgccctcccgaggctactaccgccggatctgcaagggggatggcccctactaccggatccacgcagggcagggtcgctaccatcggatccatcgaggaggctacgccgctgccgccgttgacgtgcttccccgccgtcatcatcattgatatcctgcagcaccagaggccaccgctggtagatgcacccctctcgaggcttccgccaccagatccgtaaggaggagggccgccgccgaatccgccgaggaggctacgccaccgctgctgtccacgcacgcctctcctccaccggcttcagttttagaattaggtttatttaaggatattgttggtcatgctcttaattcactctctccttgatattaggaaaaaaaattaggaaaaaaaagtgcaccctctaattaacgacgaagggagtaatttatgcagaagctataagaacaattatagtcccatagatgtgtgctggtaacccaggtgcttgctttaaatcctgatcttcatacataaactaagacgacatatagttctatatagatgtacatctatgttgtgttgtgcaggtatttcagcggggaagcggctgtcggaggctgggataacggacatattgatcttagaggcaacagaccacattggcgggcggatgcacaaacagaggtttgccggcgtcaatgtggagatcggcgccaattgggtggagggcgtcaatggtgagaagatgaaccccatttggcccatcgtcaactccaccctcaagcttaggaacttcctctccgacttcgacagtcttgcccaaaacgtctacaaggagtacgtacattccatgagtgggtggatcgattgaaataattaaaactcgacacatgattaattatacagatttctctaaaaacatattttgcacatatttacgtgtgcgcatcatagtaatagacaagcactaatcatctgccaattccaatctgtcaccgctgttggtttgggaaaaaaagagagtaattaatgcccagttgtcagaagtactccacctattcacctttcatttatcaacaagagagagactaataaaaaaaaactttttgcggcccatgaaatggaatagtatacttctaaataaattaaaatatatatgcaacttctaactagaaatttgaaatgttaatgaaaatttcaaaaagagactgaaaaactttcaaaatgcaaagttctgttgagattaaaactttcatatcattaaatattaaaatggccataggtaactgttttggacatccatatttgtcatttaaacagtatagttttgaacattaacttctactcggctgctagctgcgagaaagttatataaaaagaaattacgttatatatatagaattttacttcacatggtttggccaaataacatataaataaaacctccaattatagaaatataaataatgtagccatataagaaaaaaataaataatagatcgatgatctaaacatgaaaaataatttgaggaaatcctccaatgctaaaattatagacaatgtagcttccgtaagagagaagagataatagatcgggtccaaatgctgaaaataatttgaggtaattgtgatagaaaaagctagaaacaaaagatggtatgcattaattggaacagattcatgcagggtatgcaatttcggtaacaccgaaatttttgtggttgccaaaatttaaaaaaaatcatggatttcagtgtttttttaccgaaattatttaaaaatttaacatcttttgacttaattgaaacaaattttgatcaaattcataaatatttgaaaaaccaaaaattccagaggagatttgtgcttgttggtacggtctgaaattaccaaaatttctaaaatttaaaaccgaaattgcaaaccatggattcattgagaggagatg

SEQ ID NO: 46605 - DNA, 1704 bp, Oryza sativa
aattgtgttttcagacaatagaaacaaactatgcatgcaaatatattattgcatccaaaatatatatatcctactagcatacatatgcatgttgcattatattgcctgaagttgaataatttcagcggtggcctctgcgacgcagcatacgtgcagaagagaatcgacctggctgatgaagcggataagagtggggagaatctctccgccacactgcacccaagcggccgggacgacatgtcaatcctttcaatgcaacggctcaacaatcagtacgtgcctttgccgctcaagtctttacttaaaaataaaatttaagcacttagaaaacacttcaaaagctatttgaattgatcattcatgtatttcaaatagtagctccaaaacaaatggaatttgcttaggcttgtgggcctctgaaaagttgtaggcttgtgggtttaggcccaaaatgaaactaataaccagtctagcagatcaagatacttcctcatgcaggaatgaatacgaaaccaatctatctatctattatctattattatttactaaaaatccatgaaacttcctacaaacactcataagccgccacgtggcactcctacaaacgctcctaaaccgtcacatggcacttttaatctaaccgtcgattttcacttaaattggtggacccactgttttagactattagattagatctatttagaaaagtcccagcttcatcgaaattataccagaaaaattaatgtacataccggatataaaccttccgtattgttctcttaaaaaaaccaaacagacgtatacgtacgtacgaagattaaaaaaaaaccaaaaaaccatatgtatgccgtaagaacaatacggtctttcgaatatagtgtagtacgtattgtgtatgcctttctctgttttttatttatcaatgaacagcaagtacatacttaagacttatctatctatccaccgtctttaaaataggatttcctatattataaaataaaatttattactccacaaatatgcactgttaaactagattaatataaagtaccaaatcaactgtctttaaatgttcatcttttaaattatttctcaaatatatatctaacttataatcctttgtctttctttaattaaataaaatactaatcacttataatcacttataatagttatatgttatatggaactgctaaattcattacgacacatggtgccaacatataatacgtaatgtgataattatttttcaaataatttagttaacatataataactaatgtcatgatcatttttaaaataatttcacatgacaaaaatgatcaacttggtgtcaaattcgcttgacaaatatataacactaattcaaatctacatgcagaaaaagtgaaacaacattgtggtttacaatcagatttgattttattttaatttatgtgatattgagattctcttttttttaaaaaaaatagaactatttgatgggaatttccaggcaaagaccttgctatattacgaccccttaatccatcaggagaattacggtcatatattgtttttctttgcgaaattggtttggtaacaaatgaaaaatcatttgcatcaaactattcatcatatattttttatactttagaaattctaatatatcaaacataattgatgatgtatgtcatacaccccactgaagtaactataaatgca

SEQ ID NO: 46606 - DNA, 2186 bp, Oryza sativa
cgtggtattatgagtttctcatatattattgcatatataagacatactaaggtagctggacgtagtagtacttagttggttaaaaagttatatatatatgctactatcaactttaaatttaggactcatgttgcctagggttttttttaaaagaacaccataaatcacatatataaaagggaaggacgcgtaaaatatatatatctcctatgtatttattgtctcattctttcaagaaaataaagaagatcattgataattgctaatagtaatgaattaaatattatatagttcaaccttacaaatgtcttgtaaaaaattatctaagcaatagcgatgaagaaaatttataaagaaatactccctccgtcccaaattataccaactataatcaaactcggtaccttttaactaataatcatactaactatatctaagtattatgcatgttacatcactagatttatattttgaagtactttcatgtgatgctaatttcatatttgttgggatagaatggaataaagtactggtcaaaatatgttattaaaacctgtgtaaaaaaatataggtcttataatttgagacagagggagtagtatttttcaagcatagcaggtattgtccgattgatactccatcatccgattgatattcccagtgtaacctactttacatgcccacgcgaatgcgcgggctaccttcctagttctaccagaaagggtaaatgatagtaccagaaaaccaaatctcttttaactaaaatagcccttaaacctcacgaagtttggtctgactgatgtatatgcgcgtcagtctgactccgtagtcctgctgatctaatcaccgtgtgcgatgaatctgcctgcctactcgtcaccgctggttaaaccgcccgtcgagtagaccgcttgtctgatgctggtctgaccattgagatccaaaaaaaacacgtctcgacaaaactcttaaaagtagatcaaccgtattgtatcaaattgtgtttacaaatcgcatctaaagcactgctctttcacctcatgtactagagtcaaagtctcaaagcaagaactaacttttctcccttaaaagtcgatatactcctaatatcaacccctcgcctatttatacataaaacatagctgtacctagccatgaatcctactggaactaggaatcctaatcacacaaaaaaacccctctcgaaccaggaaaacaacatccctatacaacaccaaacttctcaaacttaggctctaatctaaatttgactctactttccatacacacacaacaccacgtgtatgccataagagaactcatgtatattgttctctagtctgagcatctcgcatgatctcgttgatcatttgtacctcaagtaatgcaaaatttcatatccaagcacaagttcacaccaacttgtctcacatcatcatgcaaatagtatcacatatgtatctaaaccatttagaagtcatgaatatgaaccgattttaaaaatcgacaaaaccaacctgaacatagatgaaaaaccgaaaacattattcgtcgtattttcacatatacttatctttgacaattatttttcaccaagattacatcatcacatgatttcacacctccaaattttaatatatgatgccattggcattgttagatacttttggttgtccatattaattttgttattatttgatttgtcaataaatatttttaagcatgactgatatgttttatgcttaaaatttttaaataagacgaataactaaatgtcaacggcaacgtatattaaaaaccgatagagtttttttggccgggccagtggacggcgtcggccaatgtattaagcatgggaaagaaaaacattttacaaacaaacaacagtcactgctgtcgggaaactagaacatacaccggtagtaggctgggttaggccagagactaaatatataactggcccgcctgacagatagtatacaacatacttctatgtaaaacaacttaattctaaagatgtatctagataacgtgtatgtccaaatacaagctcagaaatggattagaattaaaaaaaattttaaagatagagggagtagtacaatagttgtacaagctgtgattcagtctctctgttcttctgggtggtggtggcgtgcaaatccatgaaatggccagcctgccca

SEQ ID NO: 46607 - DNA, 1848 bp, Oryza sativa
cggtgaccgacgaggagtcgaggcggatcgagcagcagccggacagccagaccaaggcagagatcatggaggttgtgaggagcatgttccctgacgaggacgtccccgacgccaccgacatcctcgtcccgagatggtggtcgacaggttcttccaaggcagcttctccaactggcccatcggcgtcagtcgctacgaacatgaccagctcagggtacgagctgttactccaaccaaatgctaatcgcaattcactacagatcatgtttttcattgctactttgatgtttctttggtcatgaacaaatgaggtttaaatttgagcttaatttggttttgtgtatgttttgctgtttctgcacacaaggcgccggttgggagagtctatttcaccggtgagcacacgagcgagcgctacaatggctatgtccatggagcttatcttgcaggtatctatgcctaatttgttagcctatgtctctaatgttagagagaccggagatgtaaaccatttttattgtcttaaaaaaatacctgctctagtgattgacgagatttgtaatgctaatatttgtgctttattatgtgctgtgcctttgcttgtttttgtcaggtattgactctgcagaaattctgatcaactgtgtgtgtacagaagaatatgtgcaaatgtaatgtcaggggaaacttgctttcccctgacattacattcttcagttaattaattctgcgtgttgatatgtatttttaggcgcaaacattttcatgatggaatgagaaatgtgagattccacaatttgctcatcgaggtgtgtagggccttttgtggaaaattatggtgtttacattaattgttttcttatgctacttcttgttgctgaataattcagcagttgagctgatgtatatatgttcggatatggtatcttcatatatcttcggatatggtatcttctctacagggaccaattcaatagtttaaactataattttcagataaaataatgtccaatatccccacttcgttttgttgggactctcatgtcataccctacaccttgtggatttctaataactaatggtatccgttctcttaaaaaaacattgtcaaattttcccaacatcgcaattatataattggtttgatcaatataattaatactaaaaagtcattgtctcttattgcaaaaacatactccctctattctataatataaggtgcggttaaagttggcacggtctccaaaactaatctttagcttataatttctcatatactataaggtttgtaacaacaaaattataacaatatgaaagaagatctaaatctcaatctattatactaagtattggtcaaatgttttaaaagttgaatcttgaaatacgtgcgagcattatattatgggatggagggagtatttaataagttattgatttatgataagatgggataattcttcgaaagaatttattattttacaaaatgttggcttaaattttaatttttatagtacattttgctaatcatgtgacatcatatatgggccgcagtggaacgtacgattgaattgattagggatcatttttcagtttataattttgatttgagcaaaggccagtttcccatctctttttctcatcagatgttatatttctgttttttgtgtgctccatataagataggctttggtcgattttgaataacggcgtttagtgtactttacaaaattaagaattcatttataatcttcacttgtcacgggttagtctagtcagctctttaaatgggaaaaaaaatcttggacaatatggaggaatgcatgaggccaacatgtaagacaaagtgcc

SEQ ID NO: 46608 - DNA, 2983 bp, Oryza sativa
ccgtcggcttggcaacatggagctctcacacttagtcgattgttaacgtagtcagctttctcgaatatgaacttgatgagattggagttgtctctagatctctcatgtcggtatttgtggcttctacattgggtttgtctatatatgtattggtttgtattttgacttagcgtgtctagatctgtctagatgtcttggtgcgttcgttactcctcttctctccccctatgggttcttgtatttatatcgtcgggtacccctttacaagtagaactagggaaacgagtatggatacgatccgagtaatccttatagtgcccgagtagactctgtttctttttccttatctgaaacaccttatgtttagtaagctccgccgagcccaacccaaaactattgggtatacaatatctataacactaacaccaaaggtacacccataagatgctaggcaaaccaaatcctaattcatgtgcaattatttaatttttgctagtgtatggctaatcgatccgaatgcagatatgtttgaggtactactctatatctatataatacggctaaaccatatttaattatttaataagatagatggtcagatgttggacacagaaaaccacaactctacttaaaatgggacagagggagtagctctctcagggttgcatcgctcgttaagattaaactgagagcactatcattctagattgtaccaattaaggaagtttgaaatttctctctataaaacgatttgttacaaatacatccctcgtaatgcaccttggtttgagattctcccaattgtcaattattgtccattcttcgcacacgtacgcgctcatctgaaaaataataggcaaggaaccgtggtcaccactcgtgttaggcatggccagataacatgaccatggtggcttccggcatcccatgcatggtactcagtacgtcattgggcgaaaggggtcacgagtctcctctacaagacattgcggacgacggaagatgagctatatattacgcttgcctcatggggtttcgtgagctgcctgatttattggacagattaagatgaggaagaaaatgtgtttgaaatagtatccatcatgagatgccctaattcatataacacaggtggaaagagaaaaatacaggaggaatctcaaacaaaggggaattaggagatcgaggggcaatttttaaatcttatggaaatttcaaacacagagtaacatttggggttttttttttggttgcaattttccataaaaaaaaggcgctgtggtatatataagtacaccgatggcacaaagcatataattaaatgaaaaaaaaagaatactccctccattttatattataactagctttgtctcttttactagtcaatttcttttagtttgatttaagtttatagaaaagatttaacaacatctacaatgccacattagtttcattaaaactaatatttaatatactttgataatatgttaattttgtgttgaaaatattgctatgtttttctacttgtactataaaacggatgtaggaatcaaacatgaaaaggaaatagctagcaagaaaaaaaagatacatcaactaaaaacatgaagggttcttttttattattatagtccgagtatttcataaaaaactagatgaagaagaaatgcaatcaggttcaatatttagaaaagccattttatatttaacataataaaaaagatataggtttttgacatgcacatattttagtttggttggataaaaaggaaagcaaaataacaattgaagcgagataaatggatatcatcagaaatactagatcgatattaattagagaagatcctctaggatatatatattctcgatcatatttgaacatatgattcagaccatgcgataattattttagacttttttgttagtgttggttgtgcttaatattataggatggagaaagtacagatgaaatagaagaattaatatttagaatgtagatatatatttcaatatttgttatcaagatgtattatggagattatttggatgtgaatccagccaccccggtcccagcctaccagcactgaacccaatcatttaattactcgcatgcgatgcaagttgccatgttgatgaacttctgagcgcaaaaagctaaacacgaacagctaacgaaatttaatcaaacaaaagggaaaaggacctgacaacaaatacctgcaggtcccccttttacaaatgaaaatatggaatacacgggatattttataaaataatcttcattttcaaattttaaaaagtgttccagttgtacgtacgcctcacaagtaaacaaaaaaatattaaatttaccacataaatcaaaatccataatcaattgttcatacattaacaacaaaaatattaatttaccacacaaattaaaagccataataaactgtttataaaatatcaaaatttaatattaaaatactagatataaaaaaaattataactctggcactcgcatttacaacttttttggaatggtaagcgatgtacctgatgatggctaggtgcttggataatttcatcaatcttaaaatttgtcaatccaatctcgcgagaaagttgtatgtgtattcgtttataagggtgggtgcgtacgtgtgtgctaatctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccaaatccaaatccttccaatcaaattcctccgcaaaagtctattttgcctcccccgaggtcgatgggccgaatctcgctcggcccatcttcccctcttccccggccccctctctccccgggcgctctctctctctctctctctctctctctctcgcgcgcgcgctctcccatctctccccccc

SEQ ID NO: 46609 - DNA, 10805 bp, Oryza sativa
cctgcagccctccggatctcaagcaaggcaagccacctttgaacatcttgagcctatattgaaatttaattatattgcttgcgaaatattatgcattgataagatcacacttaatctgttgtcccgtctgcaaggcagattggcagacctacctaatttgttacatttgatccttcctttgttaattgttataccatgtccccttgtaaccacccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccacggaccggggaacgtaccgggtgtacggtttcccgctctcgcacttaaggaccgatttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggttgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtctgactactgcttgtgaaattgctgttgtgaaaaggggttcgatgtttgaaaaatctgcagctgatgggatcagctaggcccgggtggccgtttgaaaagttgttggcccgggtggccgtttgaaaagctattggccgggtgccaaccctgtttcaagatctaaagactgatacattgcacatactccgaccggacgagacgcactgtctcctccgtgttgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgcgcctgtgacgattggtccaagtcctggcttccgctttccttttgtaatgcagttgtgatctcgggatctgtccgcagcccaacatgactgtacttctactctataaaaaagagacctatgttgctgtgatactctgtctccctgtgataccagcactgtttcctgggactggtatcgattaacaggttaatttggagcgtcacgggctagttccggtcgggactagttcggggcgtgacattatcggcatgacggctatgcgtttctactgtgttttaattagggttttaaaattatgatactgatataaaaaaaccttttacgctggtttcaaaatagctaacgcgccaacggcgggccaattagataggaaattaagtgaggagacaagggtgtatcgcgcagcaagagggcatgttgtgcagcaagagggttagtggccaatttgacaagttcctcatcagtctgcacgagctcatccaacttcaccacttcgcccactactacaaaacattcaaataggtatcggtactataggtaccggaagtgctaaaaccggcacctataagccttttcccacctccgcggtccgaaaacacgaaaaaccgacacctttaagcaattataagtgtcggttctgtaaaaaaaacagcacctatattataggtgttggatttcagtaaaaaccgacacttataataaattaaaggtgtcggtttttttttaaaaaaacagcacctttcagatcgagctgtgagccgagccgcctgaggagcggataagggagaccgcgtctttctcacgcgtctttctctctctcggtctcttctcttcctctctcttctccaccgcacacctcctcttctcttctcttcgtcctctctttctcctctcccggcggcaggaagagcggcgggaggagcagcggtgtcggtgtcggtgtcatcagcaacgtgtgtcggcgtcgtcggcgtgcggcaggaggagcggcggctgcccggaggcgccctccctcctccagatccgacaggaggaagggcggcggcggcccgacagcgccgtcccctccgctgtagcagcgtggggcggcggcggcgttcggcgggaggagcagtggccggctggaggcgctctccctccgccagatctggcgggaggaaggacggcggcggcccgagatcaccctcccatctgcggcactggcttgcgacggcgttgtcggtggcggcagtggctgatttttgatttttgatttgttgatattttgatgtgatgatttgttcatatttgttgatgtgatgatttgttgatattggttgatgtgatgatttgtgatttgtttgatctagatgtattcatggatttagggtttttttgggatcggcttgacagcacgatgcatcaagccgatttgttttggctcgttttgaaaccggcacctttaggcttctgtgatctgtgccactctcgtggtgtcggttgggaaaaccgacacctaagggggtttcccaaccggcaccatttaagggttctgtagtagtgtccccaaatccagtgctcaacctctcgtcgtttggtggagtggggaagaagaggatatttcttcgtcaaggtgagaggaggggattgacgtggggacaaacaaggctgagtgacatgcaacatgcggtggggaaaatgatgctatagctcttgctcacttacatgtggcaatgtgggccaccagtccaatgtatgctttggtaacaaaatatggcggcctaaagtgaaagtagatggtccaacttgaaatttaatttgatgataaagattagttcaaagtgtaattcattttttgattttctttttgttataatttgtatttttattaaaggcactttaaatatgacttgttttttatttttaatataatttttcaataaagcgaatggccgtcaatttcatcgtacattaaaaatactggataggtaatgattactcccgatttgctggaaacttgacacacacacgatctggcttccaatcaacacgacccgaaccctgcaattgcagcaccacgttttctctagttatcaacctgattaacctcaccgaaggctaatccttgtgtgcgaatggaagaaaacaagtaagagcaacgtagattgcaactcaatttgtagatgaatgactaagcactcgaatagggttccacaaaccgaaccagtgacgcaactgtaatggcaaaaataatgtaagcaaaactcgagtctaaactatggcggctactgaataaatatgattagggacatcctagggttacccggcaccacccccttggtcttagcgcacgatacaatacaaggcccaaagctcaaatcagaatcagactatgtgaggtatgtgacttgttttgcagattcctaactgctaaggaggaattttgatgtgagaccaaaaccatatgaaagttgcctccataaactttccaacaagtactcatgtgacctaagattccttctagactagagtctagcttcatttgaagcttatgctataaggagacctgaatccgaatccgaaacgtgtacaatttcatcttttgccttttacagaccaaaagtggtgtggtaatgttggagtagactttgggaaggtcttgggttggtccccaataaacttccttgataatccatatatattctttgcgctcggtctctttccttttactcaagcaagtacctcttcaaacgagaacagacactagtactgaaagggtttttacagacggcccgaaaggggttttcgcgtatggtagggctagctgcacacaccaaatgatatgcgaaaatcgctatttttgtgtgcgggtgggcgcacccgcacgcgaaaatcagaggttcgcgtgcaggtgcttattttgtcctcacgcaaaaataaaaaaaaagaaccaaaaatcacgaaccctaaccctagaagccgccgccaccatccttgttgtcaccatcgttgcttgaagccactgccgctgtcctcgtcatctccgccgtccttgtcctcatcctccacctcctcgtcgggcataggggtggtgggatccgcgtgggagaggaaatggacatcgggtccatccctcacgtcaccgttgccacgcagtagaggccggatctccgccgccacgcctcccacccaccaccgtcggatctgcctccgctagcaccgccgccgccggatccgcccctctcgagaacagccagctgcggatccatgaggaaggcaacgaggcctctccgctatcaccattgctgacctcgtccaccgccgccaagcctcccacccaccaccactggatccgcctcccctagcaccaccgctgtaggattcgcccctcttgaggccagccaaccgcagatccacgagggaggcagagagacccctctaccgttgttgtcgctgacctcctccgccatcaccgtcacgcatccggcagccaccaccgccgagagagagagagaggactgagagagagagagtcacagtggaggaactagaactcgatccttaggcgtcgaaagtgttggagctcgagcttaggaagggatgtcctcttgttcttccccaccagcaagcaaaaagtgcatggtgaactcttctccactttctcatttttgctatcggcaaggaaccaacgcataacatagtcagtagtacaaaacgtcacattcgtgacgctctcatagatatcgattcactttaaaccaacacctacgagggatttttcatgcaaacaaggctttttaaaaaccgacattcatatatgatacatcagtgccacctatggattgagccgaaccgacagcaccgaagaaaataactctagctagccaggttggtttttaagtgcctgcttaaatgccccccacccccctgtgcacgcacgcgtgcaaattcgcttcccttcttgatccatccgccctcatcctattctcttctccatccacaaggcaaccatatttgtgtggggactttggggggaggggggattgatggcggtcaacacatcggcgggaagattcttgactccatattatcccatggggagcaacagcggtgatggtgtagtattcttccttccagatatgtgttcttgtctactgacttgtgcatgcttgattcaatttttttcttcgatgttcatggaaacctttcaatcttagggtctccatgttgttgttggatggatggtggcatatggtgttgatgaatgtgatgttaatcaatgtgttcttggatatgggtcgctacaatttctttggttccatggaacctcataggtatgggttcctaaattggcacctatatgatttctcctcattggttttgccgaaactagcacatatgtgggttcccaaccgacacctatagggtgttgcaccaatgagtgtggataggaacaacttaagctcgttttgccttgctcatggccacaaccgcaaactcagatttgtatggttgaagaacgagtggatagaaaagagaaacgtgctcaaggtgaaacattgcactactacagtgcaattgcatggacaaccgcacgcaaaaactgattttcacgggtggttagttatggcgctgcctaaaaaaaggtaaaacaataaaaattctaaaatcatgaatccttagttccgaaccatagctccggcggcggctgatctgccgctcccccgatgccgtcgtccctgtagctcccgaggcgagcccgaagcccagagcccactatacatgaagctgccatcgccagtagccaaccaccttcgcccctcgaagggccggcgtcaaaatctgcgcactacggaggcactgcctccgaatcggcccctcccagcagtatggatgcacctgccgcggggccgctggcgccagctcaagtttgctctgctgctctcgtcgccacccctcctttagttgcaggcactcccgtcgcaactgtcgtcactgctcccatcgtcggttggtggaggacacggtgaggaagagaggagaggatgagggaggagatgtctcgagaggagaggggaagtaaaggaggacatagaattttttaagggaggagagaaaataagagggagaagactaggtggccgtcctgttgctaagcgtgcctcttaacaagtttgcatatatgtatttatttgttagctcaaaatcttttaacatacgggtgtttttagcctgtttggagaaaaaattaaagggattgtctacaaaaccatttttagtgtactgtttagcaaacaaatctcgctcaaattgaggagggtagtttaacataccctattccaaattatacaatggtgtaaaaagagatgttccactatgcaatttactcttttttataagtcaaatgatttaattatcgaacacatgtctacaagataacaatgtcatagtttaagctagagaggaaatattaattagttgtttccatatatgacgtgacatgtatatgcatatatatgacttccaggtgcaccgttaccgtttgtttatgacactgaagttaaaccttagatcggaaattcggaaaggaaaacatttgacctgtacgcataaaattctcaagggtccggtgtagttatatttatagcgccgtattttttacttaaaaaataggcaacacgtatttatattgtaagtctctaaattacatatgtaaatttagtgtatttataatataagtttcaaaattacatatgtaagtctcaaaattatatagtttttacatgtgtaaatggtgtgtaagtgggatgtaagtggggtgtaaatttgtattaaggaatagcatgcatgcatgcatataacacgaaattaattaggagccgtttcactcggatttgcatgactttagaggttagctagcatgctttcaggtctcttggcaaggaaaaagtatggaagcacggatcttaaacacagatccaacggccagagaactaattgtaatcaactaaaaaatttgtcgacacaattatagcaaatacgaattctcaatggctacgcgttgaaatggaaggcgacgatcaatttgtttcgctggtcggtcaatttgttcgtcttacaaccttaaaacatgcgtgtacgactcgatctatatatgtgtcacgtttattttcctccaaattaacaatacaatgtacacacaacaacctctttcggaaactatatatatatgtaggtacaagttcattctcgtgccaagaagggagatcgagagtacttgaaagacagtatgacgaagcccacgacgatggccatttttcttgtcttagcgctatccatagcacagcttcttccgtccctcgtcgctggcaccggccggccaagggtcatcattgttggcgctggcatatccggtacgtacaatctatctattatattattatagcactagaaaaaagagccttcacgttcgctctgatggcctaaaaatttttacattaatcggagaaaaagaaaaggcagagtccatatagaaatacatttagaaatagctgaaattcggaattaaaaaataaggaatattagaagaggagactagagtccatatagaaatacaatttagaaatagttgaaattcggaattaaaaaataaggaatattagaagaggagactagactccatatagaaatacaattaggaaataactgaaagtcggaattaaaaataaggaatattagaaatagagtatagagtacttatagaaatacaattagaaaatagctaaaattcgaaattaaaaataaggattattagaagaggagactagagtccatatagaaatacaattaggaaatagctgaaattcggaattaaaaaataaggaatattaaaagaggagactatagtccatatagaaatacaattaggaaataactgaaattcgaaattaaaaaataaggaatattagaagtagagtatagagtccatatagaaatacaattaggaaataatagaaattcggaattaaaaatggggaatattagaagtagagtatagagtccatatagaaatacaattaaaaaaaatagaaattcggaattaaaaaaaaggaatattagaagtagaatatagagtccataggaatttaaaactaactaaaattcagaataaaaaggagcctccatgttcgctctcatgatctagaaattgtcacattaattggagaaaaagaaaaaagcagagtctatatagaaatacaatttagaaatagctgaaattcggaattaaaaaataaggaacattagaagaggagactagactccatatataaatacaatttagaaatagttgaaattcggaattaaaaaataattaatattagaagaggagactagagtccatatagaaatataattaggaaataacagaaatttagaattaaaaataaggaatattagaagtagagtatagagttcatatataaatacaattagtaaataatagaaattcggaattaaaaataaggaatattagaagtagagtatagagtccatatagaaatacaattaagaaaaaaaagaaaattggaattaaaaaataaggaatattagaagtagattatagagtccatataggaatttgaaactaactaaaattcggaataaacatgataaaattaaaagtagagtttagagtccgtataaaaatacaatttacaaataactaaaattcgaaattaagaaaaacatgggaagaagattttaaagtcaatataggaatacaatttagaagtaactgaaatttgaaattaaaaattaaagaatattgaaagatgagtttagagtccacatagaaatacaattagaaataataaaaattcagaattaaaaaaataaatattaaaagacgagtctagagtccatataggaatatatataatttataaataactaaaatttgatatcaaaaataattaataactaacatgtatataaaatacaatatgaatattacacattagtagtttcgtaaagttattgtaaaatttaaaattatgttgtcattgtaatatattttaataatataatgagaaaacatatatgctattatatgagagaaaatataatgatgctagccgcgcaatctgcgcgggccaccatgctagttacttttacagtggtatctaccatcactcgtagtattccctactccctccatccaaaaataaaccaacctcgtagtagggtataacgcatcctatatgtcagatttattggatcctatatattaagatttggtgtattaggatatgtcgcattctaggttgtcttattttacgacagagagagtataacagttgccggatgaaaatccctcgtaggtgtcggattcccaaccagcattaatttggaggcgcctttgcccgttggcataggtgccagttataaaatcaacacttatagagattataggtgtcaattctatagacagacccgacacctataatctttggaaaaaagggttgtggaggcgcaagggatcaccgacctggtagcaaagggcgacaaagctccttgtagaagtgcttgaagtgtcctagcaactcgtcgacagcggggaaagataggcggtgggccccgggcgtgcagtccctgtggaacttcaataggtgctcatccaccagggttccgagcgttgaacgaggagtccccctgtgcatgagcacgcatgtgcacacacaatgacacgaccacaccttagacaccaccggaccaaatcgttggagggaggaaggggaggggggagtggacattatacttgtcagctttttaattaattaacgcctatgatatattatatgtgtcattcgttttttcaaaatcggtacttatagaattaatgccagcttttcctatagctgcttaaaggtgcataggtgttggttttaaacgaaccaacacttatgagctgatatctattagggattctacagtagtaactccaatattattactatgttagccacaatgctatgtttttaattatgatgtatgttacatgttagtttatacggacccatagtacaaattatggttcacacattagagataaattggtccggtggtagataccatatataggagtagtacatatcatgagttaaaatctcggtctccacaagctgagaaccgcatgtacattgatttacatctatattgctgtgcaggtatctcagcggggaagcggatatgggaggctgggatagcagacgtattgatcttagaggcgacagaccgcattggcgggcggatgcacaagcagagtttcgccggcgtcaatgtggagatcggtgccaactgggtggagggcgtcaatggcgaaaagaagaaccccatttggcccatcgtcaactccaccctcaagctcagaagcttccgctccgactttgacagccttgcccagaacgtctacaaggagtacgtacattttcacacaacca

SEQ ID NO: 46610 - DNA, 5433 bp, Oryza sativa
cagttgtcaattccaaaccgtcaccactgttggttaattattgcatgcacagcacagcactcagaagtgtatcatttagtattcatgcaccattcacttatcaacaagagtaactaataattggatactttgtgcggcccacgaaatggaataattatacttaatttgaaaaagttgatgaaatttcaacaagagatcaaaaatttcaaaatgcaaagcttttttttagattaaaacattcatataaatattggagaaatttcacacaattttcaggtaattaaaacattcatacacaatgttcaagcacaaaacattcaaatatagatcaagagatatatataagtgacttttctcccaacttttggttttaccttgaaactatctaccgtgtaaacatggaatagtacttggaagaaaactaggtattgttggtcaaactttttctctttcccggccactagctatcagttccccatttcttgagtttttttatttcttttgtgcgaggagttccttagtagtaaactatagatagtatgggttctcattggaagatagataggtaaacatgagagggtaaacttataaatactacctttgtcttagaacccgttctaagcagatacatcaaacggctaattagccgcacatgagaaatgtgattagcatataattaattgtattaattattaaaaactttttgatttttaatagcttgtatataaaagaaattttgtaggtaagacatcgtttagcaatttaaaaacatactaacggaaaatgagaaatagctaagttgaattagcacttcagaataaggtcttaaaattagtagctagaaataaaaaaaaattaggacgaagggagtagataaatactaaaccttctaaaccacttaagggcaatcccaacactcaaagggaaaaatatgaagaaactattatttcttatacaagacactagctttaaaggaacaaaaataaggataaaaagaaagagaagggagatgatttgatgagagtttattttaaataaatcgtctatattgggtatatagtttctgcgtacattgtcgatataacatggtatatatgaaaactagtaatagtttttgggttaagattgttctaatgatcaaccttctatttatttcacgctgaatgccacctcacagttgtacgttcgtaggcaagtggccaacaagataacagtgcccggccccatcatgttatgggaaaccaatcgcaatagcatacaagttgtatcaaattggccataggtaatgtttacatgtgcacatggctttatgagaaaagatggacaatttgcaccatgcataagtgatcgaaaggttagaaatagttatggtaacgttacttctcatcagaagagaaaattggcattaaaaatatttagtggggattcaattttatggatgacgttctctttcgtggtccaatcttctggtgaggggataactctcggtttgatcgagtgcgacatttgcgatatggctaccaaccagaacaaggacatgacgttgtgcaatcgctacaccacaaacaatgtcataccaaccgtgacacacggttgatgatctttacaatgcaaacgagagaacattgcaagaacaagatataagatgcaatctaaatattgcgaataggtaattaagcacaaattaatagttgtgattaaagtgatatatctaatcgatccgataaatcaacacaccaactattaggggctctgaatctattgtcgccgactaattaatcgagcgaggactatagacaaggtgaatggcacttggcaaaatccaactaaaccaaaacacaattgttctagagggtatacatatacatttatagaggaaaatggatctagagttaagtgctaattcatggaggtggagggagacacttttgagatgggactagccatgtcttgttttaaagattcttgttgactcggaatgaatttggatgagaccggatgcgtttgaaagatagcgagataatctttccatcaatccaggatcacctaaatcggagttggcatggagacgctacgtccgtttgaagtaagtactatctccggaggctgaactgaacttggacttgaaattatcattagaacgtgtgaagttacgtgcgtatccgatgaagtaatgccctcatcgtttattggaacaaatacataatgtcaacataacaaacataatataaattgaaattttgatctttcggaaaaaacaaacgtataaattctcgacaaattaacgcatatggatactgcaagtttctacctgggtccaggaacttatatttgttcaaaccgataaatgtttgtgacatgagtagattctacaccgaacttaattatttttttaaaaaaaataatggaaacttaattaattagtatcatgtatatttttttcctccaatatatatatgctaccatacatatatgcatgttgcctgatgttgtataacttcagcggaggcctctgtgacgaagcatacgtgcagaagagaatggatcgggcagatgaagtggacaagagtggggagaatctctccgccacactgcacccaagcggccgggacgacatgtcaatcctttcaatgcaacggctcaacgatcagtacgtgcctctgcccctcaagtctttacttgaaaaaaaaaacgttaagcacataaaagaacacttcaaaagttatttgattttttttgcgacaaaaagttattcgaattgatttgtcttactgtaagagtatagatagatatagaaaatcgtttgaaatttgtgtaaggactgaactaatcgtatattgggcctcgaaagatgtaggactatcaactaggcccaaaaagacactaaggcctccttcaagatttatagttggaattttgatagatcaatgaacaagttgattttgtgatagctatttgagggtatatacacaaattaattaattaactactacttacaaatttaaaaagttggttcagcaaaacagtatatagaaaactttacacaaaatatccatttagaagcttagaaaacgcgcaaatgaaaaatccaaaatccagtacaagctagctggcctgaataactggcctgacaagcagtacaacatagcactacaagctgtgaatttactttctgctgtttcgggtgcgtgcaaatgcatgcaattggcagcctacccaacggcccgtcgtcgccggtggacatggcggtggactacttcacctacgactacgagttcgccgagccgccgcgcgtgaccagcctgcagaacaccgttcccctccccaccttcaccgacttcggagacgacacctacttcgtcgccgaccaacgtggctacgagtccgtcgtccaccacctcgccggccagtacctcaacgccgacaagtccggcaacatcgccgacgcccgcctgaagctcaacaaggttgatcatatcacttctgatgccatgatcttttctgtcagaaaagatgaactgattaagcacgcgatcatcatggtggtatatatgatcgatgcaggtggtgcgtgagatctcctactcctcgaccggcgtcaccgtgaagacggaggacaactcgacgtaccaggcagactatgtcatggtttctgcgagcttgggagtcctgcagagcgatctcatacagttcaagccacagctgcctgtcagtttctatgtccaaatgtccttgcatgttcaacatatcctcttccaaatataaattaagatgtgcatatcgagcagtcaaatttactttacgtttcttgcatgtttccatcagtcttggaagattcttgcgatctaccaattcgacatggccgtgtacaccaagatattcgtcaagttccccaagaaattctggcccgaaggggcagggagggagttcttcctctacgcgagcaccaggagaggctactacggagtctggcaggtacaaaatatgcagcaatatatacaatccactcacatcgaattgtagtacattgcgatgatctgaacattcttcaggagtttgagaagcaatacccggatgccaatgtgctcctggtgacggtgaccgacgaggagtcgaggcggatcgagcagcagccggacagccagaccaaggcagagatcatggaggttgtgaggtgcatgttccctgacgaggatgtccccgacgccaccgacatcctcgtcccgagatggtggtccgacaggttcttccggggcagcttctccaactggcccatcggcgtcagtcgctacgagtatgaccagctcagggtacgaactactactccaaccaaatgctaatcacaattcacaaattgatgcggtttggatttgagattaattttggttgtgtgtattttttgctgtttctgtgcacaaggcgccggttgggagagtgtacttcaccggtgagcacacgagcgagcgctacaatggctatgtccatggagcttatcttgcaggtatccatatgtcagataggccggacatttaaaccatttttattgttctaaaagagaactaccctagggtagggatcgacgagatttgtaatgctaacatttgtgctcaagtgtgcgttgtgcctttgcttgtttttgtcaggtattgactctgcagagattctgatcaactgtgcacagaagaagatgtgcaaatataatgtcgggggcaagcacggctagtttgtggaggcaagtcaaactaccttgtcaattggctgtgagaacattccaagctatatcttcagttaattaatcctgcgtgttgatttgtatttctaggcgcaagcattttcatgatgggatgagaaatgtgagattccacaatttgttcatcgaggtgtaaagcaatttgaggaaaaagtgtttacactaattgtttacttatgctatttcttgttgctgaatatatatttcagcagttcagctgatgtatatatgtgctattgtttcgaaatgaataaaatcttgcgtagatttgtaaatctgtaatttctgatgactacaagatactccgttcattcaccaattcacgcttgggattccgatggaccaatggagaaggatgaaacggagagcaatctcttcggattagccatttcattttctacttatatgaatcagaaaaccgatatttttctctaaaaacaagcaatatctatagcttcgattatgactttgctgaatatctaaccagaactcaatgtcaaaaaaaaaaaaacaaaactcaatatagcagtgtatatatataaaacttgtgtggctaacactaaatccgaccttagctcagttggtagagcggaggactgtagtttgatgcagagaaatccttaggtcgctggttcgaatccggcaggtcggacaatttttgtttttcaggcattcaaaatgca

SEQ ID NO: 46611 - DNA, 9034 bp, Oryza sativa
atttttattaatattataatacacttacatgtcatatcaattgaatttacatttgtagatatatcaaaggatcgagaaaaaaacataaccacgaagtcgccatgaaaaatagaacatcaaattatcaaaccaaactaacttatatggttgcatccgttcatattccttatttgtttatagtgtttgttgtgtgctcgatagaaatactactaggcggtctgtatagcgtgtatggtaggagacgcatcgcagccgttaaattaaattatgcgtgatccaatggaagcaaattcgagtgatttctagggaaaaaaaactgtcgtatgatgtttagcaaaatcgttttgattttaagtaaaattatgcccacggtaaaatgaggcgcattttacgttggcattccaaagtcctggcaccaaatatgtgctcttagttcgatatggtatttgttcttgaatttcacatatttcaaccaataacatgattgggaagagaatccaagcaattcaaagttcaaattttgaccactaaaatgtctaaaagaaaatgttttcctctacccttgttgttttttttacttcaagatctaaaaatagtactagtattttgaaacagatgccggcgtacttggcacatggcagaaagaatcgaataattacaagaaacatgacatattagagtatatggtagtcagagatatattaggataggattgatttgtttggattatcactctccctgtactatccaacatgacagagtaccattaatttctccagcttacagcaaaagccaaagtacatgcaaatgtggttgtggctactgaagatcaaaaacggcagcaacaacacgagctctctcggcctgaccgttcacttcaggggtggcgcccgtacgtacgcagcacgtcgaccctgcctgccactagccgccgcctcctccctttcgccggcagagctttccactgcgttaaattgcagttgccggtcgatcggttgatcgatatatccgactggccaacaagcagccagcttgccgcctcttggcactgcacaagagtcaagaggcaggggcactgtatctgtatgtgtaattccagtgaacctgaactgaaacatgaagagcactgcagctgcgccaagttgaggttcgtgcgtgtgtcctcagcttgcattgacgggtcggcaagctgccgtgtcgtggtcatggcggttcagccatccgggctcctgcgggtagactgacgtacggtggttttctccttttctgtccattcttgcagctcaaatatagggtgtgtttagttcacgctaaaattagaagtttgattgaaattggaacgatgtgacggaaaagatggaagtttatgtgtgtaggaaagttttgatgtgatggaaaagttggaagtttgaagaaaaagttaggaactaaaccaggccatagtgcagataggtaagttgctccatttggtttaatttagtcgtagataggcaagcgagcaaaaagtatagtcacaaagttttcaggtcgatataggatcgaggaacgtgataccctactcacgagagatttttacaaggtgggaacgaaaatgatccgcgttcgcgggacagggacagtgtttccgggtcgagggacggatcctgtgactaggagcaaaaccttcttaccgacaaagataaatcaatggttgtgatttaattcaacattgttatcgatttttgtcgctgcaaatgatcatgataatgatttgttatcaattatgtatggtactgatcatgaggaatgcacaatatctgattatgacgccccctttgaaacaaaatactcgtggagaaattttgtaggactcaaattctataggaatttttcctatttaatcatttgaaatatatgattgaagctttttgaatcctatgaaatttctaaaaaatggctcactaaaagtagattttgaataaaagttagcaagaggctcaacctcttggaaaattctttttaatctatctcactcattcatttcttgcatttttcctgaaacctattcaaatagttatttctgtattttttatgcgttttgcgattctctgttttgtatttacaattctgtcaaagttccatatatatattttctacattcatctgttttctcaatgtatcatttgaaaggactatgcatatgcacacttgaagggattgtttgctgttgacacatcatgagggacgctcaactctgcaatgatatcctggtctgattgatggactgatgctaattatatgtaacactagtatcatatcctacgcagcatatgacatcagtcatttttttttattctgaagcaaacgtcaagctttgaaagccttttcctttcattatacagagccatatgttgctttcgctgatctggcgacacatacttatcagaatcatcagtagtagttaaccaggttctttgctccctgacacccatgcatcatctgctgctgagcattgcacctagatcacatccctttacaatattgttctgtaaattttggccacaagcagctcaaacttgcatcactctctctacatatattttactgaaaagttcattccaaactgcagtgcttgccacttgtatatggtcccaaataccaatcgttcacttcacttgaaccaaaaaaacgccaaagatatatgctacttgcaagtgtcatttcagagtgcaagcctactggctaccagtaaccaggacccaaaagatggcgaaaatgattttaattttgggctggaaaacaacaacctagctacctgattggtgctgactcggacaagcccacacttggtagatgctgccaaaattaaaggttccttaaaactcctgtgtagcaaatcaagcaggtatatatgaaatagagaacattatctgaaaaattatgtattacacataatctaagatagttagaaattagcaattaagtgtttttcctaggatattagcaattaagatatatatgtatcacttttctcttggagccatctcaagttagtgatttcggtcagagtatctatcagttcaacagcacctgaaatttttgtggaaaagtcattgaaagcactgtttaattagctaggctacatacactattatacttctttatcaatacgctaataactatgtttatagctagaaaaggaacctatcaagtgagatttctttctccaacaaggagcaaggcccctccactactccatgtacttttttcttgtagggacagcactgagatcaccaaatagttcccagattaagttaggatggcaatgtcataataatttttaagatcttgttttggcaagtgattgcaactgcactagaaggggagactagtcagaatgcagagcatgttgttgggtaagttgcctcagctgttctgaaacttctggctctgtcactttacatgggctgtgtttaaatccaaagtttagatccaaacttcagtccttttccatcacatcaacatgtcatacacacacaatttttcagtcacatcatctttaattccaaccaaaatccaactttgcgttgaactaaacacagccatgatgcatttaattgccaattggctaatctaattgtgttccctctaaaacaaaaggatatatagttgtgtgattaccgtttggaaaatggttttgtgatatcaaaacgatcccgagtttagacatttaccatcaagagttatggatacactgttcatgctaaggcctggtttagttcccaaaatttttttcccaatacaaaaatgtcacatcgaatctttggatacatgcatgaagcattaactatagataaaaacaaaaactaattgcacagtttacatggaaatcgcgagacgaatcttttaaacctaactagtccatgattagccataagtgctacagtaacctacatgtgctaatgacggtttaattaggctcaaaagattcgtctcgcggtttccaagcgagttatgaaattagttttttcattcatgttagaaaaccccttctaacatccggtcaaacattcgatgtgacacccaaattttttcttttcgcgaattaaacactccctaagttaaatcatttcagctatagtacttaactttctctccctggtactattgctgaaaggaattattgccatttaaatagtctaatgacattaacttctaactaatgccggctgaattgttcaatgtaagtagactcagaactgaaatagtccacactcttttagcttctttttgacattatcgctgtttaattaaattcaaaattcctggattaattaaagctctatcaactggcacttagtggctacttatagagttataatgaagtgtcaaatactatggacggaggaactatacctatgcttttagcagggccgtcccgtcaaatttaggggccctgtgcaaagttgaaggataaaaacttaactgatgatataatataaaaataatttatacttcttaatatatttcatagaaatctagaatggcctaaaatgataatataaaattaaggagtactggattagaaattaccagaaagaattaggtcaggggcgcggcaagcgtcaggcggcaacagcgttaggcggcacgaccgcatgagagagagaggtgaggcgtcgtttactgctctcgttcgttgcgattgacgattggcgattggcgaggtccacaatgggagacgattcaagattgtgaaccgacaaaggcgtaatcgaagccgaaacaacaagaaaaataacatatttttgggactagttagctaccaatttacttattgagttatatatctagtgttgaagttttgggctcaggggcccctgaaaattgggggtcctgtgcgggcgcgctggccgcacgcccctaaggacggccctggcttttagtggcatttcatttaagcatgttgcttttattctcatatatggatgatgtttaggttttctagttaaagtgttcccatttaatgagttatattatttttttccaaccatatatatatatatatatatatatatatatatatatgcatgttttcaagatgaattaatacaatctcctctccatcatttttttggatatatatttcatcctctcccccctttcggtcgtcttgccaactaactcttagctaggataggaatatataaacggaagttagtcaaacaaataggggcgaaacctagggcaagagggaggcctggcccctccaacgatgaacctcccccccccccccccccggcgaacccaaaatgcagatcccttccgattcctatcatgctgcgttagtgatgataagattaagatgggctattacttgatgactttaggtcctatacacatacagttatgattttttacgaaaatttatacattaacgtgcgaaagaaaaaccatggaaattatagttttgcctgccaaattaaatagaatacgatgaagaggggggggggaagattgttgtttcagttggtactagctcatccatattcttcaaaatcgacggaagattgctaccttattctaataaaatcatgccaacatcatggaagttgcgcgagaagagaattactctaatatgcaattaaagtcctaaaatctccatggattgtcttgatatatttttttaactaacacctcataagttagctcgtcccgccctcatgtctagatcctagcttcgccaatgctaacgaataaggggaaatattggcatatttcgatcaagaaagagatacatattgttctcgctattgcagcaagaacccaacaattctctagagtttgggcaaacacacgcgtagaagttaaacatcattgtagaaaatacatgtcatcataatagagtgacctgctaatgagccgcccaggtcatccaggcctttggtccgcccttggttaatttgctgcagaatatatatgccagagtgccgcgctttggcaaatagagggagagctttacaaaagttttatgcatgtgatattcaattatttaaaaaactactcctattctaagcaaatatatatttattttgtgtttcaaacttgctcttaacaacttcttgtctacagtaacaactaataggaaaacttgaggtatactccgttatacgggagcgtatcctatgcacacaggccctcgcgtgtacacaccgtgtacatcaactaaaaattatcacaaaaaattctaggaaaattcatatatgtactttcaatagtattacatctacgcgcaaagtcacatcttcaaattcattctacatagagaataacaaaaaagataaaattctgacaaaattgcaaccttaaaactgtcggattttttgttttttttttgttacggctaaaatataatgaatttgacgttaagattttaaccctaggtgtaatacaattgaaagtatgtgtatggttttttctagattttttggtgacattttttagttggtgtgtacgtgtgtacacgtgagggcctgtgtgcataggatatgttgccccgttataaaacatatgaatttctacatatactcttcattcaatactaattaaacatcacgaaaccattcaacatttttatatatatatatatatatatatatatatatatatatatatatatatatatatatatatatatatatatatatatatatatatatataaaacatgcattacgaacttattactcttaccaacttatgttgtgtgcaccattaatttatccgtaacatttcatgttacaaagtgcagcgcatcccagtactagctagctacccgtcaacaattaatctagcaaaccccatgaatgacctttctttcaatttgcgagatccaagaatgatggattagttgtgtttatgtatcatacgaacgcggcgaatcgcaattctagatatcaacctcatctagcatgtggaaaggtttgggcggaagcgatcgcactcgtgctgtgcgtcgattacgtgttatatatatctgacgggaaaagcccccgtcgtggctttgtacagaagagcgcggccaggaaacaatcccagccggattacatgaaagaaacgatatatgcagtaacaaactacctaacagatgcatatctataacaaaccaagtttgttactgcatggatgaggatcggcaaagcctgatctggatcggccaagcctgatccgagcttatctagctaactaacaccctctctcaatcctgaccgtacaaggttaagattgctcttgaaattctccagaagtcttaccgacaatggcttagtgaaaccatctgcaacttgatcgttagttgaaacaaaatcaatctctagaagtttctgacttaccctttctctaacaaagtgatagtcaacttctatatgttttgttctggcatgaaacactggatttgctgacatatatttagctccaagattgtcacaccatatttttgcggccctaggacttttaattcctaattctgcaagtaaggtttgtacccacatgatttctgcagtagcatttgcaatagctttatactcagactctgtactagatctggaaactgtagcttgctttctggcactccaggaaaccagatttgaccccaaaaatattgcaaagcctcctgttgaccttctgtcatccaggctaccagcccagtctgcatcagaaaacccactaacaagagtagatcctgatttatgaaactcaattccaagctgagcacattgctttaagtatctaagaattctttttactgctatccagtgtacagtgtgaggagcatgtaaaaattgacagactttgttaacagagaaagcaatatcaggcctagtgagagttaaatattgcaaagcaccaacaatacttctatattgagttgcatcatcaggacctaataaagaaccttcatgaagagagagtttctcacttactgacataggtgtacatgcaggtttgcagtctgacataccaaccttcttaagtaaatcagttgcatatttttcctgactcaacacaataccattctgaaccttatttacctctattccaagaaaataatgaaggtcaccaagatccttgagtgcaaattccccctttagatcctgaagcaaagctgtagttgccctctctgaagaactggctacaatgatatcatcaacatacaccagaacaaatataattatgccacctttgtttgaaaagaataatgaggtatctgctttagaaccctgaaaaccaagatcaaccaacttcttacttaaccttgagaaccaggctctgggcgcttgctttagtccatataaggctttgtcaagcttacaaacaaagtgtgggttagcaggatcctcaaaacctggtggctgtaacatgtatacttcttcttctaaatatccatgtaggaaagcattttgaacatctaactgtctaagactccatcccttggatacagctaaagacagtattattctgatagtagcagctttaacaacagggctaaacgtatcttcataatcaataccatacctttgtttaaacccctttgctactaaacgagctttatatctatctagtgtaccatcagctttccttttgatcttatacacccacttacagccaattatattttaccctctctgaggaggaactagatgccaggttttattcttaactaatgcatcatactcagattccattgccattttccagtttttgtcctttatagcttctaaatcattagtaggttcaccagaagcagtaaaccaggaatgcttatatttaatagtaccatcagtatataccttctctttgcgaactccactctgaagcctggttcgcggaccaacttgtgtcgcatcaacttctgtcgatgtcgagtcagctgctgttggattactttcacccgtgtcaggcgcctcggctggttctgactgccgcgccgactgccggtgctgtagctgttgtgctgtccccctggatgcagaaccggagccgccaaccagggagcg

SEQ ID NO: 46612 - DNA, 1767 bp, Oryza sativa
attcgattaatgagataggtggctgcctgaaaggcttcatcccagaattttaaaggcatagatgcatgagataaaagagataaaccaatctcaactatatggcgatgttttctctcagctgagccattttgttggtgagtatgtgggcatgacacatgatggataatgcctatggtagagaaaaatgagtttagagattggtattcacctccccaatcagtttgcatggcaagaatttttctatcaaattgtcgttctaccataacttggaactctttaaacttttcaagtacttgagacttatgttgtaaaagatagatccaagtaaatttactaaagtcatcaataaaactaacatagtatttctttcgtccaacagattctggagcaggaccccatacatcagaaaaaaacaagttccaaaggatgtttagaaatactagatgacacaggaaaaggtaactgatgactttttgcttgttgacaagcattacagactgactcgctagacaaatctgaacaaggaagactaaatttattgactacttgcttaacagtagagatggagggatgaccaagacgacgatgccaccggtccaaggataatttgatggcgctgtaggcttgcttcaaggaggattgtggtagggggtacagcctgcgccaagatcttcctttaagaagagttttcctggtgatttgatccttaagaaagaaatagtcacgatgtaattcaagaaaagcagagttatcatcaactaagcgatgtacagatacaagatttttcttagcctgaggaacatataaaacattttttagatgaatattacgactatttggggtatgaacaactgtatgaccaatatgacttatatccatacctgcaccgcttgcggtgtggatctgttcacctccattgtacttctccttcacggtgagtttctccaattctcccgtgacatgatcagtggctccggtgtcaatgtaccagtttgtgtcaacaccataggagtttacggctgcagctgcaacatgtttagcatcaggaacataatcctcatcatacctataccaacaatctgccgccgagtgaccacgcttgaaacagacttggcatgtgggcctcttgtcgacaccaccaaatccgccagatgcgcgaccacggccgcgtcctcctcctgaattgccacgaccacggccaccactagggttaccgcgaccatgactgctgcttcctccggtgttggagcctcctcggttggcgagattcaccgtgccttcatgtgcgccacggtagatggcctggcgcacttcgaagttgagcacttgggagtacagatcactcacagtgatcggttccaccctagcacacacagccgaaaccacctcgctgtatccttctccaagcccagtaattatatactggatcaactcctcttcatcaatgggacggactccagcgattgccatctcatctccaagggacttcatcttggcgaagtactccggagttgtcatgttgcccttctttgtgttggtgagagcgaatcgagtgttaatcgaacgcgctcgagtgtgtgtggagtacatcccttcgattgcactccatgcttctgctgcagtgtcgcaagttgcaacctgcatgagtacttccctcgtcagagatgagagaagaaatcccaaaacttgctggtcagcggcttcccagtcgtcgtacgccgggttgggcttcttcacggttgcgccatcagctgtgacgctgatttg

SEQ ID NO: 46613 - DNA, 18915 bp, Oryza sativa
aaatccacgcagggacgggccgccggatcaaggcggggtggtggcgcccactcctgctcggtgatgagaggagagaaagagagaggagaggagaggaagagagagagaggcgagaataggtaaaaaaattacaatggtgagaaggaaaagagagaggaggaaaaaatatatgtgcaaaagaggagtattttcgcatgcagaccacttaagaggcccgtatatgaaaatttatttttgtacgcagccccttaagtgaaccgcgtgggaaaatatacttatttttgtgtgtagccctttaagtggttcgtctacgaaaatagattttttacatgcgggcctcttaaggagccatgtgcgaaaataaaaatcgatttttgcaggcgtgatcagttacggtccgtctacaatctatagggattattgtatataaaaaatatttctgtagtacagtgtttaaaaagtctaaagcttcaaatcagaaagtccaaatcaacttaaatttgcaatcgcgccatctgagaaagtaaaacaggtccatcagaatcatgcaaaataaatgctttggaacctgtctcaacaacaacggaacattgcttctttggttgggtagccgatcgatcggcgtacggcaggagcaccaaatagcccaaaagcgttaacctgcacttagcattttcacaaattaggtgtccacatcgacggccgtaccaccatatatatagagagacaaaggcatgacggctaccttgcctcttctagcagtaaaaattcgttcagggagaagcaaaaaaaaatactatcaatgtataagcacgtaggagtacatactgttcagcatttcagttgcatctaaaatttaaatttcaaatctctcttagagttatttccgatattttgtcattgtacattattttttagttaaccttactgtcctaattagcaaggtatcgagagatattatatttttcagtgcaaaacttggtatctccaagtcttggatagcttgatttaccaaaattttaagtgtaaaattttagtatgtacacgtacaatctcaaaaatcatgaaaaaaaaattcttattcttttatattgacctttaagctgtgtttgaggtgagatgagaacagaagattgattgagatgagatgagaacaggagattgagaagatacgtaaaacgaggtaggccattagcacatgattaattcagtattaactattttaaatttcaaaaatggattcatatgatttttaaagaaatttttttattgaatttttttttaaaaaaaatacaccgtttagtagttcaggaagcgtgcgtatgaaaaacaaaacaaactcacaatctcccaccgctgaactgagcctactaagaacatatatataaaagtttacgcataattttatttctaataagcggttacgggttataattagctgtaggttacggcttatatataatactacctccgtcctaaaatataataacttttggctatgaatcagctaaaaatatttatattttgggacagaggtagtatatatttaatcacatgtgggcaaaataatactagtagtaagattgtgataactgaatcttaaattcaaattaactagtaattgcttcgtatgatgtgagtttcagactgatcagaacttcagaaccgatgcttctgattaaagatgcggacgcacaagtagtaggagtactttctttcactgaaacctgattctggagatgtaccaacttgtacttgcacattaaaataacgagagttgttagcatttctgtatttacttcagcttgtcacctgcagctgcaggcaagtggcttcttagcagtaatggccacatcggtatccatgtgaccagcatccatagctagagagcttaattaccaagctttatactagtacttaagaaaatcacgggattggcttaatcaccttaatgacatggttcagtggctcaagctggtggccgtctcatgaacacgtagagatacaactaaggaagaatcgcaagctttctctttctgttttcttttcttttttatttgacatcgatcgattcttcgtgcttaaactgtagacgaacaatctgcaccactaactctaagaaccttttatatagctttttttttcaaaaaaaaaagtccaattctcacaaaattcatatgaaattcctctgttccaggaggccatagattccccacaacattatatatgatcgatcaattaatcaatttatcaacccatcatcactgatcggcaagaactctgcaactaattaacatctcgatcgatccaagtactgatcaggtgatacatacatggattgatcaaaactaatggtatctctctaaaggcagatcgatggatcgatcgatcgaaccatacaataatggtggattaataatcgattcttgctttgctttcttcgtcgtcgtcgtcgtcgtcgtaattgagccgtgtgcatggtggttgtagcttgtagtatacttaggtgtgtgatgctgatgagctcggcgttcttgctaggtagctagaggctgtggtggctatcgatcgatcatgccgccgccaccgtgccgccgctggtggtggtcttgctggagcggcggcggccgttgggcggcgccggcgcctccttcttcatggacgtcaccccgcacttgtcctgccactcctcctgcgtcatgtgctgctgcctgcactccaggctgcagaacgccgcctctcccctgcgaagcacacagtgcgtgcgttagccgggcgccatggatgaattcatggaggaacaagaagaggaggaggtgttcgtacttgtacatgaaggtgtcgcggccggggccgaggcggcggcggcagaggccgcaggagcggaggaacgaggcggtctcgacggagcagtagtcggcggagttccgcctcagccccgccctcgccggcgcggcgcgcgcgcggtacgccgccagccagtcctgcccaggcgcgcctcctcctcctcctccgccgccgccttcgcggccgaacgacgccagccagtcctgcgccccgtctccgccgccgccgccgggctggcccaccatcatcatggcctcgagatcctcaccctcctcctccaccaccgccgccagcacgtccggcggcgagaactccgtcatgctcgtcgtccgcctcatcgggttattcttgctccctcccctccccctcttgcccaccatcatcaccaccacgcaggcgagcagccagaacgcagagagacggcctcctcctcctccttctccgacgacgacgacgaggcggcggccggcgacggcgagcgtgcgggcgcgcggcgagcgtgtgtggaggagaggatctgggaggagggggtggagataaaagaagcgggagggggaatctgggccgtcggatcgggatcccgcgatccgtcggatccacgtcagcgcggggggctcggctctgcactgattgttcgttctctcgagccaattgtgtttcttttgttcgcgactgatgattgcgtttttgttcgcatcttggctcggtcggggagctgtcgatgcggaatttatttaaatttttattttaaatttattggttggttttgtattatatattggtagtggcactaccaacatttactagtgtgattgggatatctcataaatggggagaaaatttgtgtgattgagcagctcgatgcatgaaagctgagtctggtgtggggttctttgtgcgtcacataccagttgtcatgtatgtgcaaccaaacttaattattagggctccttaagatttttggaattttaaagggaattgaaggattttaattcttcgaaaaaaattcatgttagcttctttggaacaaaggaatatatggtctgtttggcttgctgtcttgctatgccgcagccaactgcagcagcaagcagcaaaaccgtgcataacgtgcagcgtaactatagcaatagctatggaacgtgcctctaaaattcataagtttgtttcataaaaaccattcaatgcgctaaataaatatttctatgttttcaaatcctataggaataaggtggagtaaaaaatatattcttgtgtgttttttaatcattgctccaaagaagctgttaattttttttatggacacagtacaaacgtaaatgctaacaacgtgcgcatactcaccacaataaatgtagcatatcttgagattgatgaagttcacacttttacaccctaccctatggacacctccgaaaaactaggctagagattgatgaagccatcatggatggttcgctgttgataggaatatcgtttatcactaaaagaataactagtcgtagatgtaagcatccgcttcaaatctattacttgaaacagggtgagtaagttccaccacaagaaaccaaagtctaaccagttaaactacacatgagtttaacttgccaaaaagtcatttgtcacagtatgcctaactaccaagatgataggaaaataatttactcctcggatctcacaggtcccttcaatcatataaatgcttggtgccttttctttaaaacaaatatttagccaaaattaccaaaactcgagcttctcctcttattttctgaaagatcacatttggtcgtgtaggtttgtgtacatgaaagatgacaatattactaaaattttagcatgatttcttatgtatttatcaaatttggcaacaaactaaacgtagccattttttttacaacttttaaaaaaatggtatggttaaaaatggcatcaaagtgaactagcctttaattgctcaagtgattttcaagaacttttgtttaggtttaagtctgttggattaagtttttaagttagctttcttggttaagtacctaacttttggtttaacagcataatattatattatagctttaaaaacatatgaaaaagttaattatttttaggcttaggtttttaagttttttttttgcctatatgatttataagctaatggatttaaagttctaagtttaatggtgaagttataactctacctcacttaagaaaaaaaaagtttctccaaatagtgtaagagtggcttatgactttaaaaaagtgaaatggaaaagctacttgtttatgtatggttagacttttcgactcataagctagcttataaatctaaataaagatgaccttagactttttttgttgagaagtcagcttataagtctaaacaaataggacctcggcattgttattgttagtatgctaatattccctcagacgcttttcctataatataggaacattataggaacttaagattaaatttgatacggtatatcataggtttgtttagaatcgttgtagtataaagtatttcatacgatttataagttgtgatattatatgatggagggagtactaattaatttcataatcatgattcaatttgtgattctttgatatattttggtgggaagagattctgctaaatgttttacacccttagaaatctcaatgaggtctgttttttctgtaaaaacgaaatgcaaatatcgtgcttggctgtttggagcgttcacaacgacgttgtgtcactcataagtgaagtgcaataatgaagtgacaggtattatattgcttataaaatatttttgcgcacgaaggacctgttcactttggtgccattttcaaccataccattttgttttaaagttgtcaaaaaaaaaagggctacgtttagtttgttgcaaaatttggtaaatatataagaaatcatgccaaaattttaataatattatcatcttgtcaaatttagtaaagtttattttggctacgatctgatccggtcctaaaagccacggcataataaagcgcccccagggaatcgggatagtgggcccggcctgagctggacgacttggaccggtagaatgtcgtgggccacgcgtggggaaaggtcggcctccagcgcccacccaaatcgcttgccgcacgcggccctcgcgcacacgcgggtttcactgggcccacgcgtcagccggtgtgggtgggccgtggggtatcgtacggtggtcagctcggccgctgtagcgtcgtcggttttgggaaggcaggacgaacaggaacagcgagagtggggcccacctgacgccgagggtcccacacgtggcgggcggttataggtgggattcctctgggcccacctccccttgtgcttttgctggattctctgtggaaaatgccagtactacagtattgtaaggtgggccgtctcgcttggtgggcctgtcgagcaggcccagcccaacgcccttgcaggatagggccactttcgataggcccaacgctaaaagcccaataggacacttggccccgctcggttccaccacccaccgtcgcgattcctccgcgactcctccgccgcgccggcaatgagcgaccccggtcaccaccacgggccacggcggcattgtaatgctgaaaaatccgcagaaattttgccagaggaaggatttgaatcttgcattgctctcgttatgcgtagaaaacataaaagcctcatccgttacgacaacgcaaaccaaatttcggtttcgttgaagcctgaacttctaggatcattggtgggttgagagtcgtttcagcagagatcgccattggactggtgctgcatctttctcaagctcttacagctatgccttttctttttcctccagcacatgcaaaagcttcgtcggtatattagaaagaaaacaaccgagaatggttctgacaggagctcggcaatgcttctgtgatcgctaactttagcaacctcttatatatctatatatctagcatatttctctaacatgttacccttggttcatttgtccatggaacctgaacatgttggtgaatggtgattacaatcatacggattgagtgaacttgtgtcagatttgaggctagcttagggtaacctgttgttagttgatgcatatctgcattacttttttaagtttcttcattgtttgagataattgatatgttctcggaatacctcggttctaaatatttgtcactatttactgttcatctccaatgtaaaaccatggagattctatattgctatgccgtttccaaaaaggaaagaaaaaaaaagagagagagaagaattgggagatgctacttggagtgcaagcaggaaaggggatcattcaacattgtcctgtcatctccctgctcatgcctaatgtcacaacagtcgatcgtaatatgggatttcttacagctcgttcatccatccatctagaaaccatcgagtatatctaccgcaacaattagaaaagaaaattttcccctgcttgtgagccattgtagctttggtcacattatttgactcttatttgccctcgaatgctataccaggaggttcagttcagaagtcatcctcattttatcactgtaattggggtatcttgagttcttaatccattttagagtacagatttgtgatccaatttagatgtacacgtgctttagtaaaaaaaaaacagaagcaggtaggaggaggcaacaccgcaacaggtagcagaacagatcacacaacaaaacatccacgaattgcaagctgggaattcagaccgtgacgcaggccgtgacgccgccgctgcggtcaaggatgagagaacaatctggaactgcaagcacacaccaaaattaagtactaaaattcttgactgccggagagatagggtgagtgcgtttggtaatcgtgtgtgcacgtttgatgaagcatatcatatccttgtcgaaaagaacaaagaaaattaaggaagcacccgcctactctgtattagcggacgcaatatcacagcaagaaacaatctgtatgtaaattttctcctagcaggtaaaaaactgatactcgctccgtccctaaatatttaacgctatttattttttaaacatgtttgatcgttcgtcttattcaaaaaatttaagtaattattaattattttcctatcatttgattcattattaaatatactactactactcaagtttttaataatattcacaaaagtttttgaataagacgaacggttaaacatatttacaaaagtaaacggcgttaaatatttagggacggagggagtacatgacttacttatcttttgctaggaatagagagtaggcagaaaatatataatgtaaatcatagcgtgaatttaaaaactatagtaggtttttttttaaagaaaaattgagaaattcccaagggtcttccggctagctccacaagatggtgggctagatgacctaggttcaaagcctcaccccttctaattatttgatattaggtcattccctaatattcgagttttttttaaagaaaaatcatctgtgatttattcatgtagtaccttatagtgacgtagataaatcttaaaattttattttcttattattctacgatagttgtaaagtttgcaacaaatatttttcccaccattgcatataggtaataatcacttcatgaggtgttaaattctggctattatccttggtgtaaaataattttggaagcacatagtatgtgttatgtacattttgtattgcctcgaaccatctagtacaacatcctaacaaaaaaatatataacgaattttagttatgcatttgtattgtcaaaatccaaatgcatatatgtatatgccaaaataggccacacccatgaaccaggaagcctctttttggaataatcaacggactcataacagtcactgctgacgtaagccacacacatctccatcgcctataaaagctcacctgaacaacctccaaatcacacacaaaacgcagaagcagctagcttcactgatccacattactaccagcttcttcttccaatcttcttctccgacgagcagctagccagctagcggcgccggccggcaatggcggacgaggtggtgctcctggacttgtgggtgagcccgttcgggcagcgttgccggatcgcgcttgcggagaagggcgtggagtacgagtacagcgagcagagcctcgccgacaagagcgacctcctcctccgctccaaccccgtccacaagaaggtccccgtcctcctccacgccggccgccccgtctgcgagtccctcgtcatcctcgagtacatcgacgagacatggccgccggagccggagaagaagaaggagtcgccgcgtctcctccccagcgacccctacgcccgcgcgcgtgccaggttctgggcggactacgtcgacaagaagctgttcgactgccagacacgcctctggaagctcagggccggcgacgccgcgcacgagcaggccaagagggacatggcggaggcgctggggacgctggaggcggagctcggggagggggactacttcggcggcgaggcgttcggctacctcgacgtcgtgctcgtgccgttcgtggcgtggttccacgcctacgagaggctcgcgggattcgccgtggcggagatctgcccgcggctggtggcgtggggggaacgatgcaaggggagggacagcgtcgccaagacgcttactgatcctgagaaggtgtacgagttcgcgctctacctcaaggccaagtttggcgccaagtagagtgagaattccagatttggtttggttaacaatcgcagcgtatgatctatatctattgttactgtatttggttatcgcgttgtgattttgctcctacctatcacctgtatgtatgtgcttgagcttcacgaataaattagaaagtgcagttgtgtactcgtgtgtttgaattgcgcgctctgtttgtccataatcaaaacaatttaatgtacttgtttttatgggtcgtcgtcgaatcgatctgttgtacgaaacgaagggatatgcccggagaatgaaatgcaggggtgactgcagcacgtgcgacacctcgtcctcagtcctctcgtgaggtaggactttcggggtatcaagggtagcctagcccattacatgaagcccactaagccgatgtgtgcatcgggcagacgagtttgggctgtgtcaacctgaccatgggccgcacgtgcgttacgttcttattccgaaggaaaaagaacacccgaggtccctcaacttgtcatcaagatacaaaatcatcctcaaaccgtaaaaccagatatcccacgtctcttaactaatcaaaaccggttacaaaagatccctcagcggttttgataccggtttggtcctacgtggctgctgggtcagcgtgggacccacgtggaccccacatgtcagggtaatccacgtcatcaccctccctttttctcctcttctctctttcggggagaggcaaagcggcgggtgcagggccagaggccagcaggagaggcgggagagaggagggcgatggcggccggcgcccagtggtgggggctgcagcgggaaacacggcaacgcggcagccccgacggcgatgtcatcgactgcgcgccgatgcacctgtagccatccggttcgggatgaagcatccacgcgccgccggcgtcatccgctgcgactccaccaacgacggtcgcgaatcctcttgctcgcgcatgccgaggcggcctctgtgcgagcgcgttcggctgcccctagcgagcggtgttagcctctgcttcgcggcggccgcgccagaggccgtggacgtcccgcggctggtgctccacttcgacagctctgtgtcatggagtagcagagctcgagcacgggggcagtaccgtagagctcggggattacgtcgtagcggaactcgaacccgagatccacgcaccccttcaactcctccaggttgtcgtcgacttgtcggtcaagctccacgcgtgccgccgccgccgccattgttcccgctcctcgccgtacatgcaccgccgccgaaaacgacgatgccgtagggctcctccttggccaccaccaccggcttcgtccgccgtggccacgccgcctcccactataccccgcaccacacgtcctcggcctcgacctcaggcgccgctgccgctccgcccaccccttcgctccgcccgtggcctgctgtcgtcgtcgccacggtgctctgccagtccttccgcggctccaacacctcccgtttctcccgcctccccttctcgagctccatagccccacagatctcagcggcgagctgtgcccagcggcgagaggaccatcgccgcggccgtgcaaatccggcagctgagcggcgagatccatacggtggcggaggaggaggaggagaccgggagattggccgcggcacgccgctcctctcccgcgagccgctgcgcgccgctcctcttccataggccgccgcgtgccgctgcctcctcgcaggtgaagactcggaggtaatagaggtagagaatggagaggtggacaccgccgccttgccgctcctgctcgcccgttgccatcctcgtcgcaccgtttccctatccaccacgtcgcgccgctttcccatccgccaccccactgcacggcgccgcccctccgctggttgctacctgtctcctcctccccgtgcctctgccgccgcccaactccaaggcctcccccactggcgtcgcggccctcgcacggccgccgaggagctcggccgggttgccgccgccggccgccgtcgcggcgccgccctcctctcccgcctcggcccgccgaccggccttaggctttcaagcacacggagaacgaaatgagtaaccgaggaagagaagagggggagagtgactcagcctgataagtggggcccacgtgggtcccatgctgactccgctgccacgtaggacaaaatcggggtcaaaaccaccgaatgaactattgtgaccggttttgattagttaagggatgccggatatctggttttgcggtttggggatgattttgtaactcgatgataagttgagggaccttcggtgtacttttcctattctgaaatagcgggcccataagcctctctgtttagaccaactcgtggaaagaaaaagtccacttttccccccaagtaccgcaagctgagacatgacgcgaaaatccgcagattactctttatttaacatataagtagattcgcgggttggccgcttgcatccatactgacacgtgggcccacgtattttgttttatttttaaaattgttaaattttgcttcatatgccacagaattgccacgtcagatgaaaaccgagtcaaattagccacataggggccacgtcagctaaaactgccgtccaaactgtcctagaatttattttgcaccggttttgacagttgagggatcccttgtatgtggttttccggttgaaggactaagatcggatttgttaataagttaagggacataagatgaacttattcctttcctgcccgacttatttgcagaaactgcatgagatcgagcccatagatagttagttgtccattaggcccatgtctaggaatcctgcttatgagtttaataaaggaagaactgtatttgcctccctcaactacacgtcgagatcgattcgtatccctgaaccacaaaaccggttacaggtcttcctcaactgttaaaatcagataaaatccctaactagttctgacggcggttttcctttaatttcttgagaggaaagatagagtaggagatatagaacaaaaaccctcaactaatttgagattatctccacgggtttggttaaatcggacgcgggattagggtggcgtcgggtgtaggctggctctagctcggctggagctcgaagaagttactgtagcgacattctgggacttcttttcctaggcccgattgaaggaggacgcaaactggactttaacggagaaagaaacaggaaacagagaagagactaagggaaggagtctggacttttccatattcagcccaaacctgaaagtgaggattttgattccttttttcaattaaataattgctgaaatgatcttttatttattgtgtgttcatgtttccaaaccccagctgtatcccatctgtgttggcacgaagaaaacagttcggtttgctggccggtatgagatcatgacttggataaatctaattctaattataaagatagagcttatatttgataaatctacatcattatatttaaatatggaccaaaactttttctagatcccctatgatcaacggtgtattttttctttcaattaatgtgttgatttctaagccacaaatatgaataaatatttctttattactgtaataaaataatttataaatatatggaaaaaaacatatatgcggtgcttctacacggaaagaaaacatatgtaacaccaggttatgaaaaataatgtcattttaaagttatttaatattttgtgtacttttattttttttctttttcgttgcaacgtacaggtaatttttaccgtagatatatatatactcggtgtattttgagatttagacagtaaaggattttcaaaaacgaatctggaggaagggatacgctagttaattaaatgtttacatataagtcttatattataaaacatcgaaaacgatagtacacactggtggagaaactatctttggtcgatcggcctaaatccacaatagtcccggttcgactaaaaaccgggactgaaaatctttagtcccggttcaaaagacggcaggtggtgtcagacccctcctttatctttagtcccggttggtgacgccaaccgggactaaagatatatttttagttcgggttggtgttaccaaacgggaaaaaagatcgacatgcgccgcgcgagatcgagaggaccgaagctcacgggaggatcagttaataagttttgacatttatctcctcctcttctcactcaccccatctcttcttctacctcctttggatctgcccctcccctctcctccccacttctcaggtggtggcggcagccgggcggccgcggaggcagcctcgcgcggccgggcggcgcggaggcgaaggcagcctcacgcgccctcatgtggtggccgggcggcgaggcacagcgcgtggcgtgggcggcggggccgcgcacggggcggcagcgcgccggttctcctctttttttttataatttgtgattgagagatgtataatttcttttttagaatttgtgattcattgcatggatctgagatgtataatcgatctgtgatgcatttgatttgtgtgtatttttttaagatttatgatgtatttgatttgtgtgtaagtaacttaggatttgtatttgtgatgtgaatgatttgtgatgttactttgatttggggatttggggtttgatttaggtatatgcatgacactcgatttggggtttgttgtttgatctgggtataataaaaagaaaatggaccaaccgggactgcccctatcctctcttatcctctctttagtcccggttggtagcattaaccgggactaaagagttagtccgggttggtgttaccaaccgggactaaaaattgatttttactcccggttatttcatccggggtcctggaatcgtaaccgggactacagggggttataaaccgggagtaaagatggtttctccatagtgacagtatattttgaaattgagagggcgtagcttattttcgatgacagtaaccggctgtttgttcgtcgatcgaggatcgttgtcgtgctttgtgggctcgttcctgtcgtccatcatctagaaggacggcgtcgtctgtttttttcaagggaacggcacttaattggtctatcgatttttagcgtacacgtgaacatagatccaaataaacgggcaatggacataggacttgctcccgaagaggccaaacaccgtctactggttcggatcgatatctcgcctggtattgcctcgtcagacggctgaaccacactatctacaaaatcggtatttttctcaaacggacggtacaaccacgcacgaaaatcgattccacgaatggtcaagttaagccacccgcgtgcaaaacaaaataataaaaaaaaaatcctagctcccatctatactaccgcaatccgtcacaatcatcatcaatgcagtccgccactgccgttgtcatcgtcgccgctgccggagtccactgttgttgtcgttgtcatcgctgagactccacctcacgtcctcacctgaggctggcggcggtggatccgccctagcctcccggggtcgaggccaccggatcccggaaaggatatttatctatcgatcacgtgcgggatcggaccgcgatcagatcgaagtcccataatcccgcgcgatcagcccccctatactcctccctcttctcccccttcctcctccccttcttctctttctactacagtacaccataatttttttaaaaaaaaacaaaagttagagaaaatttatgtatagaaatactatatataaaaaatttgaattcaaattcaaatttgaatcgggtatgtaaacttttgacttataaactttgggtctataaactttaggtgtataaactttagatgtatagaaatactatatatagaaaatatttgaattcaaattcaaatttgaatcagatataattcaaattcaaatttgaatcgggtatgtaaacttttgacttataaacttaggtccataaactttaggtgtataaaatttagatgtatagaaatactatatataaaaaatatcaaattcaaatttgaatcagatatataaacttttgacttataaacttttggtctctaaactttagatgtgtaaatttgaggtgtataaactttaggtgtataaatttactaaaataagaaagtaatgcagtgccaaaaaagaaaactaggtggagggagggggggggggcgaatctgatcgctacccccattgccagggcgatcgatcgcccattagaagcctccactggatccaccaccgcgtggcttgccgctgttgtgatcgtcgctggcattgaggcccgctgcacccgaggccaatgggcggcgggatccacccctcttggctctagggccaccggattagcagttgcgcggcttgcctttgtcatcgtcgctgctgctgaggcccactaaaccctacatcgactcgattgatctgttgccgcgcggtttgctagcatcattgtaatcttcgcgtgctcctttgaaggcaaactgccgccctcttgccgtccgctaaccacttgcggagaccgccattcccgtcgccacgctagccacaggctcgcttgcacgttcgtgatgaaggagagaagaggagacaggggagaagaggaatgatgagatggggagtaggggatgaatgaggaaagacttaattaatgggtaaaggagaggggatggctaatgtaaaatggataggtgggtctctttctaatctgtttacagacggatttttttttacttcgccaacgaaaaataatagcttggtcgcaaaaattgtttttttatagtgtgactggattattatggctggtttgatcgcgactgacaatgactcaattttggtttaccttatcatgtatacgcgcttgatcggtggactattaatggtaaagccaaaggattaggtgatcacacaaagtattttatactgaacgaattgaagacttaagtcatgattctctccagtcatttatgtgttcctctcatctgtatatgactccacacctgtatatatgcagcgggcctgttatgtagtatagatactaactcacatcatgcaatgcatgcatgtacttgttagctcaactaattgcacaatgtatcgccagactcgctacctccacgtacccatatatatatatatggccatatgcatgcaatggacatgactgtcacgttacacccttgcacacctagatgactatattgctctttattgcttactttgagtcgatgactttagatgagtcaaatacaaattccatttcatgcactatcgacttgtcactgtggttgaaatcgggttggatacgtattctcgtatttatagcccatattttcttcaaattcgaaaatggcgcgggtaggagagaaaaatggatatccggaatcctagttcgaatttaaatctgaaaaaaaaaggttaggataccgaaaaaattatatccttctctatgtcctatactccctccattccaaaatataagacacaaccatctttaacccaaagactaagaaataattattattatcttatagtttggatcctttaataaatatgtattgcatgcatccaatagaattagagaatgtgagagtgaaggatttaaaaaagtaataatttaatggagaagatgtcataattaattgcatgtatgcattcatgtattatattatggaacatcttaaaaaaatggttgtacattatattatagaatggagggagtattatcaaacatatatgaaaaatactatgaaattaatctacaaacataataaaagattgattaatcactgttttacgagctcacaagtaatattgcataaatttttacttgatgtattttttaacactaaaattgcctccctagatttaatatttatgaattagatatacaaataaatatccgtttctgaatccaattctgaggaaaaactatataaatagagaataggatacgagatgagtgatatgtagtactattcatacccgcgcctgggggtgaaataggatatgtatttctaaccgcccaacccagggcctgtggaaaggttagattattacctcacgcttagctgtcatgattttaggatttaacttattgtgaaaattatataataagtactccctccgtcccagaatatagggagttttggagttggacacggttattaagaaagtatgtagaattaaatagaaaggggttgtgattggttaagaagtggaggtaggtgggaatagtgaatggtggaggattgtgattggttgtgaatagaatattgagagagaagttgttatattttggaacaaatcctaagtgttaaaagttgttatattttaggacggaggaagtaactattttttaagtctagtttttgagtgacaattggaaagggagacttgcagattgaaaagcatgcatgcatcctgtcttcgctgaaactatagtccacctttttatttgctgcatcaattcaaaaatatggtaaagccgcgtgcatattattgtgtgtttatccactaatcactattgtcttattcccttgcaaacaaaccaagtcaagacctctatatcaaaccaccgacttaatttttcttgaggatagtacgtcacacaaggagcttaactagaataaatggtactcctccatctgaaaataagttcatttataggtttctgtatccaaaacttgattgtccgtcttatttaaattttttttatgattagtatttttattgttgttagatgataaaacttgaatagtactttatgagtgacttttttttataaatttttcaaataagatggatagtcaaatgttggatacaaaactcacaaattaacttactacctccgtcccaaaataagtgcaaccgtggatatccatgtctaatttttgaccgtttatcttatttgaaaatttatcaattttttttaaaaaaatagtcacatataaagtattattaatgttttaccatctaataaaaaaataataatcataaaaaaatttaaataagacaaacagtcaaacgttggacaatgcaaaactgcacttattttagaacgaaggaagtactctacaccaggcctataaataggggcaacgtcctcctcggctcctcatccctctccaagtgatctccagagtgcagacaggacatagcggtattgcaatagagctggtcggtcagttagccaccatggctcgtcgatcaaacccagcactgatcagtacccttt

SEQ ID NO: 46614 - DNA, 1330 bp, Oryza sativa
aagacacaagcccaaattaattaagctgacctatatcaatacatgttgacgctgattcttttgcagcctgttaatttcaactgttccatgccgtccgcatcctccacaagaatccttcatgggacacgttctgatgactcctcgccgccgccgccggcgtcaccgcccagctggtgaccatgatcatcatcgtgttagctgatcttgcggcggaccagaggaagaagaagaagagcggaagcatggcgccccttctgatcgtgctgctgctgattgcggttgctgctgctacaggatgtgcagctgcagatgcgagaggctcacgctgcagcaacgatcccaacttacccaggaggatccgtgcttgcggccccccgtcaattaagcctcacaactagtatacatacgctactgtgagctcgatgcagcacaatatatactactaaaataaagcttgtgctgctcatatatactatataagtaccaatctcgatcgcgtctatcatctaaggatattagtggcccactggcgcgcctaaaacaaattaatactttgttaattaatgcctcatactaccttgcatcgatagaagcttaatttctcacatttaaataaggtatggcacttggatgatatgtaattcctgcattatttcagtcctcttagttttctccattctcaacgtggatgtgctgcattattgtatgtgcatcatcaacctaaattcggaattctagtagctagtgccgaacgtctcgaataatggtacaatacacacaccgacaacatcaaataatggttcatgtatataagatcgaaatggttataatatgaaatggggagtgttatcgtaatcgaagccatcctaaacatatggatctaaattaatttgtaacctgcattttggagaagctacctgatgaaatgttcagagcactgaatatactttctacagcaaaacaatagaggaacaactcaactcaaaagggcacgattttgcgcacaaacacatgctcagctcaatatatatcattaactccaatgtaagatccgcaagagaatagtctaatgggaggtaaaggtaccactaaaattaaagtatttatgtggttccttaaaaaaataatcttaacgaaagataaccttataaagagaaaatggaggggaaacaagcaatgttgttttttaatacacaagagaccatccaacatctctttctttgactgtcatgttccacgttttgcttgacgatgtgtcttctttgcttcaatatcccacctccttacaatgcaaaagatattattggtaacttgctaagggggctgcagg

SEQ ID NO: 46615 - DNA, 7089 bp, Oryza sativa
tgtgtgcccatggacagagaccagagatgttatccatttcattatataaagaaagctcaatatcatctgcgtttgccgaccaggaccttcatggttggtggagccatccccaggccaacgttgtcgacgcagtaaatctgcgagcagcagcttttcccatagttgtttttactatcgtcaagatgaagccctcaccgctgtcgtcgcaaagacaaagcccgacctcaccaccgaggcttgtcgctacctgatctattagtaccgaggctcaccgccatcattctgctcctcgtcatctaaatactgacgccccgatcgagctcgtggcggtgacggtgtggctatggacatgaatggtggtagcaccgtttggcaatagtacgacagttgatggtggcggtggcctattgagaggcactactacataaacattttttctgtaggaaaatacatgtatattacaggcggactataaccggttgtgtatgtaaaaaatcgacctttattttcacatacaactccttaaaaaaatctgaacacgaaaatgtattttttaaaaaattcttatgcactcctcctggatcactccccttatcctctccactcatacctcatttttccttatcctccctcatctgctagcagcggtgggctcgagagcggcgatggtgagtgggagtgccgggagctgcacagcatttgcatgtcgcttatccgagcgtttgcgtttgtacaatgtttcttaaaaaaacaatctcttgagctaggtgcctttgaaaataccactattttcacaggatgattttttcaatataatagatacagaaattaatattacagctgttttggatctacaggacatctctttataattataagcagagttgtttataacttctatagtttaatttttaagtagtgcggacatctgaaagtatgaaccgcaactggcaaattaagtcaaaagagagcagcaatgctatcttgaatgatatattagtcacaaaggacaaaagcctattcgtctccatttcaacggaggaatatttagaagagcgtcgtcacgtgaacacatctgtgtggagaccggctttagaaagctctccgggcgtccaaaagaaaataaaaatccacgtttctgtgtaaaccgggctgagtcgtttgtcttattaactaaacttgtttaaatataatcgtatgttggtcctaaacaagacccataccctcgttactccgtcaagaacgctgcatataatttagttatccgctcgaagggtttgcacgcgcaacagatacaattaatatttattaattagcgtcacaagaatttgtcttaattacccgtaggcacatgcatgtatgtgctaagctagcctgtaaagcaagctttggcttcaaataattataatacgatagtatcatgttgaaactagcttaattagactcaggttttcccaattaagtcagggccacttcaaggtaccgatcaatttacctaacttttgacattaatttgatcgtgtgatatcaatggaggatttcccgtgcaattttggatggtctcgttgaattggatttaatatgtgcagttctaactttttattttcatatacacaattatattatgtatatatagatataaaaattaggattggactgatataaatctcttttcttctgtttttatacatacaattataacttgtatacaacctgaactatcaatctatacctatactgttataatttggccccacttcatctgatggattagattatttttttcgattaatgttatattgcttttagtatttatttatagagtgaatgtggtgagcccatttgaagactgttttaataatataatagatttagataagaatgtcgagagtgtgtgtgtacatatatatatgtcgatccagctttcattagtatcaaagccaaaacagggttcaacgagtttacagaaagataaaacttaggacttaaatttccgatcaggcatactttcacgtcaacttgagaagacaccagaactaccgaggatagagacaagcgtttataaatccatatgagagatgagatatgtaatatgttctaccttctacgattacgattgatccgattaatccatgtaacaagaatctctcttcacgccaaggagataataaaaggcttaaggcggagcactgtgtgatggatactacctccgtcttaaaatatagcaacttttagctatgaatctgaacacacagttgtccagattcatagctaaaaatgcttacattttaggacggatggagtatatatatccgaaattaactctcacttgcacgatgcaccggtcgaaacggtttgtcaaacgaggttctactactatactccctccgtttcaaaatgtttgacaccgttaactttttagtacatgtttaaccgttcgtcttattaaaaaaattatgaaatatgtaaaactttatgtgtatatgaaagtatatttaataatgaatcaaatgatatgaaaagaataaataattacttaatttttttaataagacgaatggtcaaacacggtgtctattttgaaaggagagagtacttcgtacgcgtgcggaggtcaaaatattccaccacttgctgtgccattgcacgccaacatcccgacaccattacatatatttgtcctaattgttttgatcattccattataaaattaaccaaatacagcaagcagctagctggggggggggggggggagacgagacgaccgtcgtgtctctatcttcactatgtttgtctgggaaaaaacaacagactgaaaaaacaattaatcttgattcagacagagatctcagctggatggatcaaattactcctcccggtctccacgtatagacgtacgctaataaacactagctaagagcacccgcaatggtaaagtaaggtgctatctataaaacatgtacacctcaacaatagactagattaatagtaaaccacttcaatggtatgtctacatgggtatctatagctctctaatccattgcctcgtttttctctacagactatctccatgttagtagatagctttgctctctctcttcatttaatctcttccaagtaggaaaatatgctgacatggatctcttgtagagagcttatagataaccattgtgggtgccctaaccacaaccaacatcatcattcagtacagtaccgacgccaagatttcaaacccgtagggtcaaaagagggccgcataagtatgcgtgtaattaagttccagcaggcaattgtaatttgcatttttcagttttgctagcttgttaatttcagtcacaaccagcaggaggacgaaatcgtacttgatgtacacgtacgtgcgacataaccaactgacgactagtacttgaggtcactcggtatgaactccacggtcatcacacgtaacgttaacgcacgcccactactcattactcatcatttagttaattatctttatcctggaaaaaaaatgaggggtttgttttactacaaatcatcttaggaatcctacagttgttggcatcatatactccctccctttcaaaatatttgacaccgttgactttttaagcacacatatgaccgttcgtcttaataaaaaacttttgtgaaatatgtaaatgtatatgtctacataaaaatatatttaacaataaatcaaatgatacgaaaagaattaataatgacttaaattttttaaataagacaaacgatcaaatatgtttaaaaaagtcaacggcgtcaaatatttaaaaacggagggagtatatgtgactcgtcacccgcgtaccatattccttcgattttgctagatattggtcatcaaatttctccccctaatatttgtcgtttttctgaccataggatttgtgctacgattcgtgcacatatgggggtggggatgcagctgcgtcaagtgtaatcagaccgcgcctgtagtcaaatttgggccatccctgtcaaatttcgggctccgcgcttttctgtccatagccgttgtgttttcctcaactctcttctcgctctctttccttctctttttttcttttctcttcagggcatgtttagtttccaaaaagtttttcccaaaaacatcacatcgaatctttagacacatgcatgaagcattaaatataaataaaaataaaaactaattgcacagttaatggggaaattgcgagacgaatcttttgagcctaattagtccataagtgctacagtaacccacatatactaatgacgcattaattaggctcaaaagattcgtctcgtggtttccaagcgagttacaaaattagttttttcattcgtatccgaaaaacccttccgacatccggtcaaatgtatgatgtgacacccaaaaattttcatttcgcgaattaaacggggcctcattgttccttcgattttggaaaaatgtttggcactatcgtagtacttcatcactgtatcgttgtgaaaaatcggcccataatctcaccatttccagttcggcctatttgcaaaaaggaaaaggttaacttttcatccctcatctggctgagtttcaattacttccctcaaccataaaacgagcataatgtatccctcatcttctaaaaccataaaatgggtataacatatctcttatcttctaaaaccagtgtaaatattgagagtgattttgaatgatgtggcgctgatgtggcactaaataaaaactcatgtggaacccgcatgttagtgaaccaaccactctcccatcacccacatcacatgtcagtggcccctcccattgagcacaacaatgttgcccatggcttacgaatatcagggtttacattaccggttgacaattaaatttcgagccccatcggtatcacggttttcgataaatttcgaccaaatctattgtttaacctttgaaattccaatcaaaacttaattttgagccgtgtagaaacgtcgaaattttgcggaattcgaccggttttcgtcggaattataaaccctgcttacgatgacttcttcaagggctgccgctagtcgtcgctcctgcccaccgaagcagagcgtgcagagttcccatcgctgcctctgcccccgcagagtttgcctgcggagactgccaagatggcggcccttcgtatcccgtcagggcagcggcgggaagagcttgctgtgcagccgctgcttgaggagctcctgcgcttgatcggcctcctcccacacttcttctcatcttcgtcgtaggggccaccatggccaaggaggccatggcgcagtcatccccatcgatttgctccctctgcttgctcacctgccgccaccaatcgagttggaagaccttgaggagaaggcagggaaaccaagagaaagagggtgtggaggcggagggatatggccgcgtccgtacccgctcgctctccaatatcggttgccgatggtttcggtattcacccgcatcgccactcttgccaaaccaagcttgcaccggagttcccactctggtttctagtgccccggtgccacattggagcggagcgccccatcccctccattgcttcctcattgacgcgtctacctgctgacaaaagatgggagagagggacaaggtagaagaggaaaagcctgcgaacagagaggatgggatcatgggacaaagggagaggatagaagaggaagaagttgatgccaatgatatgtgggtcctacttttttattttttaaaattgtgatgccacataataagcaccacataaaaaaacgactgggtcaacacgccatgtcaaccaaaaccaccatccaaaaccaccaagggacgtagtttacactacttttagaagttgaggatagtctatattttgttttatggttgagacacatgattctaactgatcccctatggagggatacaaagtgaactttctccactgcagaaacagtgtgagatggagcccataaatagttagttacccattaggcccatgtttattattttatatatagtttttccttggaatcagattcggaaatgtgtatttctttgtatcttaaattagtaaatattaaatctagggaggcaattagagtgttaaaaaagtacatcaaggaaaaatttatgcaatattacttgtgggctcgtaaaatagtgattaatcaatcttttattatgtttgtagatgaattttataatatgttttcatatacgtttgataatatgggacatacggaaggttataatttttcccgtatcctaaccttttatttttgcatattcgaattcgaatattactggatatccatttttctctccaatatctatcctttctacaggccttgggttgggtggtcagaaatacacgtcctatttcaccccttgttaccgcgcccttagctttcatgattttaggattaaatttattgtgaaaatcacataataagtaaatattttttttagtttatttttgagtgacgataggaaagggagtcttgcagattggaaagcatgcatctgtcttcactgaagcagtctttgataaggacatcgttcctttgcatacatacaatacttctcaaattgctatgcaagattacatagcatatactacaacttattttttaggaaatcctacggtttgttaacatcatattgttgtagatatagtctcaaatcagagagtggttttggatggcgtggaactcatgtggagcctatatagatggccatgtgggcctcccggcacggcatggcccaggcccggccgtgcctgggccaaggcctgtcgggccggcacggcccaaccgacgcaccgagccgtgccgtgccagcccacgtcccacactcacggcccaggcacggcacaacacgcctcgggtcgtgccgggccggcccgaaggcacgatgggccatcgtgctttttctcagaataagtctaattttcgtccgtcctattgggctgtgacacacacacacacacacacacatatatatatatatatatatatatatatatagctcaaaagtctattttcctccctcttctttgggttggagtacataaatag

SEQ ID NO: 46616 - DNA, 23732 bp, Oryza sativa
  unsure (1)..(23732): unsure at all n locations
ttccatgggttgattgggcctggctgaattggcccatgtgcagcccacccgaggctctaacatgaagctcgatcaaatatgtatgttgacttgcttcagtctcgctggagacaaacaagcccaggcgaccaacgcgacccgagcaaagggtagtgtcactttcaccaccaacgatttacacttgtgcggtgtcatactgtcatggactcatggttttattagggccgtatctaagaatttgaagcctcggtgtataacttcgtaaggaccgtatttaagaacttggtaccctgaattgaacgattttgctatatatagcactcgcaacatgtttttttgttagccatcactccatttcttcaccatatgatcttcatcaagatttcgtgctacttgttatgaaaatagatacacaacggagacacaaatttttacgtgaaaaaaccacgggcgtcgaccggcaatgatcactatagagaagttggatacaagcgcaggggatacattgggctatcgcactctccccgtgcgagttacaagcaatatatataggagaaatctaggagtcctaacaggaaactaatcctataatacaaagtcctattagataactaatccgaatatattgtgggcccaaaatacggatcatatatttaacaatctccatcttgatacgaatttcccttatagcataaatatcttcaatctccaaacaacctcgtgatgataaaatcaatgtgcgccaaatagtcacttggaatataatccataacacccttgatacagaagaggtagatcatacttcaaactcgccattgggaacaaatcctgaatctgctagtataaaccggtgtgaacctagcagagacgtgaaaccgatacacaaacttcaaactcgccatgggaataaaatcttgaatctgctggcataaatttctgaaatatattataaagtactccctctgtttcatattataagtcactttaatttttttaagtcgatatatttaaagtttgattaagtttataaaaaaaatataacaatatatatagcattaaattagttctattgtatctaacattgaatatattttaatatttttatgttgaaaatattattccctccgtcctaaaatataacaacttttagcccttaggatttgtcccaaaatattacaacttctctaccaacattctcttcccaaccaattacaactacctactccctccgtcccaaaaaaaggcaaaccatgggttcccatgccaacatttgactgtccgtcttatatgaattttttttataattagtattttaattgttgttagatgataaaacatgattaatactttatgcgtgacttatctttttaatttttttcataattttttcaaataagacgaacggtcaaacgttggacacggaaaccagggtttgtcttttttttgggacggagggagtacttgcttaataaccatatccaaccctaaaacttcttatattttgggacagagggattattatatttttctataaacttgataaagttataaaaaataacttaggaaaaagtaaaagtggcttataatataaaataaaggtagcagtaatttatttttgttaaaaatgattttttaatgcctaggacacaagttcatatcttcatcgtgagctacagatttttaaggtgtccataattactactccctccattccaaaatataacaacttttagccttcagggtttatcctaaatataataatttctccaccaatattcacttctcaaccaatcacaaccatccaccattcacttttcccacccacctccactactcatccaatcacaaccctccattattcacttctatctactttcttaataatcgtgtccaactctaaaactttttatattctggatgtgggacggagggagtattgaacacttgttggaggctaagaaaataatgccattctaaacaaatcaataaataaaaggaaaacttcttttaaaaatagagcaaaaagcctttaaacgtgtacgtctcctatagtatcatgtggttaattatcgtgtcctttccaacatcgatccacaacgcatgtacgtctacatacctgcgacgcttacctatatatatccatcgttcctaaagtatatcatcattttaacatttaaaattcattttaagattactcaaccaatcgtaactttctccatttaattttaacacttactacattctcttctcacccaaccacaacttaacattccctcatttactgctatcaacttcattaacccatggtcaaacctaaaacttaaattttataacgaggtaacactattatatatgtaaattatacaaaatactattaaaataggaactgcaggacctggcagtcaacactgcagctgttataccattataacaatccgacgaaaagctaccaccaacattcagcttaagcaatccgactggcaatttggaccatttcataagttttaaatagaagaatacagctgctatcccagtggcattgaagctggcacatactgccatatatacttagtcaaaatggaatccatgaatagaacaaaaaggatgcatatgccgctttatgacttatgatcgagtagacaaatagcatttgttctactgaatcccggccaataaatgataagtatattcagcagagatttggtcagagattaaaattagagtgtactactagctaatatgtacattgcaaggacacgtactgttcgcctctgtatataaaaaatagtggagaattggaccatcgtgtcagcttagctttgacctgtcatgtgttacctgtatcccgttaattactattacctccatcacatattacttggcactttaagtttttttaaaaaaaatttaatcattcgtcttatttgaccggtgtttcagctgcagcctgcttatatgtttccatgcatgcaactagctaactgtactttgatttgcatacagcaattgctttcacatgcaaggtagtacgtgaagtcaaaagtgttaggtgatcgtccgatcctcctcgagattcgagaggcatgaaggttcgagaagatggtaaaccccatgtcgatcaccgattcaccagcctctctctataaagttggtgcagtacgtagtgggctaaacctccctcgtcttcctcctcttgcacctagctaaacacgaacagagtatagctaagctagccagctgatcatcagtaagccgtagccgccatggcgagtggattcttccaccagctggaggtgatcatcatcatcctttgcttcttccctacttttccatccttcgcctccgggaggtactcgccacacgacggcgcgacggcgacgtgggcggggcatcatcatcagctgcaggtggcgcgcgaccaccctcgtggctgcggcggcggcggcggcctcgccgaatactgttgggttgcgcggccgcaggcgagcgtggcctccgttgcaacctttgtctctactgccggcgcggcgtcaccccatcaggtatgtaagcatgatctcatcatcacgtgttgtttggttgaagaaaaaaaaatcttttgacttgtccatgatttcaactgcagcagatccatttccctttcgagggaaaactgggattatgggcggtgggtgttaagggctggggttgcttcatttgacaccaaattaaccgtataaaattaattagtagtgccaaaatttgataatatttgacaaggtaggggtgggtatgattacgtatacgtaaaatctaaatcgagaggcttctcgctttagtcgtatcacgcgacacgcctcacagcagttcgatcatgcctgtcgtcccgacgtacatccgcgtggccgcgctctaatggctcaatgagaaggatcaacgtagtgactgcctgcctttttttaatagatatgtatgtctttttcctcttcaaataaagttttctcttaaattacttatccgatctataatccaattacaccattatgttcgttacaattaaatcttcataacaagatcttacatgattatattacgatgaaaaaatatttatatttgtaaattatttttattatatacgtaagttacttttatcatatatataagttacttttagatttgactaaattacttcttagacatataaaagtaaattcaataaagtctaaaagtaatttacatatatattataaaagtaacttaaaataaaacggaagtaactttgtcacgatattagaagtaaattcattgtagggataaaaatataattttatctataaattaaatttaatcagtatagatcaacacaagtaagtttgacattttttaaaagtaacttcaatgttaattggaagtaacttttgcatggtcgagaagtaactctctgtaaatccgtttaatcaccgattgtttttgtttttttcctttcatttttgcttttcatgtagaatgagaaaagaagataaaacctttcatggattgtaaataacattgatggaataacttttaggctttattgaattactttttatgtccaagaagtaatttagtgaaatttaaaagtaatttagatatattataaaagtaatttataattttcatcaaaatataatcatgtgagatcttgttataaagatttaattgttacgaacacaacggtgtaatcggatcgtagatcggatgagtagtttaagagaaaagtttatttgaagtataggtagatagtagccacgtctttaggtatggtatgtttactgatacgtttgcatttttttaaaatgtaaggaagttttgtaaattatcaatgtttggatcgtcagtgtgtcaccttgccatattttggttttattaaagtttgatacggtttgttttctaaacagatcagatacactcccttacctcttaagtttagtgagcttcatatacatatacgtgggaaaggacaattaaagagtcaaactctttcgccttttaatgcctagatatatataggagtaaaaattgagggggaatttgtctactgtgatgatttagacaagttctaccctttcatgcattctatatactattttaaaagcctataatgatggtggtgatgatgatgtatctgtcactactacttttcaagtttttacatatattgtctcgtaatatttttttaatattgtagaatagtccaacatttaatttaaacaaataaataacatataagcaaataagcaaacaaatgacattaagatattggttaaaaaatatattattttgtgacatattataatatttgtttaattctcctatagcaaagcatatggcattctgctagtctattttaaattctcatctccatcttaaagtctttgaaattcccatcaatattagaccgaaaaatatttatatcttcgaaacttatgttagtccttttaaaattgttgttaaacaggctgttagcaactgtcgcacatgggggccggtaaggtatccactagctatacatcacgtagcctatgatcaactgatcaccagttcaccacacgtcctagcttgtacagtagtttaattgtttaaagacttgtcaagaaacacaatactagtagtacctgtcatcccgctcgtgcgacggagtccgcgattctaggctagcgtacggtgtagtaccacctacccaggtttttctttgttttttgaaagatccagctaaaaagctggcttaggttgacgacagtgagctatagtacgactagcagtgagtatcaaattgcaacgagggctaaaacaaagacaaaaagggtcggatctgccgacggtcatagggcagctacaacttgttaaaaaggctattgaagtgtattttaaattttgagatttgatttacaagaatgtgtacatatccacttcctccgtttcaatatgtagcatcagagagagggagtagcacatgaagcgtatattatagtgggaaatatatattaatcccatcctaaatatatattacggcggagggtgtatcttagaaagcatatattatagtgggaaatgagcactaagcattaacacacaagtaggcgaattgagaaaaaaaaagtattttctccgttctaaaatgtaattttttttttggacatacacatgtgtatgaaggaggtaagtagaaatgattggaggaatgttataattgattgagaagataaataataaataattaaattaaatagagaatgattatgattgtttgagatgaggtggtaggtgtagaaataaatttattttaggacaagtaattgtgtttgaaatagttatatattttatcaataacagatgtggtatatttcgttttttgtgagtaagagtataataaaagggaatgtgcacgtggattacctaggatccagcgctatagatggccatattatcctaggcccagcgacccggcccatggcacggtactttggccccacccaggtatggcacgacccggttggtgacggccctgttgtggcccaacctgacaattggggccgtgggccgttgcgttggcatggtggggtggcacggtatgaatatgaggaatgcaaaatagacttattttcagccatatataagacacagtccaaagcagaagaaaaataaatagacttattacagccatacagcccaaagagaagggaggcaaaatagacttttgttagccatatctgagatgggcttctgtgcctgggctataggtggagcccgtggatgggcacggcctggcccggccgttgagcaggccataccttagccgtgcctgggctgagccgggttgggcggcttatttcgccatctctatcccgcgccccccaccccaaagttaccatgtttacatcaatttaaatattattactactatttgtttgatgatgtaccagatcgattaccaatatgttgtggcttatttggatgtatttaattactatgccagttgcttagttatacatgagtgacgttaactaattggcaggcatctttgcagcccggtgatttcaactgctccgtgctgtccgggttcgtgacacgtcctggttgctctccgctgccggcgttcgccgcggcggccggcaagtcgtcgtcccaccgcactgtcaccggcggcctaccggagctcgactccgagctggcgctactggccatgatcatcgtgctagctgatcgagcgacggaccggaggaagaagaagagcggaagggcgagatactccgtggcggcgataggcgcccttctggtcatgctgctgcggcaggttccgcatctgcagcaccggtggcagatgcaacacgctcaaactgcaccaatgatcccaacatgcccaagcattttcggtgcaacccccatcgtaattaagccccgtgctgcacagtgatcaggctctcttcaatacagatgttcactatggaagagatgcttataagttatctgatactagagtatagaaatactcaaaacatgtacgtgaggattagtggatgctatgatacattaatatcttgttcatgctattacctatcaatggaatatctttgtcacgtttaaatatggcacttggttgagagcattcagctgctttccctcaaaaaagaacattcagctgcatttcagttcattctcaactagccacgtatctacgccgttacataaggtgaatgacaattaaatgcacggtggtatatcataagtgtttgcacaacccacctccccctccttaccaagactcaaaacccaccttccacctcggtcaaaggcccctcccaccggtcaaacccgcttactaactccccccaccactcacctcttctcagctctcgtcctaggacggtgcagtaacacgacgacctctgtgcagtaacactatgtcttacgtgcagtaacagcgttaaaatatagttgaaatatagtcatgacggatctacttttgataagctctttttttctagcatcatggtgcaaacggttttaaaaaacagaaataaaatgaaataaaaaaagagagagatcggtagagagagagaagggagggggtatagaataactattttataccctgggtatagaatagtctcactctatatatatatatatatatatatatatatatatatatatatatataaacacacgatacattgtaatgtgtgtgccctaaaaaaatttattttggccataaatgtagtaaaataaccacgaaataaaaggtaagcagcttgctgttattcacctgccagcacaaaaaggacaggttttttatgagaaaatctcaaattagcacggatatatatactccgattagaattatcaattatgtatgttgattttaggcaagcagccactggagacaatataaatgtaaaaaacagttgcagtagggtgtgtttagttcacgccaaaattggaagtttggttgaaattggaacgatgtgacggaaaagttggaagtttgtgtgtgtagaaaagttttgatgtgatgaaaaagttataagtttgaagaaaaagtttagaactaaacaaggcctatcttctctcaaatttgtaacagagattacagagatgcaatactatgtaggtatttccagtaatttgtaacagacgatcgtctctgcaataattgaaagggcaaagcagggcattgaaagatcagaaattgatcgattgatcgatcaaattaatcgatcggtcactgcaataattaatactaccttatattttaaatgtataaactttttatccaacatttgatcattcgtcttattcaaaaaatttatgtaaatactcccaccatctaaaaaagacaaacactatgtttccgtgtctaacgtttgactgtctgtcttatatgaaatttttttataattaatattttcattgttgttagatgataaaacatgattaatattttatgcgtgaattgtctttttaatttttttcataattttttcaaataagacggacggtcaaatgttggacacgaagacctatggtttgtctttttttggacggagggagtatgacttagcggtaaaaacataatatgtttgtaaaaagagggagtaattgccttgcataataatgctagataaaaaagttgcaatatactttttttatgctggttagttcaaaatatttatataaggttgcaagaaatctttataggttttctctttcggttcttcttatctgactactactgcacgcgctgaaatggtgtttgtcgccttgtcgtaagaagagtacaataatacttcgtcctttgtcccagaaaacgagttgttctacatctccgataatatcccagaaaaagtgtcgttacaatgccaaacttgattagagaagtgggctatctgtctattctatcatgttattttccaataagtgttcaaagaatactcgttaattaattgtatgtagggattctttgtaacatgttgagtgtataatgacttaatgaaatgacaacccaattaaacaaataggggtaatttggtcattttaacataaaactaatttgattgacataccttaaatcgtcaattatgcagctttttaccaattatagatagagattcacaaatagactttaataatgtattctcctgatcttgtattggtttaatttacatttgtgtggtcatttcattctatcatttttgaactacactcattttagagtgctagaatgtaataataggctgtagatctttttagcaaaggccgagatgcttattccattataataaaaaaaaagtacttgggtttattgtcggtaatcagatttttggaataaaactgaactgaaattgggtaaggaagaggttacagcatgtaaagtttctccaccggttctgtttccaccatcctgcgattgaactgatgaaatcgcagtcttgcgcgtgtgtttatcttgtcatggtcagatttgcattggtttcttctgaccattctgcaactggaactggtggtcgcaatctcaatctttctgggttttatcttgtcaatgtcagagtagccgaataaattaactaaataaagttggtgaagaaaaagtttaaaatgagcgcagcgggcaaggtggtcgtcgtttctgacgtgccagtcatgcacgacctgatcgacatatgatggagcgcgcaaagctgccgtcgcacacgcaagtgagaaatgctttcatttcaattggttctcaattagtggagtagttcaggctgagtttaattctaaattttttcttcaaactttcaatttttccatcacatcgaaactcttctacacacataaacttccaatattttcgtcacatcgttctaatttcaaccaaacttttaatttcaactaaacataccctcagactccattaattgtgtctgtgtatatataccgtcatcgtacgtgtccatctcaattgcgtaactacgtatgtcttgcacttgaatttgtacgtttagacgtgtagtccaactccgacgcgccaatgccgcacacgccgcgtacgtaagcacgggcacgggcacggcatggcgtggcgcaccccatgcttttatttgcgtctctcgagccagctggtgttaggacctgtttagttccaaagtttttttttaaaacttctaacttttcattcatcaaatctttcatacacacaacttttcagtcacattgtttcaattttaactaaacttttaaatttagtgtgaactaaacacagcctcgatgaaatcgtgcacggtaacaaaaccagttttgtttatctgttaatcatcacgtgagtgctgatcttaattcgccgcctgttctgaattttaatttggctgttgacggggggtgccttttggaatattgtccttgttggcttcgtcggcggtgttctgattccacgacttcagcaatgttttttccaaaatctttgaaactgagcatggagcacactgaatcaatcttggaacaactttttttaattttagtctagaataatattggataggatcaggatcagccgtagttgtagctttggatgcaaggcagttaatttgacaggtgcaccggttaaacaactcatcttttatacccgttggaaacactattaatcctggttataaaaaacgtgaccagcaaatcgaggttaaagaccatgatctaccaagcaaaaaaatatgttgaatgtgggtttcgaccttaagatctctcatcttagtcctcatgtgcgattacatgtgttgtcaagtaaaaattaaggtgcttttccaaggagaaaaaacgccgggtgaggtgtgcaaaacttgggaacgggaattttattcgcaaatggtaaccggcaggacgatgagtttccaaccaattgaacctaaaaacgtctacacattctgcatatattgctgtcaaaaacgccatagtggtagccgcctgtcatattgttggctccaatacatgcatgttactccccccgtcaaactctcctaaaaaaaagataaaaaatagataattttcgcaggcccgcctgcgaaaatcaattttacaggcggacgacatcttcgcaggtggtagattcacccacctgcaaagcacatttcagcgaataaaaaaaaagacgcctcactgccgccaccggcctcttcctctggccgacgacagctttcctcctccgtccgctgctgtccccacaggggttggcgccgtcgttatgtcgtcgcatcgtggttgtcgtcgaggaggaagccggtggcctggcgccgtcgtcgcgacgtcgttgtcttcgtgttgttggcaccgtcgtcgtcgaggaggaagtcggtggcgaggagggagccggcggtggaggcggagccgacggcgaggaggggaactggcggcggaggcagggaggaggggagccggtggatccgtcgcttcacggtgctgcgaaggtcgtcgtcgtcgtggccaaggggagccgacagctcgcggaggcggcgtcgcggtcgtcgtcgtcgtcgttgaggagggagccggcggcggaggcgaggatgagggcaaccagcggcggaggcgggaaggaggggagccggtggatccgccgcttcacggcgccacaaaggtcgtcgtcgtcgcggccgaggggagccgacggctcgtggaggcggcatcacggtcgttgtcgtcgtcgaggaggggagccggtggatccgaagcttcacggcgccacgaaggtcgtcgtcttgcggccgaggggagccgacggcgagcggaggcagcgtcgcggtcatcgctgtcgaggagggagtcggcggcggaggcagggaggagtggagccggaggaggattttttttttgctaactttgtgagagagaaggagagagagagagagaggagggggagggaaatgagtggtggagaggagaggataaggataattgactttttttttggaggcataatttttgcaggcggaccacaatacgttccgcctgcaaagatcatatttttccaggcggacaacttaagaggtccgcctgcgaaaataaatgtatttttgcaggcggacctcttaagtggtccgtctggaaaaaatgattttcgcaggcggacggtgagctccaccccgatttatatttttctaggcggtcatttagctccgagggtcatacccgcctggaaaaataaaaggccaaagttgctaaaaatcatttttctagtactccctccgtcccaaaatagtgcagttttgcactattcatgttcaacatttgactattcgtcttatttgaaaattttttatgattagcatttttattgctattagatgataaaacatgaatagtactttatgtgtgactaaatatttttaattttttcacaaatttttcaaataagacggatggtcaaacgttgggcacggatatccacggttgcacttattttgggacggaggtagtagtgaataacagtggcaaagcattaacagcagactacatcatatctagattcagacttccatcaacagcagtagggatgaaaacggatcgaatacggtcgaaaacttctctatcatattcattttcaattttttttctcggaatcgaaatcggattctgaaacccggatacgaaaacggagtcgaatattatcgaatacagatacagagcgaatacgaatagaaacaaatatggtaacaaataattatcgaaatatcaagacccctcaaagttagcttcttaaatcgaggaagagatatagccattagttttcaaaagcaaaacatcaacattttcaaattttaattctatttgtaagggcaagggagagatagaaaatgttgtgtttactttgtatgttatcatgaaacaaataaattaattaatgtgtatcactgaaagagagaaggtacttgagacttcctagggttatccttgttgttgttgggctgggctgcctcttgggtagggctggcttataggctatggcagccttatgtgtaagttggatatccgatagaaaataccggatattattcgaccgttatccgattccgacagatatcacctatatcatattcgttttcatttccgaaaaatatatccgaattcaaaatttttcggatatatcggaccgaaactatcggattccgaaaaaaagtccggtcggatggaaactctccgaatcactttcaaccctaaacagcagcattacatcaacacaagcatcaacagtcaccacaagcatcgcggtcaaggtcatcgctgttgtcaccaagctgcagtcggcatcgccatcactgagtcagccgcaaaccctagacatagtcaccactgagggtcaacatggtcaagcttgcgtgtggagccgttgtgccgccgccatcaagggtcgtcgtcgaagttgaccgtcgccactgccagatctagcggtccaagaaccgccgtcaaatctagcgatcccaactcgactctcgccaccggccatcttcttactccctctcatcatcgtcctattcgccacccgctccagccagccagatccaccagcggagaggctagggtctcctagatccgatggccctgaccttcttattggctaatctagcatcagtacggaatgttgacagcttcctagagaggcgacagtagcggcacgccttggcggtggtggagagagggccaacgggagcaggtagaaggacgagggaaggagggagcgaggggcaagagagtctggaggtaggagggagaaaggaaggagatcgagaggcggggacaggtggtgaggtgggctgtgggtgttttaataagttgacattaattntgtgagcggtactctttggctaccaccagcgaaaaaaggttgctaagaggtccgactgaagaaatggcgaccaccagcgaaaatctattttttgctgatgtcctttggccggaattcctccgagacattttttttcaagtttttttttattcggcagtaaggataaaagggtgacaccataaaaagtcgttttgtatttaagaaaaacaaaacttttaaaaattaatctatgttcaaattcatttagtttttaaatatatgttcaaattaattcatttagttttgtctagaacggagtgaggacggagcacttgtctccttacaaacgccttggtattattctgttttgtctcgttgcaaatccccttaatttgtatgattctgtctgttctacttgctagtggtaatatttcttttgttcgcataaggagcttgtgcgtatgtatgcggccgttcacacacgatcactttttcttgcatgaatatacatagtatgtggatgcatgcttagctggcctaaaacaggatatgacatctatccaactttttacatctatgcatggtgttgatgcaccattaccatgcatggatggactcaattgtttaactccagaattacgtatcagccttctcattctgttttactattcatcaatttatttttaattttgtactactataatgaatttgggttaccggcacaatcgagcatgcatggctgcacgaatggcggcagtcatgacatcacgaacgaatgactatgcatatatctcgataactatgtacattaggtagggatcgataaaagaaatgaacttttcacaacctcttatcagaaagaaagcttcggcaagaagaatttccagcgcccctctccctcgggcgctgggctatataagcccttaacgctcgaacgaatattaattaattaccgtcacaaaccacaccgtagaattcacacagctagcgttaggccatgagcccgtccgatcaggtgttgctcttcgtctgcctacggcgtgttctcctgctctacgtcaccatctcggcggtggccgggcagagcatcaccgaggtcgtcgtcggtgatgaggtggtgcacgctgtcaccaagctggtggtgggtggcggcggcgtcgactccgcaaggaacatcaccgatgtggacggtggcgacatatgtcaccgcgaagtgcactccatcaccgaggaggacggcaacgtcgacgacgacgaggtgcagtacgccatcaccaacgagggcgtcggtgccgacgatgacggctccgacggaaaggtaacaccttgctttaagattctcttagcgttggttggggaagtttaagattctaagaagcaggtagttgaaagccaacttcaaaatcggtaaaagctgaattgtctagcttctagtttctagtttattttctgaattctgcaattatagtttctttgaatctagtaaaaaactggattgtttggaaagtttttgattctgagaagttaagcagctagaaactccctcaaacaagcccttaatcttcctctgcagtattttacctttttttccttggaggaaatgcagtattttacgtgaacctttactactgtttagatttcaacttttttcttcaaactttcaacttttcggtcacatcgaactttcctacacacacaaactttcaacttttccgttacatcattataatttcttcaaacttccagttttgacgtggaactaaacatagcctaactcagaaagacaaattccaggtttatagtagtgtactgtcgaatctcattgtgctggaaaaattgaaccagtgatgtttgaccctctgactctcatgatctgctccccctgcagttgtcatcagcgtccgaggttctttatgcggctagtgcgcagccgaacacggcggccgccggaaagtggcaccgccgcatcatgcccaccgccctgcagccagagctcaactccgacgacggccatggccagcagttcgatcggaccttcgaccaaatccaatcaagcatcgccgacagactgatcgccacgacgatcatcgtcatgctcatggtcgtcacgaatggtcgtcgtgcgagcgagaggaagaagaggagcggacgggcgacatggttctcaccggcggcggctctgacgatgctgctgttggtcgtcgctgcgtctgccaactctgcgacggcggcgcggccgttgcccgccgccggcggcggccataacgaagctgctgctgctgcagcagcatctgggacgatgccgctgaaggcggcagcaccaggacactcatcatgtacaacagatcccaatacgcagcagcctgtgcgttgtattccccactagctacatatctgagtatataccatgtgatatatagttactatatattactatataaataaagttatgtagtagtagatgatatgattgaaattatcaatataatcgtgtgggttttgtaatacagtacactatacatttggtttgtaacaaaatcggaataaatgggggcaataaatttggtttgtactcctacatatacatggtgagatttgtacgtgtcacgcacagctcgacctgttaatatttactatttgaacccgtcgtgcatgtacgttgacagcgaccgttcacgtgagctacgattcgacgttaacctaatctgttactcatcccgttttgtttatatgtactctgttttctttactgatttattatttactatctagtctctctttcgtccaagagattaggtcagatacatttgactagttcagtctttctcttatcaaggaaataaactacttactccagctacgcatatatcttaccatttctaattcgatccgggtatttttctttaaaaatcgatactggaatatttatgagaaaattccctatgtaccttcaaacttcacccaattctttctatgcctatgatatttactcattcccttgcatacccctaaatttcattttgaatccttctataccccttgcattagttgaccgttaaatttctatcataaagttcattctgccctttgatataaaaaatataaatttatgaagtatattgatagagtgtataaattcattgtatgcgactattatatgtatgagtttattttgtgagatattatttaacaaatgcaatattttagtttcgcctcgcgaagggaaaacaaaaataatttttatctatgacaaaatttattttagataaaacaaaaaaataatattttttaccattgaaaactgtatatataacatattttgttataatagtacaaaattctttatcagataaatcttgttattacttttgttaaataatatctcacacaataaactcataaatataatagtcggatataataaatttatacactccatcaacatacttcataaatttatattttcttgatatcgatgcgtaaaatggactttatgatatgaatttaacggtcaattaactgatggaaggggtatagaaggatccaaactgaaatttaggggtatggaagagaaaaatgagcatatcgatcttatagggtacagaagggattggacgaactttcagggatagaattttctcaatatttatttattcttcctccgaatagcacatgcaccgaaggaggtacaataagcatcttcgtaaaaaaaattaagtagatcaaagaagtgcggagactgaagttatctcctcttcgtaacaaacttcgcgacaaagaaatgcatacacaaatgtgccaccgatcgatcagtgttcatatcctcatctgtagtactcactttaatttgggaactaaattaaattaaatcaacgagtgctgctagctcccatccaaattaaaaacctaagaatcgttcaaaaggagaatctcgtgcatgaccaaagcggctggtttccagtgtccagtcagagttcgtactgtatatagctagctgctgtggactgcgccagatcatctccaccagctaccacatccatatcagagaatcgggcatgcatccacagattccgtggagaaatagtttagattcctaattataaattccaacactaaaaggtgctcattaccttctctgtcaagccatgcattacgtacccactttctcctagttatagtgaatgaacaattaaaatttctctattaactattttatttaattaatgtgccagctattagttgccaaattcgaccaaatagttatactcccccatagcaaaaaaccaacatacaatataatgtgacctattttaaaacaataaatctggacaaagacttatccaaagggcaacagtagatgctattaacaggagtagcaataacgtcacttgcaaatcacagatttttgtcatggtcaaaaagccaatctaagtatgggattatatttctctgcccttttgactgagtactactgtaaagtaacttggtattccatgtatggtacgtaggagtagttttttaagtggaccatgcatgtggatatgtgttcctttttctttccgaggatatggataggtatatatatgtgacttgacgttggctgacatcgtgttctgtacagcatcgatcttccgacgaccaaaccaaagcagccgtcatcacctactgtctgatcctttaattcctccggaatcggaatgttcgccgctagcaagccgaaccacattgccaacagctagccggagttcagctctgatcttgcccgtgggaggctgaaaagttaatcaggggtgtgtttagttcacgtcaaaattggaagtttggttgaaattggaacgatgtaatgaaaaagttgaaagtttgtgtgtataggaaagttttgatgtgatgaaaaagttgaaactttaaagaaaaagtttggaactaaactcggcctaggcttggtcgcctcgatagaaacaaagaagagcccaagacagtcgctacggcgcttctgattctcctagtacactccgtggaccgagtgatctaatcaagatatggattattagtactattttgaaggagagatctctttgtcatcatcgtcaatatcatctactagtacactccaaccgcgaaactagctagcaagatttcaaacctgttggatcaaaagcagcacaaagtgtgcatctgattaaacgccacatttttcatgttgcaatcaaattataagtcacaattagaaatgaatattataggtacatgctagctagtacgttcaaaatgaatatatctagccatagtacatctcataataaacaagtggatcgatctagcaattctggaacctaattttgtttactaaagcatatgaaattctcgggacacatacctatttcatatatgtatttcagattcgaaactcgcgactgcatgccctaagatgcagatagcctcaagatgctaccactctcaaccagacatgaatcttgacatttgtgtcatcatcggtacaaaattggtatttctttttcccattcttccatatcctcttttgaacatattgtcttttcttaggatgctaatctttaaagagtaatcatccaaatattttgatttccagaggaatttggtatttccgcagctttttgaaagggtagctaggcagctgcctgtatttctacagaaaaatatttcatagtgaatgatccatgtcttggttaaattccacaaaagttgcctttgtgacattcaggacaatgccctgacattttcttctgagttagtgaagaacaactagtagtccaacttgcattttcaattagtaactcagaagaacaacttgcattttcaaaacaagaaaaaaaaaaggctaccaaagaggaagctggatgcatggaaacggcattactttcggtagacaacaacagtagtatacattattcgacacggctaagaaatttctccgtgttttttcaggagccacgtgagaggatcggtcgggagcgtactgatgacatatatacatgcgacgagctgatgtgacgcctgatcgatcaagacggcagcacgaatccgttgtctcatctcgtctagctagccccttgtgcttgaggtttcttagaaggcaaaatttaaacagtgcatacgcactatttgatctcaacagtgcatgcatactttgctaggtgagaaagtgttacttattatccataaggatggcaagctaaatatctacttagctaggtcatgcatgtcattttttccatgcggttaaaacaattttcgcatgcgagtggtgatccgcacgcatgcacccaggtctttgcgaaaattagatttttgcatgcgggtagagcaaccgcgtgcacgcgaaaatccaattttcccatgtaggtggttaagtcattcgcacgcaaaaaatggaaacttatcaaaagaaaaatcggaaattcaaaaccatagcccagaaccctagcccaccgctaggaaggaggagaggagagaggagtggagtgggagagaggagagggatttgggaggggaggagtagccgagtgggggagaggagtggtggagaggaggggaagagagagaaaggaggggaggaataaaaagaatgtgaagagaaaggggtattttcgcatgtgagccacttaagaggccgcgtgcgaaaataggcctgccaataaaaattgatttttgtatgtggatttcttaagaagccgtatgtaaaaatgtaggtctatttttacagacgcatcgagttactatccgcctgcaaattataggggttcttgtacagaaaaatcgtttgtataatagtgttaaattacttatctgatttataatccgattacactgttatactcgtttcattcaaatctttacaacaagatcttaaattattacgttctaacaaaaaaatatatattgtaaattactttatcatatatctaatttactttagatttgcttaaattacttcctaggcatttatggaagtaacttcaataaatcctaaaagtaatttcgataaatgagaagtgattaataggacaattagtactctattgtgacaactattttgggacaaataagaatcctagagatataattataacttaatacaaaataagttacttaggacgatgaatgcgacacattgttgccacgcatggagaaggagatcctcctgtcgtcccatcactcagcggacaccatgtgagctgcatattcccttcaagaacttatcaataaaggtaagctcgtagtttatagattttagacttgtccattccgcaagttgctgcttatatatgttgattactaatagataacctctcaccacgtgaaggtggcgtcgggcatggccatccaacagacccttcagggacttaccactgcaggccgattccagcaggatactccaaggtcgaagtcgagttggtggaagccgcgtacgaggacctcgagttggactaccctggaggagacggtgagacgcatctacgagacacaagccacaccattatattatggcgcaagcggtacatcatcctccctgggcgacaagcggcgtctcgtgcaccatctcctccggcttcgccatctcctcctcaggctcctacaccgtctcctcctcatgctccagcatcgtctccacctcaggctcctgcattgactcctccttaggctcctacaccgattcctcctcaagctcctcatctggcaccttccaagtcaagggcccctcaagctccaccgcctgcctctacaagggcaacgaagaaggcgaaagttgacgccgccaaaaacaaggacccagggtacgattgcacccaagaggagcttgacgcttatgtggcatcaaaagacaggagacaattgaagcctcgaagtccagaaaagaagattcctatagacccgagtgttaggaacttcttcaggggtatgtctgcacctgccaaggaggctataaagctgtcggactatgagcgaacacttaagaaagcatcttctggaaagtccaaaccagtccctcagcttggagagcaaccaaaccaggagatcgagccgttggtgaccggtgaagaatttggaatacaagattttattaatgacaccgggctaactacatatcaattgctacgaggcgcaccaatcgaaaaggcgggagtgaaatacatgtacgaactcggtaaaccacttgtcaagcctgagcagctgcagtccctaccgacacaaatgtacaaattccatcaactgtacatggagatgagcgccaccggtagagagatgatcggagcaaggatcagggacacggacttcttgcaaggagaagatattctctggatcaatttcaagggtatctacgaactataccagctggacgccctcgacgtctctattatgagttgttggactttgtaagtatcgttcagttagatttcttattacgtttcctttaattaattaggtccttgtatataagtacaccatatataatatatacttccgtttatcgttgtagaatggagattcaaaggtcccgacggcggggggttttcgatactggattcatcgacccttggaaagtaaacgttgaaatgatcaccaagtatccgcaagccacagaggacaatctcgtccatctcctaaaggcgcagcattacaagacgttcatactattgccgtacaacacagagttagtttttactgtcttcctaccaaatttcattctcgtacgaacatgctaagtgtttcatatgtaatgcatctgacgcacattggagattccactgggtccttttactcttcgacttggaggcctacgtagtcaatgtatatgactcaatggataaaaaagagtctacgtttgacatggtttttgaacttatagacaggtacgactgtcataagttccaatgttaattacgaatcatgttataattaattgctactacgaatcatagctttaaactccatgtagggcttggtatcagttccgtcatttagtccgcggcaaatggagagaaagacttaggcagaagtttaaatttcatgtgagtacacatgctctacatttatattgaatctccaattcaaaaacatgtgtatattaattagatctctcgccgtttgtcatgtatatatagtgtgcaaagcaagcccagggaactaaattgtgcggctactacgtgtgtgagtattgccactgctttgcagaccaaatcatcaacacaagagagctcgatgtacgtacaaataaatatcattgcgtacgtatcgatttgttgtttactaattaattttatacattcataggttatttgcatgagggataacctcacacataagaaatttatcgcggcggttcaagaacaactcatgggattcatcaacgaataaatccttgatcccgagggtgaattct

SEQ ID NO: 46617 - DNA, 5861 bp, Oryza sativa
  unsure (1)..(5861): unsure at all n locations
tatatatatatatatatatatatatatatatatatatatatatatatatatatatatatatatatatatatatatatatatatatatataacccatccagcaaccgggccatgcaactaaaaaaaagggcaactcacgtggctgagccatctttagtcccggttggtaccgggactaaagatcgatctttagtcccggttatttcacccgggactaaagatagcgatctttatttccggattggtagtcccggttttcaagggactacatgggggttaccagccgggactaataagggtttccccaccagtgagaggatggaagaaccgaagaagacggtgttgggtgtttagggtccatggatgacagacgaaggcagcgtttaattacccgtccctaggcttccttgtgtccgttggttccagcttgaacggactagattgaatcacagaaaatcttagtactctcgtgaggtagaataaaagggcttttggatatcacggcaaacctagtctgtatatatcctcagacaattcacatgtacctagcacattacagaagctgaaggcatcttttcgtatcggtctgacaatttttgactgcgttaatctaggctgcacggtggtggtaatcccgttcggtgaagtccattttgcgtacctcaactatagaatgagtttaattcatagcccttgacaataaaatcaagtataaaaactctcaaccttttaaaccgatgtaaatcaacttatccattaaccaccacctacctgcttattcgtacctatggcagctggagcgtcgagcttagtttggaggacaggttttgcgagctacgccacctctctctctctgtgtgtgtgtgtgtgtgtttctcttcagatttagggagtcatagcaatctccttgagctcagccaccagctaccttgtcaagctcttctcgagctcagttgctaccttacgcccaaccagatctcgccaatgttcagccagggtctttgcctagtcaggctcgtgcttgccgtggcggttaagtcggtgtccactgtccttgacaaaggtggtgcggtgggatgcgtctctagaggggcttgtcgtctaagccaggtacgcagacgcgcgcggctggagaggaatggtgataaaagggtgagggagaaaatgggatgggaggagagagattatgacatgtgggccttacgttttgttttaataaatgacttacatgtggatttcatatgtagtttttattttttttaatgctaaaatatcatatgagtgccatgtcacatgaaaaacaggtcaaagccccacttacaacgaaaccatcatcaaaatcgcccaagaatgtaaattgggttgtttcgaacagttgagggaatttttatatcttgttttacggtggaagtatatgaatcaaactccgataatattttgaaggacacggaatagactttttgcatcctgttccaaaacaacggcccataacgcttctgaaatttgttttgttcggacaatctgtggaaattgcacgtctccagtccagtctcccaggctctcccaccctattgctctacgggttgcgaccatgtcgatacggcggcgggccagctgtgaggtttgaattagtagcttgtactcctggtagtgcaatttgcgagattgcttccaaagcaatatttaatgtttctcatatattctctccgttctactatgttataagatgttttgatcttcttcaatctttgtctagatttactaacgctcgtatgaatttagacacatatataaaatatatacatgtgtctaaatgagaaacattgggaagtagtaatttgaataagatattaatctattcaaaatctaaaatatcttataaaaaatataaaatttggttattctttgaccattctgtaaagaggactgaactgatgatgtcgcaggagttagcaacatgcttgggtttatctttgccgtgatcagattttccgaataaattttaattgggagaaggttacatcaacatcaggaaagctagctttctcctttggttttattctctgaccatcctgtatggttgaacagataacatatgtcgcgatcttgcgtttcttatcctaggctgtgtttagttcacatcaaaattaaaagtttggttgaaattgaaacgatgtgatagaaaagttgaaagtttgtgtatgaaggaaagttttaatgtgatgaaaaagttgtaagtttgaaaaaaagctttagaactaaacaggaccctggtatctgtctatctgaccacgtcctgtgattgaactgatgggtgtcgcaatctttgcctggatttctcttgtcttgtcgtgatctttgccgaatacatcaaggaggtttcttgtgcccactcaaactaatctggtgatgtctcaatctttgcctctctctttttttttatctcatgtcatggtcaggaaaagttgaaagattacacgaggagagcgcgtgtgaatcatgacggcaaggtcgtcgagcctgatgtgccggccacagtgtcgccgtcgcaccagctcgaccgacacgatcagcacgaacattcacgtaccggaacgtcatcagccagtagattgaccgtgccgccccggtagatatatatactccatatactagtacgtctattttacaagttgtaggtggacgacgacggaccgtccgccgagcattcatgccctgcacgcacaaaagtgcacaacgcgtttcgcagagtatggcgtcgccccgccccgcgagtcgctcaacggcatgacctcggtggccgtgcgtcggaggggacataccctaatagcaagtttaatagtatagccaagtactgctagcttcaatttatctatagccaatctaatagttcattcatacaatagttacataccacattattaatatctggtctcacctgtcatacacactgtgtcttggagtccgtgctacagctggctataaatctgtaacccacttctcttctctctccttatttatctccttaaaatatgtttatagctagcttatagcctgctattgtacctataaatcagctataaccacatatcgagaagaaaaaagaagagagagaagaaagctggctacagatttgtagtcagctgcaatatgggctccaagacgttatgtgtgtatgacaggtgggaccaggtattaatggtgtagtatatttttatagttaactattgtatgaatggactattagattagttatagatgatttggagcccgtacttggctatactattaaacttgctctaagagcaggttttaattggaggtgatcaagagaccgtacgtatagcagttggctattggcacgaactccaatcaattgatccacatttttctaacttagctttcacacacagatgctctcacatggaccccacaaccatgtttctacttgcttgtgttgtccgtctcacctaggcgtgtgtttggagccgacggcaaattaattgccggcgtacataatctctccacttagagcaaggttaatagtatcacttaccgtacgtgagctataattttatccacgtcacttatagccaacagagtagttaacctgtataataaacaggctccaacattagctaatgcaaacaatatttatttcttgttcatctggttctctcttttatccatgtcacttatagccaacagagtagttaacctgtacaataaacaggctccaacattagctaatgcaaacaatatttatttcttgttcatctggttctctctctcttcttgtttcctctgatttgtctgtgagcctatcaccatcttgggactcgtgtgtagctgggcgactatttagtcgcccactcacattctctctcatacgtttactccgccagcacatcgttgcagtttacgtggttgttttatcgccggtgtagcgcctcctattacacctgctcttatttctcttccagctcatcacttcttcttgcatgcatgcactaccgtcggcttaaactgtctactatacgcgcgcgtggaacaaccgatggttggacctactctcgcacggcgtcatgtccatcaaacctccaggcgtgcgggcgggaacaactaaccacttccctttcgggcgctctcggctcgtttgatggactacggccggcttgacgacgaacggctataaactgcgcgtgccactgccccccgtccatcccccgtccatccagcatcacgcacgcaccgaacgcacgcattcacgtacgcgcgcgggccatggcgtacgtgctgcatgcagtggcatcgatcgccacatacttcatgcgatcgcgagctcgcgtaatcacgtgtccgcctggtgtatgtccctctcgacgatggctactgggccaaaggagacgaatatatatattcggggatcgaccgcggaggggtgcgccatatcgatcacgtatacgtacgcgcgcgtgttccatcctgctccgcacgcgttcgcggagtttcctaattcgttttccttctacccgcgcgagatggtcaaaattttcgactcgtgcattacacatttctggtatgcgtacacactggatgaatagacgaaatatttttaaactaattaatggaggttataggagtataaatgcgtgatacaccgctaaaataacaaatgaatcggatggttttgaaacaaacatgtaatactacatataccacacctggtagaaacaaaaaatcaccaagttcgcggttacaaaaatcatctgctggataggacaaaattggagcgctcataattttactgcaagaaaccagcaaccaccgcggcaatcagagccgtcggatctccaaggatggtgccgatgatgatacgtattgccgtcccagcaatcctgcacaggcgctggagccaatgctcgtcacccctggtggtggtggttctctgcaccgctcctcgaggaacccgaaccaccaacgcgtccgccggctgctggcccgccgacgactcctcgtcgccggcggcgctgccgtcctgcggccggaggtacgcgagcaccgactcgcgcgcggccatcttcttcaggcacgacacgttcagcgtgacgttcccggacccggagcggtagacccagtagtcgctccgctcgccgcagcagtcgcagcgccagcgcgccgacgacgacgctttgcggaggtggagtacgccgccgtcgtcggttggccggctccggtccagcccggcgcagcacgggtgcaggtcgcggctgccgcaggcgcagtggtagacgagccccgccggcgccgcgatctcgccgaacgcgtcgcagaaccgccgtgttcgccccggcgcacggtcgtggagcgtgaacgtgcagcacctgtcccggtggagcgggtgggtgatcgtctcctcggcgtgggcgcagatgtagtggaggtggaagccgcaggcgtcgcaggcgtacagctcgccgaacccgggctgcttgcaggcgtcgcactgccatggctccttcgaagtatgtgcttatcaaatcttagttatgaagctactagacatttacatgttcagatttattattaggatttgatttttttttcttaaatgaagggaacaaatatagctaggtaacctccagtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46618 - DNA, 1429 bp, Oryza sativa
ccggttgagaatcctcacgtgaattctactcttctactgctttacgtgtcactgcctataatagtactactattatgcccagttcgccacccaaaatatctcgtcttttcatctgccgaatcgccgttgaaatgaaaacagctagtagtactactactcgtagaagtgcgttaaactgtataccgtcgctcgcgtcgcgcgccgttgacgactttcccgcgcctataaaagccggcgcctcgtccgtcattccgcctgtgtcaagccgaagcgttgagctaacgaacgagagtcgtacgtctctagacagtcgagtcaacaatagtcatggcgactccggaggacactggcagctggctgctctacctctccttggcggctaaatgctccggcgatggcgacggccagcctcaccggcttcttgggttcgtcgtggtttgcgccgtcgctggtctggttacatgtctgctgcactggtccttccccggagggccggcgtgggggaggtggtggtggacgcggcggcggcgtcgggggtcgccgtgcggtgtggcggctgttcctgggctgagggggctgccggtgatcggcagcatgtggctcatgaccgggctggcgcaccggaagctcgccgcggcggcggaggcggcgggggcggggcggctgatggcgctgtcgctcggggagacgcgggtggtcgtggcggcgcacccggacgtggcgagggagatcctgcacggcgcggcgttcgccgaccgccccgtgaaggagtccgcgtacgggctgctgttccaccgcgccatcgggttcgcgccccacggcgcgtactggcgcgcgctgcggcgggtggcgtccacgcacctcttctccccgtggcaggtcgcggcgtccgcgccccagcgcgcggtcatcgcgcgccagatggtccgcgccatcaagctgcagcagcggagccggagcggcgattccgccgccggcgccgccgtcgaggtccgccgcgtcctgcgccgcgcgtcgctccacaacgtgatgtggtcggtgttcggccggcggtacgagctgcagctggaccccggcaaggagagcgacgaggtccgggagctgagggccctcgtcgacgaaggctacgacctgctcggccagctcaactggtccgaccacctcccatggctcgcccgcttcgacctgcagagcacccgcgcccgctgctcccgcctcgtcccccgcgtcaaccgcttcgtcacccgcatcatcgacgagcatcgctcatctgctcccgtcgcagccgccatcgacttcaccgacgtcttgctctccctgcagggcaacgacaagctcgccgactccgacatggtcgccgttctctgggtgcgtcacgtcaccgaagaacccaacctttctcgccggcgactacctctgcatgttttct

SEQ ID NO: 46619 - DNA, 2125 bp, Oryza sativa
gctcgtagactactccatcccgctcgccggcgtgcaccggcgatcgggagagcaggtctccggaacctctgccttcgacgttctgcaccgggagaaggcggtaataaggtttttgggaagcgcttcgcgcgactgctccctgttcgttcgcgacggctcgccttcctcttcgctcgcgtgtttcgtgccttcgtagacacttgcgaaaagtttcgaccaagagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgagaccggataaattcaccggtgtgcattttaagagatggcagatcagggtcactctgtggttgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaactgacagaaagataaaaaggcttaggtctaatcgtggtggagagt

SEQ ID NO: 46620 - DNA, 726 bp, Oryza sativa
cgccgttcggatcgggtcggcggagctgccccgggaagagcctcgccatggccacggtggcattctggcttgccacgctgttgcacgagttcgccctcctcccctcgcccgacccggcacacggcgtcgacttgtcggaggtgctaaggctgtcgtgcgagatggccaccccgctggcggtgacagcgtggcctcggcgtgtggtgtgatgacgtgtccaagctacgtcatcagagatgctccttacaaagactacttgatggtgccttgtactccctccgtcctaaaaaaaactcaacataggaggggatgtgaccccttctaagacaacgaatctggactgactaacgacgcttagtccagattcgttatgttaggaggggtcatattcccttctaggctgagttttttttggacggagggagtagttgtagcatatgctttagatgctcctgccactacatatataggatgtgaagtgctgatgctttttggacgcctggtcagcctgcaccggcacaaaggccacaagggtgtgtatgctggcgaaatgaggtgactgagtgtgatatttttgttttgtactgttctcttgctaaatattaccctcggcttgctctgtaaattagtctcaatggtatggaattgtacatctattttactgccaagactcgaaatctccatttccttgcaatgctaagctgaactgtaactgatttggctcac

SEQ ID NO: 46621 - DNA, 16003 bp, Oryza sativa
cacgaatcacattcaagaatatagtaattcgtttaggctacatttcactaggaatagaacatatgaatattctcaggtttaataaggcagatgcaaaaaagaactgaatagcacaggaaagtaatttttccatttcaagcttctcacagtcaaaaacaagtaatggttcaaaaattgaatattctatcacctgttgcctccatttatgtggaactcacaagagggtctaagtgctgcttgacactctgacctgtatttaaataaaatgttatcacctattgcctctgcttattattgggatctcaaaacacaatctattactgtgtatgccttggcattttttaaaatctgagctgcccccttattcttcacattttctcagaaaaccatataaacttttagataaatgaagcttttattgatctcagacaattacatcaagttgatagaaccaaactaagaacacttctggcctctgataatggaactgctgtttgtttaagtagaaagaatggtgtgtgtattttaacggttggtgattgggaattgggatgcagtgaccatggagactgtgttcttcagaatatttttaagaaatagtgttttcggtggatcctatcatggaactgcctatggtggaaagagcaatacgagttgaaacatatagggattaggaagcatgggttcggactaaaatgcattcgttcctgccatgatgcaaagcttcattcgaagcaaaatgagcacatgccatggtacagtggcgtgcaacgagcactgcaattgcacacgacgtgcatgttctgaaaaaggccagtggacactagacatgcagctaatcctcttttgatgaattctatcatgaaaccaatggattcgttgaaaatctgaacaaattgatggatttggtcccagctgtagaaaggttggcaaactcttctcgctcctgtattattgtaggctggagctatgatggaccaaatcatcagaagcaaatttcaccatatataagcatctacttttatctttttctctattttaaaatgtgatcatagtgaagttatatacattctatctgcttaacgctccacattatccaaaaaaatgcatcacactccatattgggaacacgttggtggttctgaaccaaagtcgatctcttgatgccaattttttttttgagctggttgagtagtcgaactgggaacaattactgcttgaggctacaaaatttctgaccgacaatacgtcgtgatcaggaactgactatatgtattccctttcactttttatgtgatttgttggatccatcatctcgcttgggtgtcaatgctcgagagaaacatccgtgcatgtcgtagacagcgttcgtgcagtcttcttccctatgttgttggtgctgttgttattattgttatagatgtgtttgcctattcgctcgccagtgatgaagaatagtcctgcctatatttgcctgtagtacattgtaaagctacagttgacgtgtcttgtaagacccttattattattgtccataccacgacgtctcatcatcgtgttcctgtcgagattaataaacctctatcctatccgttctgctacctctcctaccctttaactgtgtactcgtttactaatccactcaatccctgtctcgtccatggtccatggctggattggctgcagcagctgcaactgctgtgaataaataaataaactagacgagtggttgcagtggtgctctgcaccaaagcagttcagtgtttatacaacaaaacaaggcgaaactgccaaagcagcagcttagctagcggaatggcagctgatgattgtaagcgtaaaggtaagcatcggcgcgtgaagctcataccctcatgcttgcttgctgctgctgcacgttgctgttcccgtctcgccatcggttcgatctagacgggtcgacggcgagacgggaggcgatcgattatcgataccaccagcagcaatactggtgctctccatcggtgggcgccgtgtcggacttcggttggtcgccctcatcatgccggatctgaaacctgacgcccacgccttcttcttcctcgtctcctcttcttcttctagcggggccttcttatgtcggcctagtctgacagagatggagaatttcagttgagatgcgcttgatattacagtgataactgacaagagtatgtgatttcaaccttaagatcatgtttaattcttaagacgctcacagtttcttcttatttatttgacaactaagtttcacgcgaagtagtttaatttttgttgtctaacaaaggcggataatttcatataacacgttcttgtagtgatcaaaagttacctcctcttgaagctgcaaaggggtgcagccgatggcaatggaggctggtaaggagtgagaggcgcggctaacggcgggaggccggactgcacgatagacgtgtccggtggtggagaaggccgacgtggcgcgatgaggcgtagccagcggtaaaggtggcgaccacgatgtgaggaggagctgtcggtgagtgtggcgctgtcttcgacgcacgaaggctagccggcggggggcgttcccacatgtcggcagaggatgagtggtggtggagcatcggtgcgacagccgtggactcgcaggtgatgagcagcgggtgaaaacccagcccggccttggccggaccgacaacgatgattctttcccccctcctaagggcgttgtcgtgccgtctcgtccttcaagggtggttgctgggtaaaagcccagtcgtggctcctttaagttcctgacggacggcgcggcggttttccgtcgcttctatccttggagacgtcgtttaggcatccccttgctgaaaccactcgaacgattggtgcaagcacgctctagatagagttgggctttgtgttggttgtaagggcgttttttggcattctcggctgtgttcctttattggcctagcggcaattggtccgttgctagctttctcctggacctgtgtgttgacgttgtctgtgtatgtggtggtttatttttgtccttttttctggttacgaccttccaggattgtaatcttgtaatttttttcgctttatcaatagaactttgcaccgtctcgtgcaagtcgttaaaaaaaaagttacctcctcatatttcacgtgaaacaattcaattctcgtagcgatcgaaagttacttccgttgcaaacggagatttgtgagttgtatgttgagtgccgcactgatcgacagtcactgccactaaactgattgatgatggggtgtcttctcaaattctgggcgttgtgctcatagcctttgcgacgcactgatgatggattctgtttctatggtaacagaggggtgacgatgatgcagcactgctttgtgcgcttcccaaaagcaaagatacactctgtcacgaaacagattaaaatctcttcatgtgttatctctcttatgtgcgaaatctctccatgtttatctaatttatgtgccagtagtgcctgaacgttcatagttttcgagcaaacggttcagaacttcatatcgacttctcctaagaaattgttcaaaactgtactacgttcttcgcatacagtagagttgagctaagtgttagttgggctgcatataagcccaattacatcaaacaaattgctggctgggccaatcttaaattggagcagaagaacatgaacctaaggttgaatgcacggattatggggatttttcgtctctctctctcctcatttgtcttttgatttatcgactacagttaaatttaaattttaaaacttaattttagagctgattttgaggggttttttaaatatatttttcttgcctttggcttttagaccacgaatgatatagatataaagttctggctataaattagttttcgtgttgcttgacttgcttgctttgttcatatttctacactttatcagtcgtaactcagatgatcagagccatactaaccccttcaaacatatatcttgagtgaattttatattataaagtacctgaattttcctcttccattagtacacatgttgagccgcccatatagagtaaaaaaaatcatgagcatataagggatgaggaaagactcaaaaaatatcgaaggttcgtcaagtcaaggactggggtccaaaccgtttaatcctctttttttttttgggagactgctatacagcagaatcccgtttaggtgagacaataccggttaggtatcatgttctggtattagtaccagattctagatgttaatacttgttgatatcacctgatacttgttgatatcatagcgatacctaccagatataaggagtcaagcaccgaagcgtcatcgccggtggccgtatcttctgcgttgaccagatccttcactgtcacgccttacgccggagctcgtcaccggcggccctactattcacaccccacgtcggagctcattgccagcggccgcgtcctcctttcactgagcaggtcctcttccccgacacacgacggaggtcctcacaagcggccacctcctcctcgctgctcagcttgtcgggacaaggggatcccgtctcgccgaagctcgtcgccgatggccatgtcctcctcccgctgagcaagccctcttccttggcccgcgttgaaagtcttcgcaggcggccaccttctcctcgctgctcagctcgtcgggacaaggggatctcgtcccgataggatcccggcatgtagcatttccaagtgctaattttttcccttatatttacctgaattaaattgattcttataaaaaaaatctacaagattatataaaatcaatgtatttcaaacgatggttgaaattgaaagcctttttaagaaattcaaggatcaaaattgccgtcccgcgaaaattgtaaatgcaattacttagttgaaaaatccacaacaatgttgtgctaaatattcatttcattcttgaacaagaagcctattatattattcttggaagctttggcatatttacactttctcgagatccccgcatccaagccgtccatctcgatctggacggtacagaaacgtgtcacgcctctccatccacctgtcgcatctaccattagcccccacctcctccccccctcttataacgcgtcgccttcccttcgccatgtccgtctccgccgccgtcgccgccgcctccacctcccgtaccctcgtcctcgcccgccaccgctcgccgccggcgtctagggtcgcggcgacaagccgcgggcgtccgttctcctccggcccccatcccctcgccgtctctcccgccacccgcgcccccgccatggccaccgacggcgccgccgccgccgccgcggcagggtcgaagaagaagaaggaggtgctcatcttcgacgccgaggaggacctcgcggtgtccctggcgaagtacacggcggagctgtccgcgaagctcgccgccgagaggggcgccttcaccgtcgtgctctccggcggatccctcatcaagaacatcaggtgattttgattgcttggaccccagagatcgcgcgtttcttgggttgcttcctcttcctccgggtgttctcggatcgcgtaaggaatctctcgccgttttggttggtggtggcgcaggaagctcgcggagccaccgtacctggattcggtggattggagcaagtggcatgtgttctgggtggacgagagggtggtgcccaaggaccatgaggatagcaactacaagctcgccttggatgggtttctctccaaggtattccctcgcgagctctggatttcttctttccgaaactgcttgtcctagtcgtcgtttcggcctggatgcatgatctgctcggggcatgatcaggctatttagggatcataatatttttgtggtttagagtgatggaaattcattcaggaatagaattctggtaatgcttgggttaactgaagatgaaaacaaagaaccgtgatgaagaacagattcaggttttcagacttagagcatctccaatagcctctttattccactctccaagccaaatgttagcaactttggacaaaaaatacactccaacttagggcctgcttggcaacttcgaaaaattttgcaccggtaaagatattacacttgtatttttcggggtcccgaaaattcccttttggttacggaggaaaagtttttccaggcaaatgatgtttgggcaaagagcaatgggtatatcacaatatttccattactgcagcaataggtacccattctgaaacatctttttctataaactgaaatcaaatagaaaaccaactgattataaagaattttcattacaaatcaggaagaactgcaatcgatacttgcaatttataaaagaaataagaggcaacaaatttgaatgagaaaacaatgatcttgaggaatttcaatcttgcctgctaagatctgaaataacaaagaaactcaaaagctgacaaaccagaactcaatctttcatcttgtgaaaataacaccaagcttctccttccaatccctcggtgtggcaccgggcgtagcgctgtgaaacgagcttgaggctgaccttgcccatcaccggataggagagaagcagggggaactgttgcgccagcctccgaagagggctaggtgagggtgcagagtgctgctagagctagaggaaagcctgctggccactggtaagaagctgatcgagctagaggcggcggccatgggatagaggggagaggagcgcagcacgagcacaaggagaggcgaagcggcgagcctgacttctgtcattttatttgtgtggcctgaggaggtgttactgttcttccgggtgtaatgggcattttccggcggattttaatccgataacagcccatccaagcagtcctttccagcccgtccagtaaaaactcatggaccggtattttacaccggttttgaaccaaaaaccgggcttccaagcaggcccttgtgggaagcggttgattgatatgttttctgcagtgtactagatctgtaacaaaaacacttgtgcttctcatccagtttacagaacctctactgctctctgtgagttatcggcataagcattttgattgaccaatgatgaaacgctttattcgactgtgggcagtgggattttataatctgcttgcctgtatccatgctcaattgtttgaaattgtgccaaccatttgaaatataccgtgaaatgaactatagtggttttttgtggataatggataatgaatcattagtatccgcaactgtgaatatttaggaaataagttgttgaagtggtgatccgagatgcattcttgtgtctacttattgcattttcatcagttttctggtgtgcgtgtaaatttctttgctgtgtattcagaagtactccttaactaggttcttcctttcgaatttctaggtcccaattcctactggccaagtttatgctataaatgatgccttgtcagctgagggagcagcggatgactatgaaacttgcttgaagcaacttgtcaagaatggtgtgattgcaatgtcgcaatcgactgggtttcctaggtttgatgtcatgctcctgggaatgggccctgatggccatattgcatctcttttcccaggccaccctcttgttaatgaaaacaagaagtgggtcacctacatcaaggattctccaaagccaccacctgagagaattacgtttacatttcctgtgatcaactcatctgcgtatgtcgcaatggtggtcactggagctgggaaagctggtgcagtgcagaaagcactttcagataagcagacttcgtctgatttgctgcctgtagaaatggctgtacttcaagatggggaattcacttggttcactgacaagccagcagtgtcaatgttacagaacaaatgaggtccatgcctggatattgtttaagctttcatcttaaataaagatccaggggctaatcccagcctggatactgcttaagctttcaatccaaagctgggttgtaatgatcttctgtctaaaaaaggatccaggtgactgcatagttgcattcctcttttatgcatcacttgtaaggaaaacatgagcatgtatgttgtatgttgttcagagtgatgtatctgagacactcctggtttcgacttagtaaataacctttcctggcccttgctcaagtgtctatgtttgttaaatttgcgcggttaataaaccggcgatcaacttatctacatattttgcaaattcagatagagaactcattttgtgcatgttattcaaatggtttcaattcaagacacaattctttttgtttactgattgaagtgatgccaatgctgcttgacaaagtgaggtaaactgtgatacaagcttggagacctgcatgattctgcattattcactattaagaggagtcttattcagagtgtattgcgagtaccttcagtttccagtttagtaaatcacctcttttgggcgttgcattggaaatatttagatgttcagctgccacttgtcaatacctgtaattgttagtttattgtgtatactgttccatccacagacaatccatatctttttactgcatttgcacttcagaacggcaccaatttcgctcgctttcagctgcctgtacatcgcaaggggctagtgattattcaatttttagagccatgcataggtagtgtacaggttgatctgtaagatttatattttcaggcagtactgcacgaggatgaatttacttaggcagcagcctaaatggctgtacgttcaaggcagggaactcagaactgattagcaacatggcctttctacccaacataaatcgcgcattagttgtgctgtctgacactgacctcggtacatttctggcatctaaattttcatagacattcacattttgggcaataatagcatgttgacccgttgacaaattatttcacatatttaaccgtaaggaattttggaggaatttcataagaatcgaactactcgttaataatatttgacgttaggagtactagtactcttagcatattttgaagttgggagcactaattgtaatactggaagtagtgaattttatgaaaagttctataaattccatactcctatgttccaaagaagccttaatcatatgataattgaacttattcctaaggccgagtttagttccaaagtttttcttcaaactttcaatttttccatcacatcaaaactgtcctacacacacaaactttcaatttttgcgtgaactgaacacgccctaaaagaaattataaattccatccatttcaaagaagccttaattggataattgaacaccacgttttcgacatgatttggcaggccaaccgtggtggacacatccagagtgaatgcagggagacgagacgatggaccatggctgcattcccctcgtgctgccacgggctctcggccggccaagccaagccgccgcaccgcccatttcggccatttgcaccggcatttgcagccatggtcctccatccatctgcaacgcactccaaaaatcccaacaaacaagcagcagcaacacatgattccatgagctgctccagtgaaagcttctgctgccactcgatctccagtttgcagcaagatattactaatccagtacctaacctctcacccaggttcatgtgaggtgtgaccctatctcctctcaagactcacatgagctttggagcaaaagaacatggcctagaatctagggcactcttaaaaatctaacctattagtttcaaaagaaaaaaaaatctaaccttggccatgttagaggctcatcatggtgtggcatggaattctttttttgttcggataaataaaactgaaagattcagaagcctgatcttggggacacgttgctcgtcactacatgaggagagctccatcgttgctgctgttggtttccccacaaaactactccgcatgttcaactgtctcatgtaagatcatattaaaattcttggtgttgcaacttgcaaattgtgactttgtgactgaactcatctgtccaaattttgtgtgtgatcgaattaagaaggatactggatatatagagaattgttaattaacatgtggtagcagaatagatgataggatctttcattttttttgccgcagcaattgataaagagaagagaaaggtaaaggtgttcgtcaaaggtgcgaccagtgcagaaaaaaatttggggtggttatgattgccggacagacctgaccgatcgatttgcttttgtcttaaggttttgtgcttttttttgggcctgctttattctaaccatgcgtattgaattaaatcaaaatttagctggagtacgtaataacttgaatacgaaatacatacgaatttctgaagaaatttgcagccattacatgagaaaacacgcgcgttattgtcatgtatgattgcgtatggttgttaatttggcttggctgcatccacaaaagattttgatgactcgttcaatgagtcggtccacgcgaaatattctccaattttttcttcgttttttttcgagcatatttgatccgttgacaaggtgaggatttccatgagctaaacgtgtcaggtcacaagtcaatcagtgttgatcacgcccatgccattttatagttcacacgtacattgacctacctgaaattagtgcaggattaggttagaaaaaaaagttaattagtggttgggattttcatgggcttcttctcctggataaaaccgtgtggatttggtccactctgaatggttcattcaaaatttagcattgcaagtacacaccttttagacaaacatttagacctattataagcctaccaaatctcgcatgaattgagttaaaatacactcaagtagatgcatataaaaaaatcagaaaaacaaacacgctattaaagtatgaacaaattttcaggtcaaccaacccagtctccttttgtccttacaacctaagcttagttattcagacaaacataaaattgccaaagaaagagttcaagaatgtatccccactttgaatatttttttaaaaaattaaaaaaaaaatcaaagaactaaccgaattcaaaccaaaggtacatcggttctattcgtaccaaaaattcctttgaaactactagtatatgattctcatcctctacttgttttgtttataagctgcaactaatatcgaaacgtaaccttagagttgatttaagatttttttcttttattctactaaagctattatccagtcttaataacctctataatataatttttactatacagacataaaaagttttacctaaactaataacctaataacatgttctttttccaatggtttatcaaccgacaagagcccaagatttaccaaaccgtttggattgggactactatcaccttatgatataacgattatcacgaaaaccacgtggttaccacgaagtatatcgtggttaaaaaactgaaaatgttatttcacacgataactgcacggttttatagacatttcgggagcccaaaagtttcagaacagatccacaaatgtggtgggcccacaccgccagcctctcccactgacacctaggccccacaagaaggacagggccggtgggtcccacgtggcaggccggaacaaagacccgtttaaacgcgcacggcacccacccactcctctctccctcttcttgtgtgtgtgtgggtgtggctttattggcgtcacatgcgccctcttttcctctctctgtttttcttctttttctctctctatctcttcgcttacgagcttaaagagacaacgagttaaagccgaggaagaaaaaaaaaaccaaccgatttttttttaattaaccggcgcctcctccttgcgcggcgtgcgttcgccggcggcgagatcctgcggcggcggaggaggaggaggaggaggaggaggagggggatggagtggtgggggccgggggagtggtggcgctggtagtggcggggacggggagtggttggttgggtttggggagtttggtgggtgagagagggggagagggagaggggacatgaaggcgctgcggcgatccagcacctcgtcctccccgtcgtcgtcgtcctcgtcgccgacggccgcgtcgtccccgccgtcctcgtcgtggatccacctccggtcgctgctcgtcgccgcggcgtcgtcgtcttcgtcggcgtcgtcgtcggcggcggcgggaagctccgtggccatggtgtccgcttcggcgcccgccgcgtcgtcgtcgccgtcgccgtcgccagcgcccgcccccgcgccgtcctcgccgcactcggatcggtgggttttctccctctccttcggattggtgaaaaggaggagtaaaaatgactccttttttagtcctttccttttgggggcgtcttgatctgcttcccgtggagtctagcctcacatgttctgatctaattggtggtctggaggctgcttaggtgctcatgttatggtttttttgtgcgcctcaatccaaccaagtctttggatttcagcttaagagtgcagtaaaacgttagagtgacagcctggcttaattgtgtgcctagcaattcctgcctcgtgcaggaaggttgcggggcctgcaatccaaactgaggacaccggatttttaagagcgaatcgattatgtgttcaatctgttgacatgatagtgggggagattcggtttgttgattcagagagatcatggattctgttgcagagtggtttgcttactctaaaggtgccttccgtctaagttctagtgtgataagattttgtcatagtttagtggcagcgttagtgctgaatgcagcttgcacaattgcctcaagatatgttgatgatgtgatgctgttggtggtttgaacaagggacagcttgctgctatcttgaattatgtgctttaggttgttggatggcatggtatttaagaccttggaggtgatcctgtcccctaaggtagcaaatttagtttctaagaataatagggggggtgcttgatgtttccttttggtttgggagtgaagctgtggcactgtaaatgctacctaaaagtttggatcttccatgagttgaacaattttgctgacctgaataggtatcaccgtaaatcacaagagtttttagatgatacacctccagttttcctgtgatctgctcttgttccgtagttatctcttgtcaagtttgctttcaacttatttgttcactgatctaggtattatattgaactgcatgttgactataacgattcctttttgtagcccaggtcctcagataactcataactatgaatcattgcctagaaaatcgttttatgtggtcatcttttcttaatccaattaccaagttcaataccatcaatttttttcactagcgtatggtgttagggaccctgtttcatccacagattccatagtattgtctgatttatgcctcttgatcgatgtatgtattattcagctatgtagttttgtttagataatggataaaattgtatggttagttcaaaatatggtagaccatactgcttgattaagaatcagttcatgctgcgcataacgaatgtatccttgacgctgcacaattatgttcttaacagcactttgaaacaataactaggaggaagtttttcagtatcacgtttgtttcgtaaactaattaataccttaatatctgtctattttatgaatttgttttatatccaaccttttcgtgtgcatacaaattatatgtgaagttggatttatgaggactcaaagcattccctcttcggatgctgtagcttagagagtgtgttaaagatggtactattagttagtctgtcagttggtatggcagtgttatcttttattgatccatatcttccttgttgctccactttctaaaactattctttaatcttctttcaggggtggaataaagtctccatggtctcgaaggaaaagaaaacgagtactttctcgtcaacaatgggaaggtctgttttctgctaatgggaaacttcgtgatcgaggaaagaagtttctgaagaaagttcgcagcggggtaagtttgattatctatttgtttagatgtcctgcatatgtttacaagaatacttgcctattgttttgtttgttcaaagatttagacatatatagtagtgatattgaaagcatgttctgcatcttactccgtacagtctaattaatatactggccttttttttctgttgtgtcagggcattgaaccaggaatcagggctgaagtttggcccttcctgctaggagtgtgagttttttaatctcttctatgcatctagtaattcataagctttcgtttctttgaccaagtttgaggtcgcaactacatacacgtagacttcctatagcacctaattggttatgtgaccacatggagtgtgcatgttttgtgtagctctacgggacggctccgattcatggactagggtccttccttactgtttcccataatgaaaaggtttaggattatcagttagagaagatagttcttcatggcaatataatacaccattcttagtatttgaatccaggataattaataccttcatactacctctgtcccaaaaagacttcatttctcagttcttgtccaggtgcatagccagaaatgaagtctttgtggggcagaggtagtaacatcttttccagtttggttttggttgatgtgataaattgtatggttgttgtcataaagtctgttcggattgttgtgttgtgtttaatgtattctgtcttcaaaccaagagagattgacgctgtcaattcttatgtgcagctatgatttaaatagcacagaagacgaaaggaataccatcaaaatcaagaaaaggtattatattcattgctctgaaggctgttcaatttaagtaggattgaaacattttgctcaatgtgctgtgtttccatcaagctacactaaaagcccaaccactaatatgtaacatagcagaagatccccaagtagtttcagaacatcaatattgttattttgcaatggcctaaagaaaatgagactatgatattctaaatgcgaccaatataatttctaatctgataagaacttgttgattgatgtggcttttggttcaggaaagagtatgaaaagttgaggcgacagtgccagcaaattctgaattgttacaagggcaatgggctgaaagtaataaatgaaaataatgaggagtgttctggtatagagtttagtgctgaaggatcagaatcaccttgttttgaagatgtcaatattgcaagggcttctgtgtcacatgaggagctgaaacctgaatccgagcctgagcaaccagataactcaatgtgtgctgttacagaatgtatggaagaagacacgggtgaattaatttgtttagatccttgcatagcagagtcagaatcttctgattctgaatcatctgatgaagatgaccctggaaggatatcgatgtctggtgaggaaaattgtgatccagatcctaaatttaccaggactacttcattcaaggcagacttttttaagtctagcaagacttcagaggattttgccacgtggcaacgcattataaggttggatgctatccgagcaaacacagaatggattctgttctctcgcaaccaggccgaaatttctagagagagagctttgcagtgtgcagaatctgttgggttaagagattatgaccatttagatcccagtatgatttatcatgctgctcgattagtggggcttcttgaagcatatgcggtctatgatccagaaatcggttactgtcaaggtatgagtgatcttttatctccaataattgcagtgatggaggaggacgatgaagcattttggtgctttgtgggtttcatgaggaaagccaggcacaacttcaggcttgatgaggttggaataagaaggcagttgaagattgtctctcagattatcaagcgaaaagattcgcacctg

SEQ ID NO: 46622 - DNA, 1543 bp, Oryza sativa
cagcagttctaagtagcacacagtctttctcaggaagggctggtcagggaaacgatgcggcaaatcttggaccagccactatccaatctagtacacaaggttattatggaatgcaaaactctcaagcagcgtatgcagtccaacaatctcttagtggaagttggaacgcctcaagtcagtttggaactgcaataaatcctgtgacactttctcagcctgccatgggtagctttgtagttggacaaaatgcagctttaggaagtgcaggtcagctaactcctgtaccaggtcctgcgacagtgagtgcagaagtagttaattcacagttgcagtcccagaaccagatagcatcttttttatcacaaagtgatggcagattagctgatggaaacgattcaaagttgggggaagatgcttcgcgtgaaaggatgaggtcatcgggtgaaggtaggctctttgcgaaggtttatatcgttcaatgtattgaggaaacaaatacttaatatataaaaaaaatgtacaccgtttctttaatgaatggtaataggctgagaattataaaatcgccgcgaagaagtatttcaatatggcctaaacattcttttttggttctcacagatcttggactatctggtgcacaacctggaggggtgcaatcaaatactcaacaacttgaaggtattgctcaatgcttgttcattgtttatgccattgtcttctcttttactgtattagcatctgttgtttcacaaaggaagcttttaatcccgaagcaacttttgttcaatgaaaattatggtttaaatacctaatgaaactgatggcattacctgcagatgcaaggaaccagttacaaactgatgcttccaactcggtaaagccatctcagctgatatcaacaccatctgctgaagcagtgcagccctcgtccacagccatggctggtggtgataatcaaaacactgcttgggcacaattggcaagcacatctggccaatctcagcctcaggcggctggaaatatgacctggggagctactctccagggtaatgcaaacatgggctggggaatggttggacagaacaacatgaacatgtcttggggaggaacagcacaaagtgccacaggctacaacatgggtttggctatgcaagcacagccaaatgcagttccaaacatgggctgggttacaccaaatcctggaaacaccaatatgaatatgatgtgggcaactcaaggccaaggcactccaaatgcagcagcaatggtgggaactcagatgcaaggagttgcaatggctccatggggggccattgcacaaggaaatacaaattcttatcctggttgggggggccaagttggaaacatgaaccaaaatgttggatggggtgctcccatgcaggttaatccaggtcccagtactggaaatgggacaggccaagataataacaatatgaactggaattcaccaagcgggaacccaaattggaataaccagcagcgagacaatggaggcaggcattctgggcatggtggtgatttt

SEQ ID NO: 46623 - DNA, 1057 bp, Oryza sativa
tgatataattgtcacttctgtgtatgtacatggtcttgtaaagagtataaatggaaaccataattcgacttttgccagaattgagaattggtaacaaccatttgatttttttttatgaattattcgtaccgattcgatcaattgaaaccaacgccgtgtttagtactaaaataattctaaaagctttcaacttttttatcacatcaaaacttttctatacacataaatttctaactttttcgttacatcgtttcaattttaaccaaacttctaattttggtgtgaactaaacacagcccaattgtgacaagtatcacggcaacctgaaattaatcctacagtacaaatcaaaattttaaaaatccaaagaagtaacgtaactactcgtgaattgtcttgatcctctgacctgactggtgggccctctagtcggcgggtacgattcgggaacccaatcgccgaggttggcgggcccacatgtcagccagcgcaggggaggacaaaatttgacgacgaaatctcttcgtcacggggagtcgagaggagaggagaggagagaggaaaagagagcgcgatatgggggaggaatcgccggcggccggcggtggcgcggcggcggcggcggccggaaaaccatcgggcacggcgcttccgaggagggggaaatcctgcaagggctgcctctactactcgtccatgctcagatcccgcggattcaaccccgtctgcgtggggatcccgcgctccatcccccaaggtaaaacgaaacgaaccctaatctccccccccccccccccaaaaaaaaaaaatcgcagcgcgcgatcgatcggcgtgcgggttttcaatccatcggcaaaaattgtctctatcgatttctggtggttcgggttcagattgatcggagaatctcacgaaactgttgttgtttggttcggtgctccagtcccaagctacgtggtggacgagcccagagaagaggcggcggcgcaggggcatgatttgaggcagttcaagtacgcctgcgctggttactccatgtttgtggtggataacaaag

SEQ ID NO: 46624 - DNA, 1982 bp, Oryza sativa
gatcgtcgaagaaggagtgagggaggtcggtggggagggggggaggggccgaagcttgatctggatcctccttgtcgccctacattaagtgtgcaataatctacaacttgttgttttgttatgcttaatacacgtgaaatgagaagctacccattgcaacctgatcaaccaatcaaattgttctgcatctagggatgagccaaaccgggttcatcggaggagtagtaagccccggtgcctcggccatatctagatcttgcacgtccatgccatcagggagctcccaatcgaagtggtacaacaagctagcgatcaccatctccaatcctggcaatgctaagatgatgccagggcacaacctccggccagccccaaatggtatgaacttatagtcgttgcccctgaaatccactgcactgcccataaaccgctctggtctaaactcatccggtgtgtcccacgccgcagggtccctcccgatcgcccacacgttgatgaaggcgatggtcttggccggaatgtggtagccttggatggtggtcggcatcgttgagtggtgtgggatgagaagcggcgctggtgggtgtagccggagtacctccttgatgactgcttttaggtagtccaatttggttaggtcctcttctgtgacggttggtttggagccagtgacttgtatgatctcgttttgtagcttggacatcacctgcgtgtttcgaatcagctccgtcatgatccattctagggtcacgaacgaggtatcggtagctgcacccataatgtcctgcaaaaagattaaaaagaattttgtattcagtttgaatttagaaaaaaaagacccttttttacctataaggtatcagaagtagattctctcacgttactattcactgtgactaccacatgttagccaccaaatcagtgggaagttacgtcaaaggatctcaatcctaaggtatcaacagctgcaccaaaacgtcggttcccaaacatttgttttccttaccaatcggggaaaaatatgacttttttattgtgcccgtaagtatcaacatctacaccaaaaatttgtaaactaaatgaaagtctaagatttgccatgttattatgataaagttcttactcctagtaataaagaatttactcacggttaaatttgaaaataaaatttttacttacagttttattactcgtgctgacgtagataatcttatgctttcaaattttacgatagttttcagttttgcactgtatatttcccccataatcctttacctgccacgtgggtttatcgccagtagcggaaagaaacaactcactatattgacttttaaaaattttaaattttagtaaaatttgttcggtctttctctcatccctacatatggcattcaaaaccctgggtttttgtaaaacaaaactcggacattcgatgctggacaatggatatatcttcaaaaaatggtggatttttttcgttaccttgataatagccttgacgttatcctccgcgagctcgaggccgccggcggcggcggcgccttgtctcctcagtcgcaggagcacgtcgacgaagtcctcctcctcgccctccgccttctcgtcgtcgtgcgccgccaggatctcgcccaggaacctgtccgactcgtcggccatgtcgtctagcttcttgttcaggcccgtcagcttcctcgccgcccaccccgccgcctccggcagccggtccacccactggaacccggcgagcagctccgacgtgtccgccatcatcttcctgaacctctccgccgtcgcgccgctgccgccggccgccacgcgggtgatgaccccgttcgtgtaggcgtacaggagctccctgagctggacggcccgcgccgcctccgcggcgcggcgagcgcgggcgacgagcgcggcggcctcggcggcgcgggcgggcgcggcgaggggagaggaggtgcgccacggacagcttcttggtgcgg

SEQ ID NO: 46625 - DNA, 15360 bp, Oryza sativa
cgaacacgagcaacgctgcggcgacgacgacgtacgatgacatcttggtggattttgccacaaaggtttggatttttactctgaatagcttggtgcttataaatcaatcagagcacaatgcattccatgtccttgtaaccaatcaacacggtggctggtggtggctatcagatcgattgcgagtctggaatattctatgatagatgttttttttttctccaaattggatttttatagaaccacatgtttgatgaactcttttgccatgtagttggggatattttctgaagatcatcataaatcatctccagttggatggctgctttctggctatagtgcacgtatgtttgtgagttgtgtcaggttgatctagaattacattcagaaatacatgtcaaatatttgcgttatcaagcaccagcattttgtgctgtgaagttccaaaatactctgtactgtttacagtcaaacacctttcttataatttttcaggtaagagaacctttcatataaaacacaaagtacaggtttcttcaataccacctgtattagtgcagtaaaattgcactttgacacatccacacaaaattcagtgcaaacccaaaaacagaagagaaaagaagagaacatgggaagaagctctcattattgtatagacccccatgcttttcaatccaatcctatgaataggcagtgccatcttaacacaaacctacttcttacattttcccctatttataacttctgtccctcatctatatctagatgccaaattattcaatctcaatgcctgacatggccttggcctggatcaggattgccaacaaggtaagcaagaactcctaccaatggagcattgatgtaggtagttggttcagatttcctgaaatcggcacggtcatcctcataaacatcatcctccccaggccccccaacaactgcgccaattaacgggtttgggttcgggctagatgaattgtagtaaggcgtgccgtcgttgcacgcaatgcgctggggatggctcttgatcgaaggcaacgatgatcctcgatggtgtatccgttgaggataccgatcgccgtacccgaccatgtatgacattttcatcgggttatctcctaatatataatcagcctgcaaataagtaaataagtacaatataatgttcagagtttagttagtcaatgttcctgcatttcatatttggatgttatgtaggacaattcagtagtcgctccctccaatataattacttttggatcttgacataatctttgtgatgctactttgacaaaaagttattttaaataaaaagagttgcatattatgacagtttgtttaatgataagtctagtaacatcattcttacataatcagtttataatcttttttattaataattaaagtttaacatgcttgacttagcattatttcaaaagttagttatattttgggatggaggtactacctgctttctggctagctgctgaagagtggcaggaccaaccgaaacatttccacagttgacagtgcgcgaggaattggagaggtacttggcataagtcaggagcaggaacgaaatggatgtaacatgctgcatgttgctgcctccaggcttgtagatcatgcccccgggcgtgtacgtgatgtgcggagacgacgactccggaatcagtgtgcagatgaatccatctgcaaactccttgtaggattgcagagatagcacctcgccatctatgaactcctgtaaccaaatttggaacccattttctctttgtgtcagctactgatgtttctctgaatttgttgcagctgcagaaggtgtgttcagaaactggaggagattgatggaggcaaaccttggagacaaggacattgatgccggcatgcttgttgtcccagccgaattcgttggtgctatcctctgctccaagggtcttgccgttgttctgaatgtagtcgaggtaggtgccttccttggaggctctccgtagccatgctgctccccacagcagctcatcctgccaagaattttcagtcgtgtgaactttgagatttttattcacccccccccccccaaaacaaaaaaaaaaaaaactatgtgatcaattatgagcttctgatggttgtgaagttctaattctggagttcgtaacaacagcatttgacgggttcagttttttttttccagaaatactagaaaacgctattaccgttgtaacggtttagtttatgtttgatggataaggtatcaggtttgatacctctgtgtatcatgtatttgtgtaccagatatggaacgtaatagattatgatgacatcagcattgtaactatatactagaactcgagtatcattttttttagagaagggtttttacccggcctttacatccaatcggatatatgcaaccgattatgatgacatcagcattgtaactatttactagaactcgagtatcatttttttagagaagggtttttactcggcctctacatccaatcggatatatgcactcattttatattaggaacttagcctatcaaataagaaacttagcccttaaataactcaatctgaaattcgttcatatggagatttgaactcaagaccttggggtgctactcagatcaatacaaccactaggctacatgccctttcgcaactcgagcatcatgtcacactgttctccggccaacttgtttttcaggtgaaatgacggcttcagtttcacatatgcctattccatgaaaccatgtcgcaacagttgcttttgccccaaagctcataaatagattagccctgtgaacaacctgaatttgtggagtttcagaaatagaaactttaatgttcccggactagataattgtttaccccttcattttggaaagaaattatcgtgtattcctagtttaatatccctgtaaaatagcatttacatgtacaatggttatcaatagtggtctcttagcgttgctaattaggaatacttgttgacgtggaagaaagaggagagacaaaacattgttgtcatgcataacaacggcttaacaacgactcttaatcactacaatatggaaatatggttgcatgagggtaaaaaaatagaaagaatattaataaaataaatattttttgagttaatgattagagtttttatcgtttcaactgttgtaaagatacggtctctaaataatcttatattgtttaagaaactatactcgtctctaccattgaatatgcccttctttcttttttttttccttgaccttacctactggaattctcatgctaaacttataaagacgtgcaatgtcagctggtactccatgaagcaaggcaccaaagctgctttgtttcttctgaacagtttatttatcgtttatttttatatgcgagagatatctaagcagcgtttcagttttgatgccaactactgaattgccagagcagcagctagcattgcagcaacagcatgcaaagctttttgtttctagtgacaaattaaagcagcaaaacacaaaaaaactgaagaaatttaagaacaagacaagaattaccctgacctgatatccatcgaagtcgcagtagaacgggcagccgccggccctgagctccgggtcgtcgctgtacgcgcccttgtgttcgtccgcgaactcgaacgcgctcctggcgccggcgagcagccgcgcggcgtacgccgggtcgtcgtcgcggaacaccatcgacgccgcggccagcgccgccgccgtctccccggccacgtccgaccccggcctcgccgcgctgatgttgtacaccgtcctcgctgtgtccatgtcctccggccgctcccagcacccgtggtccttcgttgggtcgcccacctgcattgccatcgacgccgcgctcacatggtcgtcgccgtcgacgaggaagacgacggtgcgcagtgcaatgtgtttgtgtgtgtgcttgcctgaatgaagatgacgccggggtgggagatggtcttgaggaggtagtcggtggcccagcggacggcgtcggcggcgtgggcgcgctccgcgggcggcatggcgtcgccgaactcgacgacgccccacgccagcatcgtggcggtgaacgccatcgggaagccgaacttgacgttgtcgccggcgtcgtagtacccgccctccaggtcgacgcccgccgcgccgccgtccgacaccgccgagtcccctcgccacgccgcgcgctgccccgccgccggcagccgccccgaccgctgcccctcgaagaacaggatcgacttggccagcgcgtcgccgtagtcatgccccgccgccgccgccgccgccgacggcgccgcgagcgccagtagcaagcagcagcacactagcaggacacgcacgcgcgagcggcggcggcgcacgggagccgagaggagcgccatgtcgtcgaacactcgccgcctcactagagcatgcacgtgacgtgagcacactgagatagctatagctctcgtggggcttcgtatttatagcacgcattcttcactagccagcaaacggcaagcttagctcacggctggattatggctccagatatatacgtaattaacacagatactatattctgatatgcaattatgtacgggatttttatatagagaaataataaatgctttactaaattcgtctcaaaatataaattggaaatatatgtatatgtctagatatatatatgactaaaagttagaaatatatatgtctaaatacatagtaagaaattattacatttccaaatatatgtgtccagatacagaatgagaggcaaagtgagtgtaactcaactgactatgtttctagaggtggaaactgtctatccaactgttcaaattttatatctgacataggtgctcgcatttacagctattttttaaagaaaaatggtaactgacgtttctattgacaacaaatcgtctgtagtgagtagtgacttcatgaatcttaaaatttatcggaccaatatttgaaagcgctcacagggatagggcgtacgtgttgtgtgctcatatgagtggtgagcgtgcacatgcttatataagtgtatgcgttttgtactttgtttttttttaaaaatggaacaagaagtagttgtatcttcggatgggggtacaagttatgctgatatgtcctaattattactcccttcgtattataatgtatgacaccattgacttttcgaacaacgtttgaccattcgtcttatttaaattttttgtgcaaatataaaatatttatgtcatgcttaaagaataaatatgataaatcaagtcacgataaaataaatgataattacataaattttttaataaggtgaatgtttaagcattaataaaaagttaacggtttcatacattaggaggaagtagtacaattttggagggtaattagagagaggttatggtgggacaaaatgtaggggtcacgggagcggtggtaagacagaggtgaggccaaaggtatgttttgatgggttacacgggcaggcagacattcagaaacaccttctgtgctcggtgtggtgtggtcacatgcagcggttacccaagagcatgagagaaacaacaaggccactagaatgatacgtagcactaggacccaagatgtaagatccacgagtaggctgtgttctaaagttctcatggatgactgagtttatcgcaattatttgagggcagagatgcaaaagaattaaatattagaaagttaaacaatcaattttataaagttatctaagaaatactctctccgtactcataaaggaagtcgtttaggacaatgtttaagtcaaacattggaaatataaatcatgaataactcttaaggtgttgagtttaaaaatgtaaaaattatatgaatagatttgtcttgaaaaatactttcataaaagtatacatatatcatttttcaataaatatttttatagaaataaggagttaaagttgtgtttagagaccgtatcgctgtctaaaacaacttcctttactagtatgaagggagtactggtttaggagtttcagtaaatgtgcccgtgatgatttataatatgtaaaaaaaaaaaggaatgtgtcctgaattcccagttattgatagggattatgatttttctactagtaagagaaactgaaccggttgatcccggttactaattatctcgtcggttgatgaaagctgagcagaaaaaggaaagcattgatagtatttattccgaaatggtaaccagatagtgctctttttttggggaaaccagataatgctcttaacgctgatacttgctggttggatatccctttttgacagattttaatactccgtccatttcaaaataagacacaatcaccttacaaaggctaaagacaatctccctagtttagatcaccctaataaatattttctctgttttaggttatgagactttctagcattgcccatattcatatagatcaatagatgtctagattcattaacatctatatgaatgtggtcaacgctagaaagtattataacctaaaacggaggtagtataatacatgcacccaatataattagagatcttaaaagtagagaattttaaaagataataatttagtggagaagatgggctaattaattgcatttgtgtatgcacaccttatattataaaacatcttgaaaaaaaattgagttgtgcattatattatggaattgagggagtattgtatagggaaatcatctttttaaatgtgcacatcaagaaatttaagactaaataaaaaaaatgcaaatacttattagtccagttattacttggagaaatgagtatacctccagataaattatttaagactaaatcaatttcaaggatcaaaatcagtgcacatacgtatctggcgaccgatacactcaactgcaacaacgccctcttcatgccaatctagcaagaggacaacacaaaattctcctgtgatctgcctgaaagacagcatgttctcttcatttctctttctctctcattgtttgagacatgtcaaaaaaagccaaaatgtggcgaatctatgtgatcgagaccagtgactctaagtgagaagcttgagcaccgaccatactgatgcgtacagtttgctgtgtttccctggaaaaaaaggaagctgttattgattatcaacttttggattggtgagtcccctccggttcagagtttgaggctggtgtagaatggaaatgtgaagcaacaaatttgagagaattgctgtggatggggactcctgtctgttccatttaggaatgtgatgtgagcttcctgtgcagcacgcaaactgaattttgggagcattcagcaattttttgttccaaatataattatgtgtagtactaaataacttcaaaattatttccatatatattactcttaacgaatttggtcctttgctcctgagctaatggtagtaagatgcgcgcttcccgatgcaaaaagccagatttgcaatgcatgtctttttggttgattcatctaggggtggaacttcaaccaatattgtgaaaaaaaaaatgaaagttcccacattgttttgccaattttaggcgtacattcgtaaatcagttagatgaagtgtacattattactactcagcagggtttacaaaaaccaataaaaaccagtcggtttccctaaaaactaaatctccctggcttggctcgggaacacaaattaaaccgcttggttttccattcaagtttaacaaaaaaatatatattcaaactggattttaaatattttacaaaatttgatcatatttcatcggcagtcaacaaattttaaacggttttcacaaaataataataataataagcattgatccggtttttgtgagtggttttcccgctactcaatactactactagtagtataaacttcagagacctcgtactccaagtccaacctgcttgaaacctccattttgctcctcctgtaagctacccagtgagcagaggaatcacatgataggtctccttggacggatcaaatcaatcttcctccttttcattatacatttgaggccacagaaaaagatggcatgcaaaagcaacgatccgttgcactttctgctgcatactgtccctgttccattcttcagttacactgatctaaacctttttgcagaagtgatgaagtagtagtttttcagagttgtgtctctggcaagtgacaagacgataatctgtcgctaagtatctgtgaccgtggctagctgtagatggtgaagtttcaacaagttctcctgattttaaaaaatgttttagttttatagataatctgacccttgatttaaaagatgctatatccacctattataataattgtaaatcttcatctgaatttggcgaaaatttgtggattaaaacttgatgatacgaagtgattaatgtctcactcggattaacctgaacaataaataagatccaaagttgagcttagatacacttcggtgtgcacactgcagaaagtcaggaggacctgtaaatcgttagattgcaggatgcactttctcaaggaagatcacacaattttgcgagacatcatgcgtggcccggatttttctttcttcgacaagttgtgggcttgtggcagctctttgcgtgcgagagtccaaagcttaagatcccgataatgatgatgatcaagagcaaagccgaaaagaggttatgcgttcttcagatatcttcagagaggaaaaaaaggaatagtgcatgtattggaaggaatagtgatcgatcgattgataggtccagcagattaaaatgttgaaaagttttacactgtcacagatcatatagtcgatggcaccgacagagacatcacaggtccccttattttttaaattctctggagggaaggttctcttattatttccatataatttaaataattatatttttttgcaagaatttaataacataaactaatcgtaatacatcactccataaatatataaatttaattatgacttttacaagtcgagaacaaaagcaaatatgattttgaatatgcacatatactactccacgtttaatttgtttttttttacaatatcaagaggttgaatttaaatttacatgtttgagaggtgaattcatcatggcatgctgtgaataggggtgaaaacgagccgagccttgcagtggctcgcaacaaactagacttggatcggctcgacttagttagggaaacaagctaaaacttgagcttggctcgggtcgtttcttggctcaagccagctcaagctggcttgcaagtattcttgtcgaaacacctcttcatatatattttataattattaaaaaatgcaagaataaatcattaacatgtaaaatttaaataagtttatatatatatatatattcaattcttcaaaatcttaatgataaatttcaatttgataaataataacgccacaaaagataaaataatcgatataaatacatgatggcctaggctcgcgagccaaaacaagcggctagcgagctagctcggctcggctcatttcagcaacgagctgaaaaggaggcttgggcttggctcgtttggtttacgagccgagccgagccaaccaagctcgagccaagcctgagctgagctcacaagcctgagtttttttttccacccctagctgtgaacaagaccgcatgtccgcaccacgtggtgctgaaggggatccaacggctgcgagtgcgtcgcaaagtcgaatgggccgcaccgctgaaatcccgttccggcccaatttaagtaggcccacacgtaagtaggcctaatttaagctagatgggccacatgtacatcggaatcccaatccgtcccaaaccgtaacgggccgcatgtacttggcaaccacgttacagcccaatatggataggtcggggttccactgtggcccaaacgtatcggtcctgatgtgcgtggcaattttttttcctagaatgactgaaggaggtcaatcaatgtgattaagattgaagaaaaaaaggttacctgaaaagttttacatcggcagctggctgtcgataaaggaagtgcaccagagcacacaccccgaaccatgtgacaaccgcccaaacacacgttacagagagggaagccgagtactgaactgaccgtcgcactgtgcatggaaattgtattgacccattttgtattggcccgattttgatgttagagtattaaattttgggggttttgatggtttcaccattccggcagatgatgtcaatgagggtcggagttttaatctccgaaccccttgggccttggctaatgtctgctgcatgtccgtttgttcctacctttggggtcatgcaggtttcccgttcaattctcaattaagacactctgaagtgaagtgcttgtatgagacgatcatgccaaaatcttcaccttgattcttttgatgcatccaaaagaataactaatttgaggtgaaatcctcctcctggaatggcttaaatttacagcaccgaaacccatcttgttcaaaacattattctccgaatccccttgatcagtattatttgggatgaaattctaatcttcgaccaccctttgctgctgctgtatcatcgtcatgccagcagcagaatccggttgtctgtcatggctagcagctgtagatcagtaggcagtagatgataccagcagcaatctttggaagagttaacaggattaaaatcagaagaaattgttcgaccagtaaatcaaagtcagtaacgaggaggagtttgcgaaggagacgagcctgtacgaaccctctttgcaggaagagggaatatgctctgaatcatctcctgctaaacttcatggacaaactattttgtttcagcaatcgccttctccatcagagaagaaaaatgaataattacgcgtgcatgggatgggtgatcgatcgattgatacgtccagcagattgaatgttcagtaattttcgttcgtgtaatgtttttgtttcaacaaatcgattacacaatcatcgcagcttgcgctcttgtcgattttttttatattttttgtgagaagggtatttttgcccagcctctatatccaatcggatatatacaacctttttaaattaagaacttatcctatcgaacatgaaacttagctctcaaataatccaatctgaaattcgctcttataaagatttgaactcagaaccttggggtgctactgagatcaactttcactcttgtcgattataaagaaggattaggcatgtaaaacattgtaaattttggccttttaaacgggaggaagcagagagcgctcgaggacaattcgcgcctgcaacctgcgcatctttccccgcctccgctcgtactcacaaaccctggctaccactgcagtcatcgctagcacgagcaggcccccaaccaccgcgttcttgccgtcgccgtggtggtgttcgccggcggagaggatgccagccacgcccaggcacaggagcagcgcgcccacgacgacgtcgaacgccgcgaacgccatggcacccttggaccaggcgaaccccgagctcgggcgggacgtcgtcccggcggcggcgatgtccgccgcgatcttgtcgccgccgcgctcgtccagctgccccgacgccaccagcctccgccgccactccggcggcatcgccccggccgcgaacgccgcctcgatctcgtcgtcctcgaagatgttgctgctgctcatgacgatgacgatggtgagagatgctgctgctaaggtttggttgcgatacctccgccgcgaccgggttggaatatatgataactccgtgctgccagatcgaactcgggctcggactcgttacaactcagaaaggaaatgagatacttctactccggcaaggctagtaggctacagagattaatgggcaaaataagggcatgttcagattgtagccaaaataaattttatcaagttttaacaatatcaaaattttgataagatggcaatattgcctaaattttggcagaatttcttatatattaatcaaatttggcaacaaactaaatgtagagcatgttcactttgatgttattttcaaccttaccagctaaaattttggcaagaaactaaatatagccacttttttagcaactttaccaaaatttggtaagtttgaaaatgacatcaaagtgaacaggcttgtaaacattttttttgccaactttaccaaaaaaaaaatggtatagtagaaaatggcatcaaagtaaacatgccctaaacctaaccaaattttggctatgtcaaaattttgataagatggcaatattaccaaaaatttagcatgatttcttatgtaattatcaaatttggcaataaactaaacttagacattttttttagcaaatttgctaaaaaaatggtatggtttaaaatggtatcaaagtgaacaggccctaaatgccacgagaaatcttgcacatcttcgtatagaatttcagtctttcgcagtgaatgatccctgacgatgtcatttccatttcgaagatgtcgaaatgtcgatcaataggatttaggctctatttgattcagcttagaattattgtaatctgaattattaggagtaagctgaaacaaatagatagcttattatgatagattattacaatctataagccaaattactataatctggtaagccactataaaggtgctttttctagattattggatggctaacaactaacaaacagctaataatccagataaacaaacagctaacagcttattctatgtcgacttattataattcagcttatagtaatctaattctataatttagattataataatattaagctgaaacaaacagggccttaaatgccaaactcccttcgtttgtttgtgttcgtccagtgatcgcgggtgtaatccggagtctgacactgatacagcgtcatggccgtcagagctcgacgaggatggcaatggcggaggcagcggcagagctgacgaacgctttggaatatggaggggtggtgccgtggtaggtttctccgacgagcaccgcaccgagcacgtcgtgtcgtgggtgaccgatcgagacggagaaactccaatcgaggagcatatgtgccctctttgcacgaagaggggaatatactctgaatcatcttgctaattttcatcgccaaactgttctgtttgagcaatggcttctccattgtcaagatcaaagtcgaaattaaagaggttatacgttgttcagatatcttcagaggagcaaaaagaattgtgcgtgcatgggaagggtgattcacccttgcaaatttactcagggcgatcgattagcagaataagtttttagtaattttacattgttcacagatcagacaggagatcgatcacaagttgccgcttctagccttctacaccactgttttgttttgtttcagcaaggccgatttcagagttcagaagaggtgcagtgtgaaggaggtttcagaaattcagagttaagcctgatatagcatttgcactttgctgttctactcctattttgctatcggtggatttctgtagtcgctcgctgttctgctgttatctgtatcggatatttagatgacgagctagcactgtgcactcggcaaatgggacaaagctgtccttggattgatttttcctttttaagcagcaggtctctgccatgtccaacttcggcagaattggaaatgcaaactgctaccttctgaagaaaagagaagtatttctttggaagagtttacagtattaaattcagacaaagtattcgttcatcaacgaagaggaatttacaaggagatagccctgcgctctttgcaggaacgaagagggggataatctgaactgtcctgctaattttcatcgctaaattgtttcgtttcgtttcgtttcaacgacggcttattcatatgaagagaggtgcaatgcaacgtgggggaggtttcagagttaaagagtgatatactgcttggtaagagacaaagaccgagattggttccaacaaataagtatctggcattgactaagttttactgcttgacatcactgatggctggatcacaacatcatgttgtaaagttcatagtgcattccaagtccaagatccgagagaattgatgcttgttctaacatacttatctattttgtcaaatgggcatgctcaagtatcatacaccgacaagtcgacagcagcaggtcatgagaaatctaacacatcttcatataggcaggaggtccaaggaggcatatccttttgggaaaggaagaagaaaggatcaaactagtgcactatttatccgagaagatgcctcgttacaactcatcacacctccatgttcatgaatactgatgcactaattacaagtaatatgtcctaattgcttattcttctccttcaacagccggtaggccttccttgaaccatgtgtagagtcctccatccagatggaacacattcttgtaaccattcaggaccaacaagtaagctgctatcagggacctgccaaaatgaaacagatgagatgagttagctatgttccagaggcacaaacatagtcacctttgtaaaacaacataaaattcagagctaaggtgaagaaaggagtgtgggcagacaacaagtttatagttttacatgaaatgaaacaatacagatgttgggcaaacggggtaaattggaactcagatgaacgaatagtataatccccttctagtttgcatatggcactcggatgaactaccgctcagcaacatggtagaaatttcaagctggtaatatcattcaactgggaaacattgttgacaaaagaaatgtgaaacaaaaccaccagtagaaagaaacgaaagatatccatactacaaaataaaattccaccaattaagagatgatcatgacactacagaaataccttatgcaaatattaggaagaatatcaatgccacaatatgatagacccatttctgatttcaaggaatacagaaaagaaaaaaaacctcatttgcgacagtggtattaagagactgtatcagcgctttcgtgtcagttagaacatgaatgttaattggtaaaaattgaatcaagtttactgataaagaatactaaggtaacatggcatacctcgattgcttcccatcaggaaagttctgtgttggtttcaatgttcctcctgtcgaacatgccacaataatctttgcatctttaccaagtttctcatcaacaccttcgtaaagataatatatgtcactgattgtaaactcatactccctccgttttttaatagatgacgccgttgactttttctcacatgtttgaccattcgtcttatt

SEQ ID NO: 46626 - DNA, 16741 bp, Oryza sativa
cctgcagccctaaattttttgaataagacgaatggtcaaacatgtgagaaaaagtcaacggcgtcatctattaaaaaacggaggtagtatatgagtaaccatgaagcagaaaacagaataaactaccatactttgtatgaactcaggattctcttctgttccagaaaatatgccaaagaatgcaaatgctgcccgtcttgcaatatcccatgctgtccattcctttatcaatctatatatttgcacattaacggcaccaggtggatgagcctgcataagaatgaacccatatgatggcatttgcaacaaaatctaatgaatctaagtatcaaacaccacatagtatgacagcaacaaagtttgagatacacttgcacatcattggaaataattttgttaacaaaattatatccatttttcaccgactgcagacctttttttctcttccaaacaaaattactcctatttctcagacactctaaaattgcgtaaagtcagaacctttggttcaatatacgatatttctaagggaataaatgccacaaaagattataattacatattaatgtaaagcgtaacctcaagttattgtgttaaacctaagagctgcattatggtgcaaaaaccgaagataagtggagaacaattacaacattacctctttaaagtccgctactggcctgacatcaagaattgcaaaattgttttccttctgaagacgcagtgcttccttcacatcaacactacggacctgcaaaaccaaacaacagaaggaattctaatgtaaatggaagccgcttagcagagaaggctccccacgggtaattaacatatgaaatcaacaaacccagggaaaacaagtccataattccaaaacagagcaatatgacatggaatctatggcttatctactcatatatgtgcaatacacactctctgaagaactaaaaccaggtattcagtaagatacttcatatatggagttgataacaaaatagctaacatttggaaatggcaggaaattaggaattacccgcttttctactagcacttgcctcttgatcttccattcttcttcagctgtatataaaaataaaaaaaaatacagcaaattaatatcatgcccagagaattactagctgctccaaaccaagaaaatggagagcgtattcgcagtacctggtgactttgcaggctttgtggcagtacaggttatctgcagcgagcgcacagctcgtgtccggcagagttttgcagcctctataggacgccaggagtagccagatgtgaagtctgagcaggaggatatccttgatgagcaaggaaggttgctgttcactacagagctagctgcaagcattgtggtcatgagaaaaaaggagcagaaagaactatggaggactctgagagaattagaagaggggtttgcctctaacacctaaggatggatcctgtaactgagaagatttttttttctggatggggaaacgtccaaagaactcaatggttttggatgggaggtgccagcatatctgaactggtggtggaggttgagctagtgttgtgatagacaatctggattctgaacttgtagcttagcctgaccccacaacaccaacaatctagacaggaacacttaagagctgcactttttttccatgacataatttatgatgcttgactaaaagtaaatatactaggatgtgcaaataaagaaaaatagaggatactacagcgacataatttatgtaaaatccaaccttttctgaatgatataaaaatctggcttttattggtactcagaagttaccacctacaaatgggaatcctaagatgcccaaacatgatgttctcaaaatcgacctgacaactaaacaagagtacaccagaggcccctggaaaatggaaccacttagacctctcaatctgaattcagaagacaaacaaaagacaccatcaccacagttccttgatcatcttcagctcaactctgctcagtgctcactcactccagtacccgtcgtcttccttgtccttcttttcatcgtcctcctcgccttcctcctcgccgatttccatcactgcctccttgaaccgcttgacatcctccaacgccgccttccggaacatcccaatgtccactgcaccagacaccatgtggtaacccctcagcttgagctgctctgccgggtcgttcggcatggcgaatccgcctagatatgcgacattgccatctgaagctgtcacattcttcttcctggcatccaacaccttcttctcggcctccctcagcctggctcgcaccttcctgttccctgggtcccacaggtaccccatgctggctgacaagtcgagcggtcccatctggacgacgtcgacgccgtcgacggcggcaatggcgtcgacctccgcaatgccagcggcggtctcgacctggcagatgattagcgtctcgtcctcgcagcgggagaggtaggagtcgtcgaggccgtacgcggaggcgcggacgatggggtgggcggcgccgcgaacgcctcggggcgggtagcggcagtgcgacacggcggcggccgcggcggcgggggactcgacggcggggaccatgaggcccgcggggccgaggtcgagggccttcttggcccagatggggccggcctcggggaggcggatgacggctggggtacgggcggcgtcgagggcgcggaggcaggccagcgcctcgggaacgccgccggggccgtgctccatgtcgacgacgacgtagtcgtagccggcgagggcggcgagctcggcgagcgtgggggagaaggagaggaggaagagcccgtacagggtctccccggcggcgagccgggacttgagggagggtgcggcgtagaggaggtcggaggcggcggcggcggcggagatgggccgctgcccgcgccgccgcggcaaggggagcagggcgggggcgcggcgggaggggagaggcgcggggtctggcttgcgcgcgaggaggaggtgggagagggaggcggtggcggaggcggaggcggaggcggccatggcgcgcgaggcgagccggcgcggcggcggagaggtttggggatctgcggcgagtgagtcccagtcagtgtggggggacagcgtgaggcagtgacgtggcgttgctgcttcacgtgtcgctttgccacgggccttattgggcctcgcccactgacgttggtgggctctggcccgtctactttgtaaggcccaggaattgtatataacttaacttttaaattggaataagttcactttaaatcaccgccgagttcgattttcgttgttgtcctacaaccgtataataccagatataatgagattcaaagaagtatactgtatgtttttggctcacgtggcgagtgggttatgtttttggctgacgtggcgagtgggcctcacgtcaggcctatttattcttcctccaatctcctctctttttccatctcctattctccaaacctcctctctctcatccgttccacatcactgataggggagggcggatgtggccaacggcgggccgccatcgtcctagacaacactatatgcaccgcatcgccgtcattgtcgatgccctctgcatcgccaacctcctcttcactggacttgccctggatgctgccccaacaaccccgattgcacaaccactgggcggcatacgcctagctatagttgaggcaacattagctccatcaattatccccgcggcaaggctcctccggtgagaaggtgtccttctcatcatcgtaccccccaccatgtagaagtcttggtgcatgtcaaactcactaagcttgagcatgtgcttcatgccaaaactatttgctgacatgtcgaggctgttggatccatgctccaccatcgggaagaggttcagtcatcctaggatagggatgaccgctgacgagtgcatcgacgcaacgttccactcccagtggaggaagtcagtgctccgatacaccaaagcagagccagtggcaatgaccttgacatttgttcttcgatccaccccaacaaccccacatggcaccgcgcttggctgaccatcatggagacctcggatgtcattaggcctagggcagtgaccgcacactcaaggccacaaatggcatgggtgtaggtgacgatgaggtcagagaacatagcagtgaagcgcgcgtatgtgtagtcaaccgtcggtggcccaaccagagccatcttagatggtggttgtcaacgtagaagatgacggtggtgcgggtccaagagatgtgtaggagtgcgtggcgacgatggggtcgtcgaaggggaggaggtaccgaagtagtgttccttgcagctgcaagtgcggtgctgccgtcgcctccgtccctcccttagccgatgatgggaaatggaggagagagatgggaaatggggaatataggagatatagagggaggggaggttggaggaagaagacatatgcctgacatatggggcccactcgccgtgtgagccaaaaccggggaaccatactgcttgggaccttgggtacaccagttttgcacatgtcatatctggtattgctgttcaagaaaaaaaaatcgaacttggcgaaagacgagggaccttgaacttattcctttcaaatttcgttgtggatcagaaatttggtgggccttatccggattccagcccagcaaatgatgggccccgcagtggagagaccgtggcccaaacatcatcgcctctcgccgtcgtctcgtctcttcctctgcggctgaactagtcgccgatccagaggccgtcgtccactcgcggtcccaccggccaccgcctccgccgcctctcaccggcgccaccgctgctctgcctccaccgcgttcctcctctccacaagcctcggtcgcccagtacgcatcccatccgtcgccgtcgacctagctgcctggtggaggtggaggcgagggggattgactcggctccggcgctccgattgagcccgcagccgaccgatccggatacgatccgctccgctcctcgccggagcggaggctgtcgcgaacccaggtaacatccccgccctaacctcccacgccgcacgcacgcgaagaccgacggcggcagcgccatcccctgacgacggactgcgcagcggcgctccgccccgcgccccggcctgggcatgcccgctttcggccttccccgactcgcgccgctgctgcgccccgccgtgcagccgttgccttcgcccttcgcgtcggcgctgccgtgtcgtcgctccgtgcagcgccgtcgcgcgcggcgcgcccgctgcccggcatccggccctcccccaagccccagcccccttggactccggtgagcactgcctctcgccctctccggctctccctctacctcagtccctctcccccttctagtagaccacagtattatccccttcaataatcaatttctttgtatgattgtatctgtgattagccaattagggatatagtaatttgtatagattactacaaaattatgtgcaacaatgaacctcaaatgaaatttttgacttgtattgtaatatcctatttatctaagatgttatgttatgtttgaacaatttacattgtcctttaggtaagattcaaacttgtttgttattttctacttgtattgaaccatttagagttatataccgtatcacggtatcgtttataatttatcagatatcttatcgaatcataccgtattgcatttagatttttttttgctaggcctaccccgggttcaaatcctgggtccgccactgttagaacacacgcagagaactctggccacatcgaatcgatcgccgttcacgagatgtgctaattgattccatcggattttttatggaactgcagccaatttagactaggaagcatgaggaggcgaccgggaatcgcgggcttgcagaacgcagcggctactcgtgtatgtggacatcttgcttgaatagcttataatgttttttttttctttttctgtggattctgagatgagtgtgctcttggaaaatttaaggaccaattccggctggttggggaaaatgtggccaaggtcaggaccgatgtcatgaaggagcagcttgcgacgtttcggacacagctcgaagaatttgcacgcaagcataaggtgattcctactcctgtattctagttgagttttacagaaaatattaccgacgctattcgtatgtcacaaattgaattacacatagcatgctttcacaatcttcttaatcttggggatcaggatatatcagtcattcttgcagactgactgaattcttacattttttttcaactgcccagcgcaaatgaaatgaatgttctaacaaacatgaaaacagtgaagttactgctattcacttgattaaagttgtctatcgaactgggaaatagggaacctaagtagcatactagtccatggtcaagtgctcaacatatactaaaactgaggaacggtagttaaagatggaaaatgtaccaaagaaaaggtgttggagttaccaaggtgccaattgatcttgtttcttgtgatagatttcacttgtctcatggcatctagttccaactgggttgacatttgcaatgtaacactgatgttctaggtgatcacaatagagctcaaatggcacagcatattccaactcttaagtaactttgtgtacatggtgtgctagtgcagaatgatatccgtaaaaatccactatttagacaacagttccatgagatgtgtgcaaaagttggagtagacccgctggcttcgaataaaggagcttgggcagagcttctagggattggtgacttctactatgaattgggttggtatacttaatttaagctaccttgtatgttttgatcctggaattttctgttattattggaccatttacgttctgcttggcatctgtgtctattgcaccaggagttcagattgttgacatatgcatagcaaccagagcgaccaacggtggcttgattgacttgctagatctccgtaaactcctctgtcagaagaggaaagctgatcttggatcgttaacatcagatgattgtttgcgtgcgataagtaagctgaaggcaagtattttaaggaattctacagctacatttttttgggaatcctgtaattgcattcatgcaagttttacaagattgcattcgaatctatggccaataaaattttatttgatgtacttggacagatcgttaattcttctggtcctttgcctgtgaactctcaggtccttggtagtggttttgaagtaatttctgttgggaagaaaaagcttgtgcgttctgttcctacagaactgaataaagatcacaatgggatacttgagctagctcaggtttgtaatcagcttttaatagtgtataataccacagtacacttaacaagtatgtggatgctgtcataaccttatcatgcttacactgaacaagtatgtggatggtgtataacctttggttggaagtcataaagccccctatgttccacataaacgcttatttcagtcaacatagagacatagtacaaaactaagttaaaccgaagctttcaagttgctgccttgctcaatctgtcaccttgccacaatataaccgtacctgtccagttataacattatttcacatgcaggctgaaggttttgtcaccgtagagcaagtcgagagaaagttctcgtggtcaactggccgtgccattgacgtccttgaaactttgctcaaggtaaatcctgctcctgcatttccactctttaagcaacctttgtgcttcatttctgtgcccaaagaaaagaaaaccggcttcctttgatgcaagttatgtattggtgaatggtgattagatctctctgttgaatccacgcttaagccattgcaggattaccttctttttgagctatccataatccatatataaataaagtacttttcgtatgtgcatctgtattgacacttttatgaacgtcaaattttttggcatctatatccaactctggtctctattacataaacaggaagggcttgcgatgatcgacgatgggcacagggatggcaagcgcagatactggttcccgtgcgtcactctcagctctgactctactggtgcggatgccaagtcatgacctgtgccgtgcctgttccactccgttgttgtcacctgtatccttttccattggttcatttctgtaggcactgaagcacatatggcatgccatttaccagtacagctctggaagaatcatgagatagcaatacacttttcagggctgggctgccggcaaaatttttacattgtgattcgtgcatcaggattctggatgtatttgtactagtgatctatactatactagctcttctttcacgaaattactcgtaatcgtaaatgttcaatgctatttcctccgttttataatgtaagactttctagcatggcttatatttatgtagatataaatgaatatagacacatatatgtctagattcattaacatctatatgaattatctatattcatttatatctacatgaatataagcaatgctagaaagtcttacattatgaaacggagggagtaacttgctaatgtgagcaagagaaatgctcgcaataaatatgataaaaagagagagatgctaagtaacggtatcttattcggatgaaataataccttaaagatttcgtctctaatacctaatagcggctgataccctatttgaaatagggtatcacacgatacttatgacttatgatatattatttcatggaaaaagtacaccgaaggtcactcaacttgtcatcgggataaaaaacatcctcaaaccacaaaactagatatgtgaggtcccttaactatacaaaaccagtcacaataggtttcttagcggttttgatcctggttttgtcttacgtggctgctgagacagcgtgagccccatatgtcggcctctttctttcccttcttctctcccttcctcttctctctctcttctctggctctgggcaagccggcgccggggcgaggccgcgaggcgggggaggaggtccggcggggcgaggcgggagaggaggtccggcggccggcgacgtggcggcggcggcagcggagacgacgcgggatcaggggagcaaggcggcggcgacgacgacaacgcgggagcaggggagggcatcggcggcggcgagggtgaggagccgcctccgccaccatcagcgacctcaggacggcgctctgttcctccttcactctcgcgctggtttcccttgacttccacctcttcctcaagggcaccaagctcatggccgacgcccgaggtcggaaacctccccgtcggccccggcgagtccatctctttcatccctgtcaactccgctgcatcctcccgcttggaagccgacgtcgagctcgagcacgccgaatccatggagaaaacgcaagttttcttggcacgacggcggcggtgaagacgtccacgccaagaagccaacgagcccagcgctgccgccgccgctctcctgccatggatgtgtagttcggggatgtgaatgggaatggattggatcttgggattatggtgtccgccgctgttgccgatcttgatggcgccagggttgagctcaccagtgggaggatggtgaatgcctggatcgagtactcgcccaccttgtcgtcgccgtcgaagccatcgccacgtacgacggcgcctttgccgccgccggaagcgccagtttcatccgccgttccgcctcccgtgagttttaatccaatgcttccctcgcctccgcagctccccggcgtaaccacggcgccgtcgccgccggtgtccacggtttcgatgcctcccaccagctccgccttgctcccctcgccgccgccgacgcccctcacctgctcccgcgtcgtcttcgccgccgccaccgccgccacgtcgccggccgccggacctcctctcccgcctcgccccggtgccggcctgcccagagccagagaagagagagagagagaagaggaagggagagaagaggggaaagaaagaggaggctgacatgtggggcccacgtgggcccacgctgactcagcagccacgtaggacaaaatcaggatgaaaaccgccgagggatctactgtgactggttttgtatgtatagttaagggaactacgtggttttgcagttcgaggatgttttttattccgatgacaagttgagggacctttggtgtactttttccttatttcatccgaacggaatatcgtccttaagcattccaattcggcccacgggcctcaaggcttcaacccatgacaattgacaaccggacaggtgtgggcgttgactagtcttctttagttttccaccggacaggagtaattggcaagaagaaacaaaagggaaaaaaagtggcggaaaattcatttttgggaggggaaatggccaccgcagaggcgaagcgccggcgccaccactcaccgccggcctccatcgccgccggcggcgattcctccacccctacctcggcggcgcccgccgactcgtcgtccccgtcgctggatctcatccccgacatagcccgccgcctgacgtccctggaggatttcttctccctgcgcgcctcctgccgcgcctaccgcgcgctcctcccggcgtcgcgccgcctcctcgcctcgcagtccccgctcctcctcgtctccctctacccctccttcgccgaggcgctcttccacccgcgcctccgccgcctccaccgcttccgcctcccatgggggcaccacctgcccccctcgcgctacaccctcctctacgcccacggcttcctcgtcacctccaccaccgccgccaacaactacccgccaaggctcctcctcctccgcctcttcaccggcgagcagctccgcctccccagggtcttcgcgcccttctcccgcgtcatcctcaccgcggacctcctcgtcgtcatcttcttgcccggccgggccaccgtccagcactgccgccccggggacgcgctctggcgcgttgcctccgcccctgcaccccatgtgttcgacgatttgatctctgtcaatggcaccctctacgcgctggttggcctccgtcttgccacgctccagctgtcggagagttcgctggagctgtcatttctgggaggagagcatgatgacgcgaacaggccggagggggatcggttcatgctcggggagtgtggaggcgaggtgttgctcatcagcgtggagcatgaggagagggttgtgtaccgcgtgttccgttgggcatctgagaaaaggaagtgggagatgatcaccaacttgggcgggcggtcgctgtttcttggcttggatggattcgcagcttgcgttgatcaagatcatccaggggttcgaggggattgcttatatgcagctgggcgacgcttgggtgagtggcatgagtattccttggctgatggaacctgtgatgtctgcaatgctgactatccaggcgcgccacccctgaacaacagttcactgatcagaccatcagtttggatctttcccagcttgtgttgatgcaagcctgagtagggttcatcctagatcaatgttgaagccctattgctcagttgctcacatgagagaaaagaatggtaatgcttgatcactagcttgcttactaggtcatttatgtaaacaatatattcatacggcgatcagtacttgcatcttattcgaccagtcaattgttgttttggttgatatagtgaatacttttccttaggattttgaccacaggagcaaaataattttgttccctaaatgctgacagcattactttatgtgctatgcaacttgttgagatattatgaagcttcttttgcgtttattttcctctgatactgcagtaatagtgagtaaagcacataatacatcaaggaatatgctagtaccataatgttaattggttatatttgactatgtccctgaagttgcatggttgtaacttgtgtagggtaggcagtagcagaattcttaaccctgtttgctttgtgatttatacaatgctgcaaatcctgcggagttgtcacagttagtccagtgatagtgataaacaagaccaggaatgacacacatgtccaatggatgatatcataaattatagctgatcatgtttatgatttgtactcctaaaaatatgacatatgccaggtcttagaaccacttatttatatgattttccactcctataactgtaactttcattcctgaatcctgatagaacctgtggtgtatgacctccaaatggtctacccaatcagtagttggcagcaagcagatgtgaaggggttgggcatgctcttttctggtccatcagtttaggctttatatttaaagtgttcttcagttccgtgtttttggactacccttcagtttattcttttttcgggtctcctgtctctcccttccttgttcttgctgagtgctgacacgagacacaacttggttctcttgcggttgtccgttttgcttggtccgttgttgtttctctgtcttaatacaaagttaagccaggcttttgtgtgcttcctgtgtttcagaactcctcttattatctcaaaaaagaaaaactcttcttattgacttcagagggattggaacaatttcaagtttgaaagcatgattcgctgacatatggacctcaaacttatgtctgtgcaatgttacctggcatctcattttgttagcactcgtaaacatgaagtctggttacctgcaattctgaagaacactgtcttataacctctgacttgtgtgcaggttttcaagtttattttttgacctttggatggtatttgcaatgagattcagtcatatttccttatacatgtttccttattacttgaaagttgaaactaactttgagaatgttcaacccttcaaacacttgctctacctacttggtgtattgatatttgcatgtgttcccaagaatgttcaagtgctgcatcaatttgtgccaggatgccagcttagcgagtgcatatttgcgatctcaagtctgtcgatgacatacgcacattattcattttggatgcctactgaatttgttctgtaatcgcaaatactgtactcaatttcaggttgcatcactggctttcaggtgttctctttcttctgacatgttgctacttgcttgcaaatggatcgctgaataccaaccgtccattctggattctgccacttgcagttcttgctgatagccttgcagttctttctctgtgtagctcttttgttgatgtctgaattctgatgcttcaaaaattcagaaatgcagtaataaacagtagtagtagcactatttatttattgacacctggaagagaggtcctgtgcctctccagtcactgacatgtgggcccactttgcagtcattgaccaccctactgctacggaggtccacaggcggtctattgtggggtccacctgcagtgggtcaaacgggccttcgctaactcctcgccgtcctcttcccatccaaacctccgcagcagagctcgctgccgcggcgaacgcacacaatgcaacacctcgccctcctccgtccgctcatccatccctctccccttccggccgcgagtcccctcgctgcgcgatgccgcggcggccggggccgaggccgaggccgaggcgtccgctggagatgcgcgacggggggaggcgcgggcggcggcgaggttgaggagggggagggggaggggaagcgggaggcggcggcgtggctgagctcggcggtgggggagaaggtggacgagctgctgctgcgcgaggagaaccgcgcgctggtggaaggggtcgaggccgccgagcggcgggtggagcgggcgcgcgccgcgctcgccgacatcgagcgccaggaggccgccgcccgcctcgccagcgaggaggtccgccgcctcgagaggcgccgcgacgaggtatggtgactgctgcccgcgttcaacctgtttgatgctttgcctgctctgcattcgcctcaatcaacgagcagagtgcctgccctagcgagtagtgggtctctcatggcctcatggtggagagcgacgtggcctcacctagctatagtgctgtacagtgtacacacgcgcggtccaatccccaccccgacgcggtgatgcacgcatctggtggcaatagacgtagcatgaaccagcaatatggcaccaccagggtgttgcggtgcaatggcgtgctagtatggttgtggttgtactgtactactgtgtcggtgtggccctagatgttctgtgactgccgcctttgtgtttgagttaatgtggcaccgacgagcttgaggaatgctctttaattagccgaacagtagtacctcaccacgggtgcatgtgatttacgaaatgtaaatatgtaatgcacggaaacagaaaattgcgtattgaagactattgtcagagaatatgaaaaagctccagttattttctcctatctatatactgcctaacctattactccttgagcgttttctacaagcaggcaaaaaatgctatttctgaaagcaaaccctgatatgcattgcaccgccttacattgaaccgacttttccatgccatttcgctggattcgattctttgaaatgccttttggatagaagtgccaagcacaatatccctacagtcgataaattgtagtttatatattcttgctttgtcatggcttgttatgcatatccagttggagatgtactgtagaaatcagctcatttgatctatgctgaacagtttgttagatttagaaaactagatgaatttcccctacaaacgcttagctggatactgaaacaaatacgaaatatccttatgtttgaagctggtcgcgttaatatatcaatctagtacctgaggctgaaaataactgtatttgtacactaatgtagtctgtaaaggtgcaatatctgtccacagttttgctaattctatgccattataatctgaccttagcaaatcatctgtgtagtttccatcattttttctctaggatttttttattttacaaattaacaattgaatatcttgccttcttagcatatcagatgctttgaatccttccaactgtttatattctccatttctgtataggagatggttccatgtcttttgagaaaacataaagtactagtagcatgtgtcagattcatgtggtcccatgacgataaaggcagaatgattattagttgtgatatcaattgtatgacaattcatttctgtaatcatcaaattatctttccttcaatatacatgggaaggacatgaattatttgtagcttggtgtttcctatgtgctatttcctcttaataatgttgtttacaatgctgcattacataaacaagatcacagagtcccaacgtgaattgctacaagcaagagaaatgattgatgaagcacaacgttccttgtcttctagtcttgaggatcaaagctttggagatgtaccaagtggagatattgatgaagatagtgaaagactggaatctgtaaaagctgcagcagtttcctctgtagttggtgttctagctagtttacccatatctttttatgaagcccatgattttccacaattatttgttcagttgtcagttattttcataagttgtgctttgtttggagtaacattccggtatgccattaggagagatctggacaatgtccaactaaaaacaggggctgctgctgcatttgcttttgtaagaggtaaaactcgataatgctatttcataaaacttctcagcacatattcaagcacattgtcattttgtttatttgaactaaattatttgcaggccttgctatggtggaatctgggaggccctttgagctgagcactgatgccttaatatcacttgcccttgatggtgcagttagtgtggttgagaacattttgacatttctacctgctgcaattgcactggactattgttttaagatgagatttttgagtccatttcctacaagaaaacagtagttcctgcaaataatctgtaaggtccataatgccatttgttggtccaatgattgtagtaaatataccatactgcttatgtcttatattcatcatgccaaatactcgtggaatcaaaaaatcatgttgtttatcaaatagttgctttaatgtaacagctggatcttgtcctgtttctcagatattctgagatcgataactcatagctccactatgtgcttgaatagacatccttcttaagtgccctacactttgccaggactgaggcatatggacttatctgtttgtgtttctcctgtactattgatgttcactcccaggaattttttatttccacttgaatcaatgctttgggctatctgtttcatatcagcttttggtgaaatgctgcaatctgcgtaaactgatatgtgcttcatcagtccttgcccttatgcaaagagaattctttactctccatgaccatccattctttctacacaataatctatattctaatgtgcaagcacaagaaacatggtacatatctttcttcggtatgttgtatctgtcatctacattgatttatgcctgctgtaccttgcttgtctattagtgttcttccctttatttcagtattgctgtgaagcaactagctgctgaactgtgctataacctgatacagtattattctggtcattcataatgcgccaaaccggctggaacgg

SEQ ID NO: 46627 - DNA, 7992 bp, Oryza sativa
caaaatttacaacatttgagggggtttttatgtcaaaagtcatataggcagttcctaaaatttataccaaaatataacttctctatctacttatgttcttaacaaatcataactttttcatttagttccacctaggaagtgatctaggattggtccatggtcagggctagcctataaaagagttaagggcatgtttggatcctaccctaacaatttattactagtgccaaaatctaggcaaattttagcactactaatatttcgttaaggtaaagttatatggttcttgtttcgattgggatcaatatgaagccaaattttggtatcgtagtgaaaaacttctataatttggccaaataaaacatgggcactaccaattggttgtgctcaatccaaacacatgtactatttaagttgccaaaaaattggtaaggcacattagcctatgcataatgattacatggtgaaaatatatccacataattaattagcctatgcataatgattacatggtgaaaatatatccatcataattaatgggcagtcttcgggccatggcccgagtgatctgaggtgtgagtctgcccctaattatacatattttaaaaatatctttgtacaatctaaaaacggatttgctatcctactgtcgacagttttcaccacagttttcaggggtgaaaactgtcaaattttaaaccgtccgatatgcttagctttgagctttgtgctgtggaggaaaaaatgaaaaaaaaaaccacacgctcacggcaagaattgaacccgagacctgcagcaaactttaaaccgtccgatatgctttgagctttgtgctgtggtggaaaaaatggaaaaaaaaaaccacacgctcactacaagaattgaacccgagacctacagactacatgctcattgaaataaccaatcgctccatcaaattcttccaagttacatttgagtcacagatagcttatattgtagttacatggtactcctacaactacattgtaattgtaattatatagtagttgcagttgaaagtttttcattcaaaaaactatcgaatattatataactacttccaaaaatctttatgttttaatatggaggtatagtaattataactaattcttttgagtggctttggtaattttggacgctggaattaatacgtggatatggtaattcttgatgccgatcactgtgatccgccgtccggcactggtggagaaatattttttactcccggtttagaaccctcggtttttcaaccgggactacgaatccaggtagtcccggttggagtaaagaggggtaatctttagtccctgaagaggggtagcggcaatcccttgaggtctttttttttcattgttgatttgctaatggctagagttaatccctatatttttcccaaatcgagtgggatgcatatcccaaatcaacatcctaaatattaagttactcatacacacagatcaaatacatcacaaatcctacacacatatcaaatacatcataaatcctaaaaaactacacataaattaaatacatcacagattatacatgtcagatccatgcgatgcaatgaatcacaaaatctaaaaaaatatacatatagtgaaacacaaattatatataaaaaaacaaacgagccggccaccgctcgcagcctgccgccatcctaccccgcgcggccgcgctgccaccgcccgccgccggccggctgatggaagagggagtagaggggaggaggaggaagggccggcttatgggagggaggagaggggaggaggagaagaggaaggggggaggaagaggggggaggggaggaggaaggggattggatcgagaagaggaagagatgggatgatccaatcttatctaaatatctgtctgggacttaaccgatcagatgtgggagagaaatatttactcccggttgataactccaaccggaactaaagatcaatctttagtcccggactaaagtggtaatctactaaagatcctcggcccctgacatacatctgacaggggatgaaccggactaaaaatcatctttagtcccggtttttaatggaaccagtattattgtggaatttggtctagcgaccaaagatggtttctccactagtgcggggctccgggtgcaagtaaagatcgaggtgattttgcattattattggcgcccggcggagcacgcgagtggccggtttgttccagatattgtgccgcagcgcaggccgcagccgcacgtgtagccacgagcgaatgcgatgcagaggccggcgagggtagctatagctggctgattcgccggctgtggcacggtggatcttatcagatccaaccccggggccccgccatgaacgccacacgggtcaagctacttgtgtctgacgagatgcctacctctacgcatatacccctgcctccgatccggcgatcgatcgatcaccagcacggtggccaagtggacgtacgaggcggacgccgccgacgacgacggcgatccactagcagcgcgcatatgcatgtaccgatcgccgggcccgtacgcggtacgaacttattccggttttttgtgtacgtactgatcgatgatgcaatgggcggcacgggtaagggtggtacaaagctagctagcaaccgtgagcggaggtgcacggcgaatatcgcagccgattgggcggcgggtcagtgcccggaacgctgggtgcgccggcgaggggagagagagatcgaagcatctctcatctcatcgcatcgcatcgaatcgcggtataaaggtggcgccgcgggtgggtgcgggtgacggccggtggtttggactgacggcgatctgcgctatagctagctatcgtctcgatcggccagccagctgattgccggacagatctcgatcgagaagcgaatatctttgcaaatttgttaccttgctgatgttcttttccttgctaaaatcgtcggaatataatcgtagttaatccaatgcgcgcaagcccctttcgctcgccggccggccactcggacaaagcggcgacagggagccggctggccggccttgtcgttcttgtgctcagctagctagctgtttaagggcttatttcgagagctcaagattctgaggagtaactggcggcgttgatagttagtttctaattttttttaaaaaaaaactaggttttccaattttttgtttagtagttagaagctcttaaataagtcctaagtgtaaatgcacaactagctcgccaacagctgagatatcgagctagtacctagttgcatgccctgatgcccatgccacggcgtaacgttaacgtacgtgtcgtcggtacatggtagttttcatgggatctttttgtacgtttttgctagctagttagctagctgcagggaccatgcacgtaagcaatcacacggcgatctctcgatcggtcgactgatcgatcgattagctagcttaataattagcttggacgatcggtttgcgagtcggcgtcctcaactttggccagctcttgctgatgacatgacctgtatggtacacgacgtacggcgtcgtcccaaaactcgcagcccaattgtttgattgttagcttataagccacaatcaaattagttttatgtgtgttctaaaacttaattgagctggttttttgaatttcttttcttaacgatggtttatttttcaccatccacttttaactcatcaagaacacaaataaagctttatttattctattgttttgtttattttcctatgagtcatcagctgttgaccaaacgatgagactgttgtcactgacgtggcagtggcacaacacgtataccggcaggggagggcagggtacgcaacgtacggtacgttgcaccggtcgcatgcaccatgcatgcacatcgatcgagtcagctgatcactcacactgcggactcaccctgcagctagcggccatgagatcagattggatggatatgatggagacgggcctccaaacaaagcaagttaagctatctagctagctagcgaccgagtgacgacgcttatctcgttatctcgtttgtttgtcatatgtaacacgtatgaataccgacgaggaagcgtatgtgcactgtacatggactggttatcaacctatgatttgatgatggtgggacacgcaccaaccaatcaatctccatttttacctttgcatggctaataatatttccaacttttgtatgtaatagggatacaagcgggacgggcaaataggtttttttagcccgcttcttctagtttatttttttcttctaaattttatactactatatgggaaatgaactagcaagcgggtttttatacggatagcgggactacccacttgcatccctaaattttagtacttttctcataatgtaagtttatatgaatatgtgcaatgctagaaagttcattatggaacggaggaagtagcatatagcaagaaaagaaaaagaaaaagaaaaagaaaaacttccgatgcttctcggcctaggacagcacggcccagttaaactgggcccgaattagggagttgcggcccatgcgcttcgggaagagcccgtgatggtgttacgtccacgtcagcccagcaataggccgctgatatattgggccgacacgtcaagtctcggtctctcttctctctctctctctctctctctctctcgtcttctccgatcgcggcggaatggacggcggcgcggccacgaacgcatctggagtcgccgcggcggcagcggcggcggggaacggcgtgcaggcggggggcgggggcgagagggcggaggacgcgtcgaagcagaacctggcgctgatgatggcctcgatccagaggacgctggggctcctccaccagctcaacctcaacgtctcctccttcagctccgcctcccagctacccctcctccagcgcctgtgagattctcccagcaaatccccctctcccccttcctgtgcgggtgtgagtgggtggagaaatcttagggtttggttggtgattgtctcgtttgccgcaggaactcgctggtggcggagctcgacacgatgcagaagcacgccgagggatgcaacatccaggtccccatggaggtcgtcaagtgagttggttcgatttccatctcagtacccctttcgccccctggttctgggtgtatgacttggattggattggattggattggtgcctgttttgctagtttgatcgatgacgggaagaatcctgacgagttcacccgagacgtgctcaacagctgcatcgcaaagaaccaggtcactaagggcaagaccgatgctttcaaggtatgttacaattggttaatgctgacatagcatgtgctattttgattctaggtgctaagtagagatttaggtattccctggcagttgctaagtagagatttagatctgttcaaagggaaactcttgatccaaactgcaattgccgctccccccgccctaaggggtgttattgttcgtgttattagtcttatgttgatttttagataagaaggtttaaatgtagtttcaagggaatcaatgacacttgaatgaaaagaatcagcaagagccttgcttatctcatttcaaacattctcatccaaaccgtatccaggagcatatactaatcccttttaacccagtgaaattggttatggtctagtatcttctgtctagctagtcagttattaagtacacattttgcttattgtattgctctcattgacttccaacaatatgctctaattaattttaggcgaattgtggggacaaagtttgttgtactagctagacagattcctatcactggtacatctagctgtataagttgatggtcctcattgaaacaaatagatggaaattctcatccaatacttctatagcatttattgatagatgtataactgttaggcccagattttttttagccttttgatattttttttatgaggtgcatatagttgtgatctgcattagtctgtgtcatggatacgttttataaactacctccattgatttttatatgctgtattttaatttgaagaagtcttcaacattaacttcgtctattgatttcttataaattatactcataatagtaataaatccaatagtatgtgagatcactttaaagtacaaagctattgatatactttttatacactaactaaatggttcctttaatttgtctaatcattgatcaaaatctacaaagtttggcctttttgaaattaaaatatgccatataagaatcaatgtagtagggagtatcaacattgttagtttgtattttaaactataatttgatccatgattgatttctccaagttaaacatctgctattttcttatatggtgtttggttacaggcattcatcttttacaaccttttacattactatttaattatttcctgtattcagatgaaaaattgacatcgtctttcatttgaacttacttagtaatacaaattgaattattttccttgcaacttgtttgtttcagagcctgcggaagcatcttcttgaggagctggagcaagcttttcctgaggatgtagaagcatacagggagatacgcgctactgctgctgctgtaagttctggaatgtagtttctgtttcaggatttgcatatgaatgcccatagctggtccaatgggccagcaatgttgtggtgatcatcttttggtattatatcaagcttcattattcaattatcagaatgcatatttagttcttctgggtgtactaattctttcgtttttatatccaactgatttctaaatattttgtttttatccaggaatcaaaacagctggctcagtcccaaagcgccttgcctaatggtgatgttaaagtgaaaccggagcattgagaggacccaactgcaaagcgtaaggatttttatttatgctttgctttaggtatgatttgtgaattaacaactcaaatttccttgtatcaactgtttcttaccaatagatctgtatgtattctcgtattgtgtgccacatcatttgttcagcttacctaatgattgaagtaataaccctgtaatctatcatcctacatgagcataaattatctgcagctcagctagctcaagggaaaaatggttgcttattaggtgctgcatgctgagtagttgtgtttaccttattttggtttatccaaagagtagcaccatctggactaggaatgccatgcctcatctatcagtcaatagactattatgcaactgacaattaatagtaaatctgtaagcttatatcttatcattcgtctgatctgataaccatttcctcattctggtcctactggatactgctgtgtactccattcatttgctaatccagttggcagttgcccctagattctttctgcaatgtagtctatggtcctatatagtacataggatagattgccttctggtttgttaaacagagaaacggttgtcttatgctgtgttggctggtcgatttccctttcgaagtcagctagttgaaattaggaaattcatctgtatacttggggcgcttcaatgtctaatctttcctatttatgattttgactattatcaccagtttatcacatgaatgcaattaattcaggtacttaaatcgtttggtgatttctcctaaagtgacgtggatactatgatggtgagctactgagctaccatggaatttgctatggtctaatggaacttaaggggacggaagatatattatgaatacaagactgcattaaattagaagtaaaccttgatcttgacatcagcctggaatattatgtatataagcatatatgagatgcagagtatctttaggacgtaacagtgacttgtagcgagcgatcgtatgatgtagtccatatgtttattttgaaagatatgtgagaataatttgagatcattttctcatatttcttctttgatggctgtactaccctcagtctttggattg

SEQ ID NO: 46628 - DNA, 11279 bp, Oryza sativa
attgtctgatgagtgatgatggtattcagaaaatgctccaaaacttcatgatcaaatgactcatcaaacatgtcgttttataaagttcaagttcggagtgattccacacacgcaatctatgtgtgaaagcaactgctgaaaatcacagaaccaagtgaaagctgaagaacttttacgctatgcagtaatgtagacactcttaaggcctcatgttttgctttggcaaaatttgtttttaccatgatcacacttcccaaactgttaatgtttttttcataaaaaaattatgtagaaggttctttaaaaataaccaattttcaagtttgtaataatctattgtattataagaccgtcttgaatccctagcacatggtagccgtgacactgagagctgctgctaggtcactactccatggcgatagactgttgttgcggctacgacaacacatcctggtggttgcgagtggttggaaggtgagagaggaggaagaggaaacgggaagagaggagagagtagagagaggcgatgaagatgatgaggcggaagtcgctgacatgtgggtcccacctatcacgtcaactgaaaccgtttcccaaaccagcagagaaggcagttcgcaccagtttttaagttggagagacgttatacccgattttacgattgagggatatggttcgatcaaaggcaaaagatgagggaggtaaaatagactaactcagctcaagtaggactttccccaaactgggccgctaccatcagtcgtgtcgtttaccgtgcagaacttcagtcaagcaaatcatctgtgagaatatgactgtcaaagctgtgtagtaccacatcagaagaggaaaaaaaaatgctcctactcaattttgcgggcatgcacctcgcactttgacacgctaaaactttatatcctgttatatctcgaatatttaaacacatgtataaatattaaatatagtctaaaaaataattaattatatagattatgactaatttgcgagacaaatcttttaagcctaattactccaagatttgataatgtgttgttacagtaaacatgtactaatgacggattgattaagcttaataaattcgtctcgtggtttaccgacggattctataattagtttttttatgagtacatgaatattttatacactaacctctataatatccgatgtgatacgctaaaacttttcacctctaattctaaatatctcctccgttgctgactaccgtgcacattattgcccatagctagtggagtggagtactctaccactgtaccagccaagaagaggagatttcagagccgaattcacagctagtaccgacaacttgccaagatatttcgctctgtagaaaaatcgctgtcaggccatctccctagccgacttctttgatcctagttctttgtcagttcattatattttctctcatataatagcatatatgttttctcattatattattaaaatatattacaatgacaacataattttaaattttgcaataactttacgaaactactaatgtgtaataaccactctagtctcctcttctaatattacttatttttttaattccaaatttccactgtttctaaattgtatttctatatagactctgccttttctttttctccgattaatgtgagaatttctaggctatgagagtgaatgtggaggctcctttttattctaaattttagttagttttaaattccaatatggactctatactctatttctaatattccttattttttaattccaaatttctatttttttttcttaattatatttctatatgtactctatactttacttctaatatttcttatttttaattccgaatttctattatttcctaattgtatttctatatggactctatactctacttctaatattccttattttttaattctgaatttcaactatttctaaattgtatttctatatggactttagtctcctcttctaatattccttattttttaattccgaatttcagctatttctaaattgtattttgatgtggactctgctttttctttttctccgattaatgtgagaatttctaggctatgagagcaaacgtggaggctcctttttctattcctttaataatataatagattgtgttcaacatttaaccgttatcttatttaaaatttttatttaaaaattttatgagaaaattttaaaaacaaatagtcacgtataaactactatttatattttatcatctaataacaacaaaaaaactaatcataaaaaaattaaataagacgaacggttaaacattggatatgaaccgtgtaaaattatacttattttggaacggagagagtataactcaatctaaaaaagacagattcttgctacgaatctagacacgtatgtgatcagattcatattaaggattatgtctttttctttttggaaaggagaggtagactaccttaattagatgaaatttagtactattaattatactccatatttatacaacaaccagtgactcatcaattatcgcggtggagaaaattcctatcttttttcttggagtaggattaggatgtaccactacgtcttcctcgccgccgttgcgctcctcgccgtcgtcggctacggggtcaagaaccgacgccgtcgaagcgccaagctcccgccatcgccgccgtcggtcccgtttctcggccacctgcatctcttgggcccgctcctgcaccgctcgttgcacgagctgcacctccggtacggcaccgacggcggcctgctcctcctgcagctcgggcggcgccggacgctggtcgtgtccacggcggccgccgcggcggacctgtacaggaaccacgacctcgccttcgcctcccgcccgctcgtcgcggcggcgcacaagctgtcgtacggctccaagaacatcaccttcgcgccgttcggggagcagtggcgccgggcgaagaagacggccgtcgtccacgccctctcgccgcggcgcgtcgaggcgttcgcgcccgtgcgggccgccgaggcggcggcgctcgtcgccgcgacccgccgcgccgccgatgccgcggcggacgggggcgccgtggagctgagggacctcctgtacagctataccaacgcggtggtgacgcgcgcggcgaccggcgccgcgggcacgacggcggagaagctgaagcagctgctcgggaacgccacgtcgctggtggccggggtccaggccgacgacctgctgccgggcatggcggcgaaggcggtgaggtgggctacggggctcgagaagcagtatgacgcctcgatggaggagtgggacaagttcctctcgccgataatggcggagcacgcggagaagaagaagaagaagcgagaggacatcggagcaggggaggaggatttcatagacgtcttgctgcgtctgaaagaagaagacaccgagctcacggacactcacgtcaagagccgcgtcgtggtgatgatctaagctatcaaatcattctcatccaaactactctctcaacaaattttcatcaaattaatctctcgattcttgcgtttaaaattctgcaggatttgatcgccgccgcaaccgagacgacgtcggtgacgctggaatggaccatggcggagctcgcggcgaacccgcgggtgatggcgaagctgcaggaagagatcgctcgagcgaccggcgggaagccggccatcacggaggcggaggtgggcggcatggagtacatgaaggcggtggtgaaggaggtgctccggctgcacccgccggccccgatcctcgtcccgcacgagtcgacggcggcggcggccgtgcaggggtacgagatcccggcgaggacgtcgctgttcgtcaacgcgtgggcgatcgggagggaccccgcggcgtggggctcgccggaggagttccggccggagcggttcttggccggcggaccggcggtggacttccgggggaacgactaccagctcgtcccgttcggcgccggccggcggatctgccccggcatcagcttcgccgtgccggtgctggagatggcgctggtcgccctcctgcaccacttcgactgggagctccccgccggcatgcgcgcggcggagctggacatgagcgaggcgcccgggctgaccacgccgctgcgcgtcccgctccgccttgtccccaagcgcaaggcgccgcttgcctagacatatttacaaacgaaatgtaattggtgaataaaacttgggtatagctatatttattacgctatatttttcatcaaaaaatagtcggcatgtatttacattgtaagtccctaaattacatatgtaattttagtgtatttataatgtaagtctcaaaattacatatgtaagcactaaaattacatatgtaaattcgaaaattacatatgtaagtggggtgtaaatgaggtgtaactactgtgtaagtggctgaaaaaaatcgactgtagcatatggcgccatatttctagcaactccgataaaacttttatatacgtgttcttaacaattaaaagaaaggtaaattggaaccatgtcattataattttgtgaagtttgaaatatgccatcggtatctcaatgacatgtaggacccacatgagtcaataacatgtgggtcaagatggtatatcttaatttttacaatattataatggcatggttccaatttttctaaaaataaaggcggaaaaataagcttcgatgaaaaatctttaaaatcggtttcaaatttaaagttaaaaattaaaaatttgactgataaatgtaagcctacgcgaaaagatagtttgttgtcgtgggctcgtcgtccgtgctgctagtcgtagatgcattgtatctggtcagtgacacggggatcagtcgtagtagtatgctgctacgagtgtttctcatctgctctgatcagagtggtgcaatgtactcctactccattgttgtatctgacctcattgtcagcaaatttgtcgatggatggaacacgaacaaatgaccacaaaattgttggaattgttgtcgttgaagcaccgttgttacaaatccgccgccgcggccgccgtggacacgaccagcgtccgccgccgcccgagctgcaggcggagcaggaggaggagcaggccgccgtcggtgccgtaccggaggtgcagctcgtgcaacgagcggtgccggagcgggcccaagagatgcaggtggccgagaaacggaaccgacggcgactgttcttgaccccgtagccgacgacggcgaagagcgcaacggcggcgaggaagacgtagtgatacatactacttcaagcaaaaggatttggatttttctccacctcgagaattgatgattcagataattgtgagctgcaacgatatcgtgtagatatgctttctccgtcagaaaatgttgcaatttatttcctccgttttacaatgtaaatctttctagcattaactacattaatatagatgctaatgaatctagatacatatgaatatggataatattagaaagtcttacaatataaaacggaggaagaattttacatattctaaaaaaatctggacagaatttgtttaggatagatctaaatctcatcctaaatacaacattttgagacagaagaagtagtgtgctcctgtgttggtaacttggtatcggtagctgcgaattgggatcagagaagacaagtcggctcatgagcctgcttgacagcgatttttcagacaaggaaatatcaggtccggtagatcaacgtctggtcgatccgagctctgatgtccccgtcttccttgctcctgctggtagccttgggcaataatgtgcacgtagtctttgtttgagagctgcataatgtggcgccaaatttagttttctctctctcaaaatttagtacagaaacacacacttatatacacgtacacacactcatatgtaaagacacatatgcatattatttttttgaacatctccaaaaaaatattttaacatatattgagattgaaatcattgtaggtgtttcaatgtcgactcataacactccgttcgttgagttctttttttttatgtggtatggagtagctttgacagtcagtcagtcacggcgctttgcttgtctgaaactctcaactccactaccgggggatgtcgattcgaaggcacattgggcctatataagttaatgggccagaactgatattcaaaggaacattgggccagtttatcgtggtccatctttcttcttcggtgatgacatggaatgaggcctggcccaactaaacatcgggcccaacttttcttcgtcggtggtgggctagagatggtgtcagggcccggcccaactagaccacatcatcctacccctacctcaacccgtcggtcctcaattccccatagcgcggctcgtcgcgacctagccctagccgccgcccgttcgcgacctcgccggcgccgccatcccgccgccggcgaacctccccccctagcggcaggtcgccgtcacgccgcgccgccccgcgccgccgtactaggcgccagcccgcgaggtccgctcggctccaggattcgcgctgccgcacactccgctccgctcggcgtccccgccgactcgagggcacccctcctcgtcgggcctctccgtcgccgacgagctttttggggggttgagccgaacccccatgccctacgtttggtctgtcccttggtcgtgaggatatggaccatatagctgaagaagagactgtgggagttgcggaagaccctggtttggctgatgttggcaaggctgatgagaccaaggaagaaggtggtggtgctggagtgcacttggatgaaactagggttgcagtggatgatcccacggaggtgcgtgcttcgcagattgacgatggtacggctatggtgtccgtattaggtggcgatggcgatagctttgttgagcaagatggtcaggatactagcggcggcggtgcttgcaatgaaggtaatgagcctgaggaagatgctcgtgttcaggtgcgtttggatgatactagtgccgctgtggatgaggggggtgcttccttgattgatgatgttatgaatacgctccccgttggaggtgtggctagctttgatgatggtcctcagacggacaagaatgcgcaggatgagggggcgcttatagatgtagtttcctcaactgtgctgaatgatgcgagcatagatcttgtcaaagctagtgatagtgtctcggaggaaggcacagggatggatatacttgtccaaccgggagaggacattaaggaaatggttacaatagcctgtgatgcggccacagatgacgagggcaggaaggtggatgcagtttccagctccagtgatcgcaacgaggaagtggttggtgcagctggtcttgatgagacagatgaagacatgcgattgggtacagttggcctgtctggtgatgacaatgtggcaaatgaggctgctgccgcagctgctggtggtgcagatgatgaggacttgaagatggatggggtcattaccgccggagataaggatgtggaaaatggcaaggctgacaatgctgatggtgttccggaagtgaatgtagttgccattagtagagataatagtgcggaaaatgaggctgctgcagctggtgatgatggcgcagatgaagagggcattcagatgaatgtgctaaacacaactagaggtgagggtgaagaagatgatgaggctgctcaaaatgttgttgaatatgctgttgatggtacagaagaactggaaactataggcctgactggagatgataaggcggaaaaagaagctgccccagctggtaacaatagtgcagatgaggagggcatgcagatggatgcggttaccacaactggagctgaagatgaagatggcaaggctgatgaaaatgttgttgaagatgatgatggtgtttcagaagaagctgtggctgacacagttggtgaggatatccctgaagaagatgcagtgcagatagatgaggacgaggatgatgatgacgtgcctccaccattgacaaggaaaggcggggggcgccggaagcgaggtcgtgcatcttccaaggctcaggttgtggtgaaaccacctgttaggaagaaggatgatgaggaagtttgcttcatttgctttgatggtggtgaccttgttgtgtgtgatcgtaggttcgttaatgacatggaatttcattctttccatatcccaaagtatattgctatgttacaattattaatggttatttctatgtcctcatactcaggggttgtcctaaggcttaccacccttcttgtgttaatcgggatgacgagttcttcaaatcgaagggtcgttggaattgtggtatgtgggacttagtctgaacaactcgcagtgcccttgcttagttacttagatggtttactttggaatgtggatatgagtattcatacttcatttcatcaaaatccatgatttttatgggtcatatttgcattgaacctactctttttacatgcagatagtgggatgccggtaaaatataaatataatagctgatttaaatttttttccattttgtcctgttatatcatatttatttgtttattgttctttactttgaaaactgaagcttgtgaaatctgtgtaatactgagtaaaaattgctggagataaatgatgctggactgtttctctgataatgatgagatttgtgcttagtccacagataatatcttccttttttttttgattttgttcaatctgcatcattttcccagggtggcatatttgtagcaactgccagaaacctgccttccatatgtgttacacatgtacctattccttatgcaaaaaatgcataaaagagacaaaattcgtctctgttaggggaaacaaaggcttctgtgagacatgcatgaatactgtgatgttgatagagaacaaggaggaggctactgagcaaatggtaatatttcctctgtttcttggcttaccttaatctatctattgtatttctatagtatcatccagtatctttgatcttttcatcattttttagtttctgtatatcatttgtgacaccattttatccttttgtcattctctctcatctaagaaacttaggtggtgtttgaaactcatgaagatgaagataaagttggtgcacgtaaaacgagataactattagcacatgattaattaagttttaattattacaaacttgacaaatggatatatgtgatattttaaagcaacttccatatagaaagttttcgcatggaacataccgttcagtagtttgaaaagcgtgctaacggaaatcgaggtaatatcttaattcataagaaaagaacagggcaaggcgtaacaagttttcgagatattcatgctcaataatcattttgttaagatgtaggccctatgtatcttggaactgttaatttgcacttgatttgtctatttgattagtaaactcaaatgagctaaccaacctgctgcctgcaggattcaaaaggtgtaacaagaactattttctgaatgatgttgtccaagcattgcagcttgctaaattgttttcacgaaatggcatttccataacttccaccaacaccttctatgcgctatgtctatgttgtacacacctatgatcattattgagatacagagttgtactgatttcagtactcacttacttattaatcaacatcaatattcttaatttgtcttctcatttcccgttgtgcttgctccataccttgccaaagtgttaacctagtatacttgtacaaatttgcttaacaggatgtagattttgacgacaaaacaagctggtggtatttgttcaaggattattggttgaatttgaaaacaaaattaccattgacgtttgaagaaatatcagcagccaagtctcaaaagaatggttcttctttggttattcgtgacaatgatctcagtgaaccacatgatacaaatgatgaagaagagggtaattcagacagctcatctgtgcgccatctagaaggcaattcaaagaggaaaggaaggaagcgatcaaagcaagctgctaacgatgacagttctgtagttaaagatagcactaggaaatctacaaagcgaggcctgacaggtggccgtgatactaaaagttctacagggagaaaggttagaaaattgtccaagcgtgctttgagcagtgaccatcgaccaagagaatctgaaagcgtagggacatctacatcgtcagctgaagagaccagttgggcttcgaaggagctcttggattttgtagcaaatatgaaaaatggtgacaaatctgtgctgtcccaatttgaagtccaatcccttttacttgattatattaaacgtgaaaacctccgggatcctcgcaggaaaagtcagataatttgtgattctatgctcaaaagcctttttgggaaagcacgtgttggtcattttgagatgctgaagcttcttgaatcccatttcctcatgagcgaggtctcgccagttgaaattgatgacaaccatggtggtgttgtagaccctgatcctagtctggatgctgatggcaacagtgaagcatcaatggtgatgagctcagaaaaaaggaaaaaatctcgcaagtatgaccagaaagctctgcaaacaaaccttgacgactacgcagcaatagataaccataacatcagtttaatgtacctgcgtcgcaacctgttagaagaattgatcagtgaagttgacacatttgatgagaaagttcttgggtcatttgtgagaataagaatatctggaacaggtcaaaggcaagacatctaccggctcgtgcaaattgttggtaagataagacactttcaagctaatctggctggttttagcttcatgatgctgactttcccatatctgtgtgcaggcacaggaatagcgccagaacaatataaatgtgggaaaaagtcgactgatataacactggagattctaaacttagacaagagagaggttattactattgatataacctcaaaccaagagttcactgaggtattatcattttcagcacaggcacttttactgtttgcttactgtttaccgcaacttggtagagttaacacttgcaagcttatatttttctaactgtgtctatagttttatttcctttcactttgtatactgttagtaataaatttgacacaacctgatcatgttactttagattatgtgtacaagcattctctcaacaagcaaatctgctgctttctttt

SEQ ID NO: 46629 - DNA, 1046 bp, Oryza sativa
agtcttccgctgcaaatagatgaaattgatgaaaattagtgtttctaaaattaaatttcgaaccaacgggagaatttaattttaggaacattaattatgtgctatgatgttgtaattttctgaccaacgttgttaaatgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaagtgagtcagatgctgactggcaaaagagacatagggacaatgctcctctcgtcatgtcgtatgacattgaacaaaagaaatggtccttagccaacaagaaatgtttggctgtggtaaagaatacgattgagcctaccatattgggtcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaag

SEQ ID NO: 46630 - DNA, 756 bp, Oryza sativa
accaactgccgccggccaattgccgccaccatcgtcgccacaccgctgccgccgtcgccaactgccgccaccctccagatccggtcgagaggcgcggatctggggggcaccgccgccgccgccaggcactggccgtccagccacgggaccaccgtgccgcctccgcgccctcggccagctccgtccccgccgccttcagccaccgccgccccagcgccgcgcgcccccgccgcctcgctgctggggtcagagctcggcctcccacgccggatccggacaggagggggccgaatccggccaccccgccgcctccacgcgcatcaccgccgccggcggcctatccccccgcaccagatccgcgcaggagagcgtgggagccagcaccgccgcctcgtcatcgtcgtcggcccggttgcccacctcttcaaccgtcgtcggcgccgccacctcgccgacaccatgcgccaccgttgatctcgacatcgcagccgccgaagtcgccgccccggagctaggtcggagtcgtgggctccaaacgccgcgaccttggggggggagaaggccacgccgccgccgtccttgcggccgcgcggtttccggcggcccgctcgggcggcggcgaggtggaaggagggcagtgggggtggtgtggcggcggcggctgggtcgcctcccgtgtcgcccctgccctaggagcgacgcgggggcaatggtgttacagcatcgacgcactaaatccagaatgaatcggtgtga

SEQ ID NO: 46631 - DNA, 1614 bp, Oryza sativa
ttcaaaaatagattaatttgtttttttaaagcaactttcgtatagaaactttttgcaaaaaaacacaccatttagcagtttgaaaagcgtgcacgcggaaaacgagggaaaggggttgggaaacttgtggaaagaacacagccttaattactttattatggttacttttgttcagagctgcttgtttagtattacatgcaagcatttattttcggttggactaccagtgtaatactccttggaatatatgctctatatatttttaaacgttcttatgatccataattatttttcatatacgatctaaataattaaattaaacgttcaaatatagtacggagtaagtatatacttaggcccatatttcgggtattgtgcaaattttacgtcgactaaaattaggcccacgttgagttgtagctgttccaacatttgggccgtaaacaatttcgctaggtcttttgaagggcctgacatttggcccacgtacaaacttttatctgggcactggcttcttccctcgaccgcaacggtgccggctgggcgcggcggtgggctgggcgaggggctctccggcggagaaaagagcggccgacgcggcgacggcgaggcgtcacggtagcggctgggtggcgggggaggatcttgggcggagagaagagcagccgccgcggagagggcgaatccccctccagctcattccgtcgacgggtggtgtctccttcccccgttttttttctcttttgcatcccttcgttttgctcgtctcttttcttataaggaagcagaatgtttatctcgtcgcttaggtcatttggttcagttcctatatatggttgtccttgcgtaagaaaatagtaacagggagagtcaatgattatactggaatcgactggtttagggatgtggaaatttgggagttttcttcgattgctgctgtactgattaatcgcaatgcgacttgcagaaaatttaatgcgccatagttttggtctcaatatataagtatataaccagcgcagtatatgcgaatttgagggttttgtgttcactcgcctccaaacaggcatcgtagtttacaaaaatggaaaaccaactactaaaatcaaaatcaggcatcatgtcatgcattattgacatggcgcatgattcatgtattcatggttgttcagttgagttcgccagggagggactgtactccataagctgtgcaatgtgggctgctactggcttgcgttgaatggggctagttgctacaaaagataactcaattttcaggtgtcaaaataaaccacagattttaagaaaacaattgatgccaaaactagtacacgtgctagagcctggcacaggaactgcaatctatatattaccagttatgcattgttcaccccaagagatgataatgggacaaatcatcattagaaaagcaggcaaacatattacaatgcagtactaatgaggttggccgtgtacatccggttggatgtagaggtcgggtttattccattttctaaaaagaaactaatgaggtacaattacaatagtattttctcatctcagaggcaaatcgtgttctttctagaaaggccatgtgcacattcacttttttct

SEQ ID NO: 46632 - DNA, 883 bp, Oryza sativa
ataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttgttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagcgagagcttgagatttcaccctaagcccccggccgaactggcaaaggggggcctgcgcggtctcccggtgaggagccaccagctccgtca

SEQ ID NO: 46633 - DNA, 780 bp, Oryza sativa
ctaaaatgaatcttagctgatacaagtaaattgaattaccaaacaagattaactaagatataagatagataggtgcttacattgacaagatcagagtatcgaagccctagccccgccatgcaaacatccttgacaagtataaaatcgtcaaaaaattataaaggtaaaatagggtggtaatgtgccgaatttgtattgattgtggagataaattacaatacccccaggtgtacatatttatacccatgggtagatacgagtccttattggacaagaaagaaactttactaaagataaaaggaaaacataaagtccttatcggacactaaacactctttcctaaagataaagaaaactaacaaactctttttaattaatagataaactgtcatgtcgcatcctccttgaactcggtctcttgtgtataaacttcctttaattgattaatttccttaaccgaatatagcaaaaatccgactattggcgacttgataattcccatcggccgattcgagtactctaaaaccgatattaactctaagccgatgatgacttcggggcttaccaaatttcactgttaacaaaaggttccagcggctactcaaaccccctctcctctcctagatccgacagtcgatggatctggggctaggcagtggatccaagggctcggggtggtagggttgccacatgcgatggagcgggaaacttggtcacgggaggcgggcggtggatcggggcgatggctcggggggcacgggcggtggagctcagccatgg

SEQ ID NO: 46634 - DNA, 1117 bp, Oryza sativa
ccagcatgcatctcactgtgagatgggcaaccgagcaaggaggaggccaggagggagtggcgacgaggaaaacgagcagcggaaggtcggaggcagccggcgtgctccctccctctgtccctggcatcctccctcctccactccccacgagcccatccatggcgaggtgcatgcagcagcgcgggagaaactacgacgagcggcggcgcggcatcagatagggcagcgcgggagaagctgtgacgagcacgagacaagctgttggatcttgaactcgtgctcgccggcgacgaattcaccggtgctcgggagtgcggctacagagggggacctgggggaggggggaggggggatctggaggtcaccagttcttggaagggcgatgcagagggggagatcaagctcaccggcgctcgggggtgcggcaatagaggaggagctcaagctcaccaccggtcactcggggacgagagaaaggaaagaaagagctcaccgccggctgcactgtgtggggtaagagagaaggaggagaggaagagaggaggaagaagaagatgacgtggaattatttgacaggtgtcatcctacgatacgtcctcgtgtagcaaaaccacggtaaaacagcttgaggggataaaatgtccggtattgatagttagggggtgtattatatccggttttgtagttcgagggtttattttagacgaatataagaattcgggggtgtaaaatggacttatcccgtctgcaaagctagcctataaaaccgggggctcctagctagcgcgtgctcggctgctcgctgctatcgagcactcctcccatattaactacctctattaaaactattagttaatatacttaactacctttattagtatttagtaatgatagtaattaggaaagattgtggagatttttttactaacaaattgaaaaaattttaagttaaatttgaaaactttcgatttaaattttaaattagattaaaaaactttcgatttaaattttaaagtcaaattttgaaaactttcaacttaaatttgaaaactttcaacttagatcgaaaacttttaactcgagattcgaaactttcaagtccagatttgaaaaattt

SEQ ID NO: 46635 - DNA, 713 bp, Oryza sativa
cgtctcgaccagtgtggcggaggtgtccttcgcgacggccgcggcgagggcgtgcgatggcaggagcagcaggaagacgacgatcgtcagcgccacccgagtcagagtccccaccctcccggtgccgaggacggcgcccatgaatgaaagtcgtcgccttgctttgcttcgtctcactatcgaaattgtcttctttgctttcacgagttcttctgatctcagatgttctttgcttcttgcattggtgctgcgtctgcgagggtgtgttcctttatagccgtggccactgcagatcacgtccagtttcggacgccgattccgattggtgtcatggaactgaacactgaagccggccgactcggagttagcaagattaatgcggtcgacgtaattagaccattaatctgcggattcggaatcggcatttttatgggggtgacgtaatcaacccgtttaatatcctggacctaattagctcatccacgtaaattcagccgatctaagtgcttgcttggacctggaaacattatacactcgccaaacttccgcacccgtattttttctgtgctccaagggccttcctgggatcgtggaaattttatacgcgcgcaaaacctttacgcccgtattttttgtgcaacaagaaaacatgtaaaacaaaaataaatattttttggtaaatattgttttctttcggaatacatggtagactc

SEQ ID NO: 46636 - DNA, 1555 bp, Oryza sativa
gcctccctttatttattatccttatcggtaatctatcctttttatcgatctctctcaccgtctctctctctctctctcgcacgcgcgcggcggcagctcgaaagagggatcagcggcgcaagaggggaggcggcgggtgacgggcggcggcggcgcacctcgccgacgggtggctgcagcaccctcccctccgcgggatccggcgggaggggaggcggcgctctcccctccaccggatctggcgagaggggaggcggcgggcggcggcggcaccctcccctccgccggatctggcgggaggggaggcaacgagtggcgacagaagaggggctcgccagcgacgaagcggatggtggagcatgaagagggctctcctccctcgtctcttgtagatttattttagatgttttggtcgatttgtggattagagtatgttcattctgtgatgtcaattgattttggtagcgatttgtggatgatttggggatttggggattttaaattgatttcggagcaactcgggcgatgacgcagtaacagtgctcagttgagtttggctcaattcgagctgagccggtcccttttttttttttggcttgagcaaagctaaaggtgtcggttttattttcttcataggtgccggttgctactattggtgccgaccaataggtgtcggttgggaaaccggcacctatagccgattcccaaccggcacctatggccctttctgtagtagtgcctgcttcttcagccagtctctaaggtaagaaatcgaagtagcgcaccatcatcgatgtcggtaaggatggcggaggccagccgcgatgatgtcaacggccacggaatgaggatggccgagagctttccacgacgacgagtgagagcttctcgaggccttgtggtggcgaatctgcatgctcgaggcccaaagacggcagatccacctgcgtcaagctcggcggcggtggatctagattcccaaggccctatggttgcaaacctgatgctcctgaggccggtgacggcggattcaagctgtggaggtcacatcgctgtcatcacgatcgtggtcacagtcgtcatcactattgtcgttgtggtggtggtcacggtcatcgttgcaggcccaattgatgtccctttgactcctaaggcccaccaactacgggcgtggtcgatgacggcagtgggcaggagcggagcgttggctgtgataggtaggtacggaggaggaaggccaggagagggaggacttgggggaggagatggggatgggggagagtctgctcgctcgggtgggaaggaggtggagtaggtggtgagagagccaagggagaaggagagatggaaaactttggctctctatgtgtcaaatttaatagtgcccccatattttgtatgccggtctttttaacccgcccataaaaatcgatttttagaggcggggttaaatctacgggcttcccgctatttatacaagtgataacaagaagtaatattttaagtccacctgaaaaataaataaaacgtatgtatcggccaaattgttttttat

SEQ ID NO: 46637 - DNA, 1247 bp, Oryza sativa
tgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgggtgtagtatagatctgacgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatcttatacatattccatatatataagttatcccctataactagtcggataactatgccgtgtgggtatggggtacccataatctccacacaactgaacccaagtaaagcttgccgccgcctctctcaatcacctccgttggcctgacgttcttcggccccctcaactcctgcaagatcttccccttgcgaccgatccttacggcgaggaggtgggtgtccgagccatacggcgtctcggtcttctcgcggtgcagcgccacccagtagcctcccttcccatcgggcctcacgttgtccgggtagcccggcagctcggcgaacggctccgacgtaccggccttggggccctcgatccagtgcctcaccagcttgcacggccccgtcagcgccaccacgaggtgactccgatcggcgctaagggcgagaccgttggggtacgtcattccggactggagcacgtcgaggtagcccgtcgtcggatcgtacttcatcaggcggcccgtggagtcgccggtggcagtgaccctctcgtgctgggatcgctggaagcgcgtgctgctgtcggtgaagtagacctcgccggtgacctggttgacgtcgacaccgttggtgaacttgaacggcacgccgtcggcctccgtggcgagcaccgttgcctccccgccgcgcgggccgacacgcatgaggcccctgtacgcgtcggcgatgtagaagttaccggaggtgttgtggaaccggaggccgagcggccggccgcacttgctctcggtgagctccgcgggatggagcttgggagccatgcacttggcgacgttgtaccccggggcgtgggagtacactacactggtcaaggtcacctgtgacgggcccaaaccctcacctttgacggttttggg

SEQ ID NO: 46638 - DNA, 939 bp, Oryza sativa
catataaagcagggatcatatgctgagtcagtaacccctgtttactggcagcagcagcagtgtatggtaagctggagtctaatactatcagcatgtgggtgttgtaagcagttgctgaacaaaatcagttaggtggaaattttgtacacttactgaatactcgtgtcagagttcagataactttcttgtagaattttgtatcttctactactgcccattcaacttaaacgttgaaataatctatgcttgccaggatacgtggtaatgtgctacggagctatgccgtttttatgctgatttctgtttcgctgctatattttgttaccaattcaggctacaattcttacaaccaagaagaatgcttgacaagttacagatggcaacaccccaattaaattgttagtttggaccagcgatgtgcatatgcaagcgaatgctgctgggctagcatcgccccgatgaaattgtttctttggtttgacagtttttccttctctaaacttgtgatgtgaaatgatgcttctgaatatgaatgaattatgcgatgattttgttcagaacttttggatttctcccttgttttctgataatcgcgcctgcttggagatttagccgtcaacaacaactcaagattgaatcatacgtaagtgcttgctgatacaatatcaacatggagggtacattgccggttccatatgaacaaacataaaaacaccgaaaccccatatggccattatgccgatcctagcctagcttggcgaggacatcgccaagagcagatttggtcaacgtgtagtacttctccgcctcttcggggctcttgatcttggctgcatggtcaagctgcacaaatcacaaagggggattcttgtcaacaactcagctgagcaacagtaatactttttccgtgttcatttcatattataaattgtttgtcta

SEQ ID NO: 46639 - DNA, 2715 bp, Oryza sativa
aaaagagcttggctcccttgccactttgggaggaaggaggaggagggagagagaacgagggagaggagcacgagctctgtctcttggttttggaaggatgcggcatggaggcatcggggccgagcgatgatagcggcgatgacggctaaaggcgagcggggccgggcggctgcgcggcgcaggcgcggggacaggcggcgtctgggctgacgtggcggcaaccgggcggtcagccacgcgcgagcgcgcaggaacgagcgaaggcggtgcagatttgagcggcgttggcgggaatcgacgccggggagagagagagcgaacggagagggagagaaaaggcagagaggcgggagctctcttcctctctcagctctgctgagtgaccacgtgcagcgcacgtgagagagaagggcagaggggagagatgggccgagggaggggattcggcccacgaacctgagggatgaaaattagacttttgcttagaatttgagttggagagaatttggattgggaatggaatttggatatctttcgagttggtacaagtatttggcgagaattcaaagagaggaattgaatttcggaatttgatctcggtgacttgaatcaggattggaaatttgaggtggaggatttcgattttgatgagagggggcaacgggatttgaattgagatcctggcacgacttagactctcacacaaagaacgaaaattttcgcaattaggattttgccgaattagtttttaacgcctcacgaaaagcggagcgttacaatagctcatagccgaaatatttgaccgaataaattaatatacggtcttgatttccgttggtatgctactgtgtgtatgtagcaaaaatttacaaaaactgaaacttcctagtgatagccgatgcaaattgaatcggctttgattttttctttttcggtaacagcgtgcagcaagaacagaactgtttctgtctcgtgtgtattgttagcgatgctactccacgtgacaaacgtataaagaggtgtcacactctcgcagcggcggtggacggtttacggtgcaaaccgacaaagatggactaaaactagggtaaaataaaaaacatagtaaaagaacgattgaagtaagcggcgacgaggtggagaggcggcggctcctctcccgacgatgatgatgactgtcgcgaccaagatgactaccgcgaccacgacgacgactgccgcgaggacgactactgccgcgacaccgacgccgacgcctatgggggcggcggtggatgaaggaggagagccattgtcggctggagggggaggctggcagcggtgcgtttttttatttgctgaaatgtttttttgcaggcgggtgaatctatcgcctacgaagatatcgtccgagggcccgcatgcgaaaatcatctatttttgcaggtctttgcttgcaaaaagaatgcccgtccgcctggaaagatggatttggcccgccagcaaataccttttttttaaaggagtgagagcaaactatgatgacaaagctcagctagataaaaaaaatgtgagcctagagctaaattagtcaatttttatttgaagctcagttgtgtgttttcgcttttactttttaacaaatacgcaataggaagcaaggataaaaatgtattttcaaaacagggcaaatatttgtcatattttgcaaaatctcagtcaaaacaagttgcgaatacacgagtgctgttcaaaattgaggcaaaaatgcaattgtaaaaaagggtaaaaatgtctttttcatgctcaacttaacatggttatgttgtgaaacaaatctctaggagataagtctcttatgggccaatctgaaccagagtagagataagatatatctcttcctaagacccatatatatacaggggcagggtgagacatatgagattggcttgtactcagatgagatctataatgaagagagagctacaacctatatatgtgttcattgtctacttctgcaatgttcttgagggcaaagggatgggcctactgctatgggagggacagggaacggatctggtgatccgctaataggcatgttggtttacaacaggttaaactcaccatatattcaaactaggggcagaactctgcttcatttcaaaaaaaagcagggaaataccctaaaaagttagggcaaaattatcattatcggtaaatataggatagctccgaattctgaaggactacttacatatatagttttagagctaccccgagggctcaagccacatgcctggctttgccactgtatgataatgcaaagctcgttcttttgtgtgtaagggtgtatacaatgattcttgagtgtgttttggtctaggaaaaaaatacattgtaccaattggattatctcttgagtgtaaatacaatgtaatatatttgtaccaattgaagtttcttgtcttagataattgaaaaaaatgtttttgcttaaaagaaatcacaaccacttatattccataattcacttaatagagaacatataaaaactaggatataactagacaataactaataataccaatacaaaatagagaaacatgtattcaagtctgtttgtaaatctccatccgaggctgggaaatatctgcatgaccgttttctctagatttcgacccacagtatgtattagttccttgtcatcatcacaattttgtagttatgtccaaaatt

SEQ ID NO: 46640 - DNA, 1413 bp, Oryza sativa
tgcagctttcattttattctgaaataataaataagtaatcttgcatgtcatgatgtcaatgaacttcatcttgaattaatttctagagtcaaaactcgaaacgaaatctacatgatctgaaactatctgttaggaattttgcgtgtctatcagccgtgtttatcatcaataagaacaagtataatagcaggctacaagctagctatcactgcacataaaacatgatggatggagtattagcgatattgacttttttgctgcacatgattggcattgtagcgcccgttccgtcgtggcgcctagcgggaaaactatctcttaaaaaccctatttgcgaaatttgtttcttttcttgtcgtctagtgtccgtgccatctcagatctcaaatccccgatctatcgtcgaattcaatcccgaatccaaatccttccaaatcaatccctccgcaaaagtctatttcgcctcccccgggtttgatgggccgaatctctctcggcccatctccctccctctctctctttctctctctctccgctctggccgcgcgccgcgcgcgcgtgcgcgtgagccgcgccgagcgtccccccctccctcgctctctctctccccgcctccatccctggcgagctcctcgcccgcggaatcggcccccgcgcgccgttgttcgcgcgcgcgcgcccgcgtggtcgccgcccgtgccgcgcctgcgccgtctgcgccgcccggccccgctgccctgccacgcagccgctcggccccgcaagccagcacgcgtgcccgagccgtgccgctcaaatcgccacgccgcccgttgcttcccgcgcgcgcgtgccgtggtggccgaccgcctggtcgccgccgccgtcagcgcctgccgcgcctgcccgcgcctgccgcccgtgtcgtcgctccgctccaaatcgccccgccgtcatcgccgtcgtcatcgactcggccccgcctctccccgcgcgtgcttccaaggaaagaaggcagggctcctcctcatcgccttctctccctcctccttttcccaaagaagcaaggaggcaagccccctttccctcttcctttcttctttttcctccatcgccggcgtcacctcctgtcgtcgttttggccgctagccgggcgccagcccaccggcttgaccgtccaaagtcggttcccctctcccaaaccgacattgtcgcccctttaaaccctagctcctccctcctccaatcttcctcgttttcgtctctcgccgccacgccactgtcgcccctgttcgccgtcgccgatcgtcgttgcgcgtgtcggaggagccggcacgagcgaggacgtggaaggggactccgggcgcgccctccccttcctcttcctcggcccgaggccgaaacgatcacgtttcgcgccgtcggctctcgtca

SEQ ID NO: 46641 - DNA, 2991 bp, Oryza sativa
ccgccgcacccgcatcccccgcgagccgcgcgcgtgcgccgcccaaaccctagcgccgcatcgcgtgctccctccgcacggtgaaccgtgccaccgacaagcgggtcccacccgggaccacgcaaggtggacccggcccaccggctccctctctcctctccgcccgcgcgcgcgctttgggccgccttcttgggccggccggaccatttagctcggccgagccgccccttcctctcgggccgcgccctagccgcccgaggaaagtctgatttccctccctccttcttttcttttctttttctttttcaaaaaggatttaaataaatcatttttcctttagaccaaaaatctaataatcttagaaattcaatatcttccaaccgtaaatccgtttgactccgttcaacttccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcgaggcaagccacccttgaacatcttgagcctatatttgaacttaattatgttgcttgaaaaaatattatgcattgataggatcacacttaatctgcttgtcccgtctgcaaggcagattggcggacctacctatttgttgcatttgatccttcctctgttaattgttataccatgtttccttgtaaccacctagtcgcgcctcgaaaatcgtgcactctgcacgagtatcgacggtcgccttcaaacttaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccataagctaggtgatccgggttagtaatgtcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaggggttcgatgtttgaaaaatcagcagctgacgggatcagctaggcccgggtggccgtttgaaaagttgttggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaaacctgcattaaacacttatttcccctggcttgctgagtactcccgtactcacccttgctctatataaatattccccccagttgctgatgaagatgaagcggatcctgctgataaggagttcttacaggagcaagccggttacgatgagttttagggtttcggcctagttcccaagtcgcgcctgtgtgtttggtccaagtctcggcttccgtttcccttttgtaatgcagttgtgagctagggatctgtccgcagcccaacatgactgtactcctactctataataaagagacctctgttactgtgatattctgtcttcctgtgataccagcactgtttcctgggactggtatcgattaacaggttaatttggagcgtcacgggctagttccggtcgggactagtccggggcgtgacaggcatattaccgaatatatgcatatggtactattggctggtttggtggaattccaattctgagccttttttatccacagctcatgttctctgtttttattaagacggatgttctctgtgattagaatatttggagaattatgatcaaacatggactatactatatcctgactagatgtgaattatatttgtataaatcaggatttgttatgtgaactagcacattgccaatgccaggtcaaacagtaagtttttttttcttcactaaatatgagcgcatggatctgaaatatattaattcatcggtcaacatggagcaaaaaaaaacaagcatagcacaactgatctaaaaacaatgtctgacgaattccagtccattaattgcagaaacaaatgtgcaaattctttagttgctataacaaagggaattccagtccattagtgccgcaagccagagcagcttgagtggccaaaatcgagctggtgaagcagtcttctctgttcatgatctgtgtcctctgttctggaactggtaagccgaaaatgtttgcgtccatcagtacgtttatgtgccatttgtttggcacaagatggtaccaatatatagtcacagcaggctgctgtcattagcagataaagagatcctgaatatttttattttacaaacacgcaaaatgattgcacgtcggtatattagaaaaaaaagtatttgtttacctaacacaatcagcccagtccaacttataccaagggaagggagaaaagacaaaacaagaaaaaaaaacaaggaaaaaagggaagaggcctgaaattttctttttaagaaaaaaatttggaacttttattcatgtagcattgtcaaaaaaaagggccatacagag

SEQ ID NO: 46642 - DNA, 1151 bp, Oryza sativa
cctttttttttaagaacaatagccggcttacctagatgccattttacagattttttttatttttatttattaaaatattttaaaaataattttttatttacaaaactaatcgcccatcactctttgatagggcaacttttaaaaatcacccctccaaaggacaatttatccaacatggcagacagccgttggccatcgcttaatggccaaccaccgaggacgccgaaattttgcaggcggcccctttgacgctagggctgtcaacgagccgagctcaagcgagcttgcctgcctaggttcgagctcgagccgagctcgagccgagcctataaaatgttcgagctttcaaacaggctcggttcgagctcaatcaagctcgagctcgactaccaagctcgatttttaattagaacagtgtattttcaaaggataatttttttaaaactatttaatttatggtttatcatattagtagaagaggaaaagaataaaataaatatttgattccaatataagacatacaaataacatatttggtctactaatttattaaatagcaacaaaaaatcataaattactaggctcgttagaagctcgagcttggctcgcaaagctcgtgagctttgggacaggctcgggctcggctcgtttggaggtcgagcccgagctcgaatcgagcctaggatgagtcgagctcgagcagctcgcgagcctcgagcttttttgatagctctatttgccgccctcacagagggcggtttttggctctaggggggcgcctgcaaaagggctaggagggtggccagacttttttgcagatggcccccttgccgccctcacagaaggcgattttacactacgcaggggaccgcctgcttaaagggcggcaggagtttgccactccccttctgctccccctcactctccctcattttcttttttttttggattttgagtgaatataatgaaaaatcagagagggagaaggagttttatatcccgcaggggcataaaatcgccctcacagaggactgcaagggagccgcctacagaatgacaggccgtcctcgctgcccttttgcaggcggtaaggggactgcctgcaaaaatgctaggctgccctcgccgcccttttgcacgtggcccccgca

SEQ ID NO: 46643 - DNA, 3168 bp, Oryza sativa
ttgatggttatgaacagcagcgttcgtaggttaaactcctcctgtttatcctcatcccacacggggacacctttcttcttccacaacagtttaagatcttcgaccagtggtcttaggaacacatcgatgtcgttaccaggttgcttagggccttgaataataatcgacatcattatgtacttcctcttcatgcatagccaaggggggaggttgtagatacacatcgtaacgggccaagtgctatggccgctgctcatctctacaaaaggattcatgccatccgtacttaaaccaaaccgtatgtttcgtgcgtcctttccaaagtctttaaattttctgtcgatgtttcgccactgcgaaccatctgcggggtgtctcagcatcccgtcctgttgatgttcttcagcgtgccaacgcatcattctagcattccccttgttcctaaataaacgccttagccgtggtattatagggaaatactacatcaccttagtaggaattctcttcttcgttagctgcccgtcaacctcacctggatcatctcgtctaatcttgtatcgtagtgttttacaaacagggcatgcttctaggttctcgtactcctcatcgcgatataggatacaatcattcggacatgcgtgaatcttctgaacttccagtcctagagggcagactatcttcttagcctcgtacgttgtctcgggcaatttgtttctctccagaagaatgttcttgacaagtttcaataaatcgccaaatgccttgtcactaacaccattttttgccttctattgcaagaactccagagtggtatccaacttttctgtgcccctgctcgcaacctgggtacaacgacgttctatggtcctctaatatattgtccaatttatgggcccccttttcactttcgcagtcctccttggcatcctgcaacatctgaccaagatcatccgcaacgtcgttataatcagcatctctgtcctcctcacccgtttgatttccttcaaatccagcgtactgagcaaagtctggaatattgtcatcttccacttcatcttcttccatttcaaccccttgctctccgtgggatgtccaacaattatagcttggaatgaaccccgactcaaacaagtggaaatgaatagtcctggatgcagaatactccttctgattcttacacttattgcatggacaacaaataaaacccttctgcttgttagcttcggccactctcaaaaaataatgcacgccgtcaataaactctttggaccgccggtcagcgtacatccattgccgatccatctacatgaaatgaaaaaaaaatcgtatacaaataatcattcgtacaataatgacagtcatataataatgataaaataatcacaaactctttcaacagtcatacaataatgacatatcattattcatacaaaaattataaaatattccaccaaataattcttatttattattttttaagttttaaattattttaattttcaatttagtttgttttcttttatttaagattaactttcactatattttcctactcaactattttataaaaccttatttagcaaataaacaaaatttctatatattctttcttttcccacacaaattttctctctcatcaacttacaacaaaattttggagacaaaaaagtgtgcaaaacatagctccaaatgtaatatgaccaaaaaaatattggaggatgaagttgctaatattttaggcacctccgatttgtatataatcaccaaagtaaattcactataaattttggcatgacctcccctcttttttaaagaaattttgaagcttgctcgggctggaggaggaagaagacatatataaaggggtgggactttagtcagatcccggtgatctttagtaccggttggtaacaccaaccgggactaaagttatgaccaaccgggactaaagatcccagggggcctgagatcaaatatgcccgttaccctttttaaccgggactaagatcggtttttattgcaaccgggattattgtggaattcggccgaccgataaaagatggtttctccaccagtgtgtacgtctccagtggcctcggcctcctgggcgtgccacgcctgacgtgatcgatcagtccctggttgtatgccctcgcgttgtccacgctcgccgcgaaccctcccgccgacggccacccgctctccgacaccaccacattcacgttccccgcgccagccttctccagcgcggcgtagatggcatgcatcatggcgtcgaacaggttggtgtaggtgagtccgttattttggtccctctctgtggggctcacccggaacgtggcgtagttgaggttgatgcacggtttatccttgtaggcgaagtaggggtagacgttggccagcagcggcgcgccggtgctcgccaggtactgagctatgccattcatgtaggtatacgcgaacacgccggcggagggagggtaatagttggcgatcacgtcggatttcaccgcggtggaaaccttgatgccgccgatgccggccgcggcaagggcggagttgacgttgcgcatggccgggaggatgctctccgtggtgccgcctaccacctcgttgccgacggcgatgtacttgatgttgacggccggatagtaggggctgatgttgtcacggacccacgcggccgcgttggaggagctggcggcgaggttggacaactggtcgccgacgtcgaggatgagggcgatgccggagttgcgcagggcgttgagagcctccttgtcggggtagtagatgcgcatccgtttgatgcccttggatatgtacatatgcaccacctcgctccgcgacgggaggttattacccaccatgccatagcacacaccgatcatttgcacggctgcacgtgcaccgcaacagttagctggagtactacaaacgtggaattttttttatttataattttttttattaaaagttttacaaaaataattttccattttgaaaattgacggaaatagtcgcctaccgccctctgggagggcgatttttaaaaatcgcccgcccagagggcggcgaaaatgacgtggcagacggccgttcgctctcgggcgacggccgtcaacgaaatttgcaggcggcccccttgccgccctccgcgagggcgat

SEQ ID NO: 46644 - DNA, 3568 bp, Oryza sativa
agcaagttttggcactaccaaatatttggtaaggtaaaattgcaattgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacatgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgtagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgttctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgctgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattg

SEQ ID NO: 46645 - DNA, 1133 bp, Oryza sativa
cctgctatgcttgaattttgagcttttacgtttggatagatgcgtattgacactaatcagtaatcagagacacaccgtgatactgagaatcaaacacatttctaacaatatgagattatgataaccattattactgatatttccatttaatcaaaatgtgtatgaattaggtataaaagtatacagccatttacacccaaatctaaaactaataccttcatgactccttaattcatatcctccaatatatccatcagagtagatcatcaacccaaccaaggcagtgtgctaccaaacaatccaaactacgatctacaaacacaacacaaatcaagaacacattttgacctgacctgacacgattcacctcaagaacacgcagttcttgtgatctttcgtgtcattttcttgctgctgcttctgctcgttggccttccagccattgggcacccaccaaactcggatgctcttgtcgagccctccactgtacaccatgcagccattgctgaccctgcaccagctcgcctggatgcatttcacggggccctcatggcctctgatcacgcccaccctggcgagggcggcggcggcggcgccgtcgccgtcgccgctcgtctgccagcgccacagcccgatggtcttgtcggcggagcccgtgaagacaaggtcgccggcgacgcacaggcagagcacggccatgtcgtgcgccttcacgtcgcaggagaggctccagcggctgcccctgccgcctaccctgtcccacccgacgacgtgcccgtccgacccggcggcgtacacgcggcgagccccggcgtcggcgctcgccacgagggcgttccacgacacgccgtcccgggagatgaggatgccctggaggaagtgcgccgccttgcctttcccccacgccttgacgtggccgtcggcggaggcggagtagatggtgccgctgtcggcggcgacggcattgatggcgtcgtcgtgggcgtggatcgactcgaggcacttgaggtcggagatgcgccagaccttgagcgtcttgtcccaggagcccgagtagacgacgccgtcgtgcacggcgaggcaggagatgctgtcggcgtgctcgatccagaggcggcggtggttgcggcgtg

SEQ ID NO: 46646 - DNA, 1671 bp, Oryza sativa
gcgtccccggcgaatccgccttgacggaggcaccccggcgagctcaccttcccggaggaatcccagctcagcctcatcgtcttcggtgaggtacgcatccctttgtcccatcacttttcacccgtcaattgcagtccccgacctggtagaggaggggagcacacagccgacgccatagcagcagcaaatctgacgtgccgtccgcctccgctctgctgcgggcgtcgattctggtgaccgtgccatgtcgcgctcgatgtgctggccttccggacggccggcgccgccatctcatcccgtagattccgaatcagcgagaaacgtgtgttactcgtgtagggaggggaacgtgaggaggacgaacccctacacctacaccttaggagttttgtgcctcctcccgatgtgaggggaataggggatcgtgtttcctgggcggagaaagctcttattgttttctgattatacacaattctgagtagtaacacgtgtctactgtgtctgtgtcccttccgcattttccgcttagtgcttacagcccagttgaacccaaatcagattttgtactgagcaaaatccttgaaccaaacatcccctggaaaaacttgctccttatcttagtgagaaatgaaacatttatcataattacattggattatttttttcttacatgtgcattttctgtatggccacgtgccattgaacatgggaagtagatctatttttctttcaccatttagtttacattgcatagcaggattttatttatgcagacatagtatttatgttgcatcctggatagtaaagtaatactagttctacgagtatgaatatgaatttaattttcttaccaaaccatataaaccatcataccctagtgtgcttacttgacttcatgcgcaagaaacttataagtgtggattctcttcatatatctgtagggaaatatcttggtgattcttgggaaccttcagaaagaccacttaatagttttccttggcccagaaaggcttgaggcttgagagctgaaaagttctgctggagctagtgctataatggccacaaaacttgtggtaagtggacaatctttctctttttaggattctataaacgaatgtgtcctttcatagtttaatcattcatgaagaatgatgacatgagatttatttacttaggttcttggaatcccatgggatgtggacactgaaggattaagagagtacatgggcaagtttggacccctagatgattgcgtcgtcatgaaggtttgtagcaatttcatattcagaataagatattagatgccatattctttgtgtttattacatgccattaagatttgaggagaatatgtttcttgtctttttaaagttatttgggaaaccacagcctcacatgttgtactgttggtaatctattcctttcaataatgagtttgccttggaacagatatggctatgtgcttgtatttcgctttcagtatctgatttctatttagtcttcctttttctggggttgtccgccaaaattgagtcctgaatttctggatgcacatcttaaataacttcttcagtactgtattcatcaatttattagcctgatttggtaatttgtgtactgactgaccactatctttcttgtacgttaaaattataggagcgttcgtctggt

SEQ ID NO: 46647 - DNA, 1666 bp, Oryza sativa
atacccctctcaatcattcttgcctccatctcctcccacttcggtattgcgacgctatagccacctgaccccaagtggtgatggtacttcttcttggcaacgttttacttgtttttgaccatcattgcttgcccttgttgccctgtcttgtaagcaacgaactcgtcccaatgatcccttagctttgggaatacgtcgaagttcggtgttagtcccttcaggatgtatttcttgtacagatctcccttgaaggtctagaactgttctgccattttcttaagagtccactatttcactatgttctccgtacccgcagggagcgtgaacgtcttgagcattgtggtccacaacatctctttctctgattccgggacaaagctgtcattatccccacgtgcccttgttttgctgacaggcacgttatccctcacaacccaaccgctgtggcgtacaaaaattcttggttgcttctgccggggcactaggtcggccgtctgcgtccacctcagttatgatgtgccgaccctctatcttcttcgcggcacctcgttgtctgcgtgccctcttctgtccagcggagggatgacttccactagcctcctcctcgttcccctccgcattcctctccacgttcccctcctcgttcccctctgcatccctctccacgttcccctcctcgttcaagtactggtttggatcctcgttcccctcttcttcgttccagtactggctgcttccctctgcgattgtatcgtacagtatctgttcctcatcgcgatcagccatctgttcatagaagaaatatttgctaagcgtaatattaaaactctactaattaatcttgtattaaaactcaaataatcatatatgctaagtctaagtgtcgtgtattagaaccctagataatcatatatgctaagtttaattaagtttcgaatattatatctctaataatcttatattaaatctctaacaatctctaacaatcaaatatgctaagtctaattaagttccgtatattaaacctctaataatcttatattaaatctctaacaatctctgacactcacatatgctaagtctaattaagttccgtatattaaacctctaataatcttatattaaatctctaataatcttatattaaaattgtaataatcatatatgctaagtctaacaatcttatattaaatcgctactaatcttatattaaaattgtaataatcatatatgctaagtctaacaatcttatattcaaactctaataatcttagattaaaattgtaataatcatatatgctaagtctaacaatcttatattcaaactctaataatcttatatcaaaattgtaataatcatatatgctaagtctaacaatcttatattaaatctctaataatataataatcttatattaaaactctaataatctaataatcttatattaaaactctaataatcttatattaaatctctaacaatcacttctttacatacttgcctacgcgaattccttcgatggctagctaccacttcggcttgagggacgacaacgacgtcttctctgcaatattaccaggaaaatatattatctaaacagggccaagttacatatattgtatttcacgttttaacctatatatataatcatatatgtatgctaag

SEQ ID NO: 46648 - DNA, 16802 bp, Oryza sativa
  unsure (1)..(16802): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaggcggtttcggcgcggtgtaccgtggcaatctgagagagctcggcctagacgttgccataaagaggttcgccaaagactcctccaagcaagggaggaaggagtacaagtcggagatcaaggtgataagtcggctgcgtcaccgtaatctcgtgcagctcatcggctggtgccacggccgtgacgagctcctcctcgtctacgagctcgtccccaaccgcagccttgacgtccatctccacggcaatggcaccttcctcacatggccaatgaggtaattaattaactctcattaatactccctccgtcccaaaatatagcaatttttagctatgaatctggattttgggacggaggtagtatatcagaatctatttttttccaatgtgcaatcaacaaatgtcaattgaaattcaactgatcaactagcttggatattatcataggatcaacattgttcttgggcttgggaatgctctgctctacctccatgaggagtgggagcaatgtgtcgtgcaccgtgacatcaaaccgagcaacatcatgctggatgaatctttcaatgcaaagttaggcgactttggtcttgcaaggcttattgaccataacgttggggtacaaacaatgacccacccctcagggacgccaggctatcttgatcctgaatgtgtgatcacaggtaaagcaagcgctgagtctgatgtctatagttttggcgttgttttgttggaagtggcatgtgggaggagaccaatgagcctactggacaaccagaacaatagcctcttccgactggtggaatgggtctgggacctatatggccagggagtcgttctcaaggcagcagacgagcggctcaacaatgactatgatgcaaccagcatggagtgtgtcatggctgttgggctctggtgtgcgcatccggaccgatacgcacgtccatctatcagagctgccatgacggtcctccaatccaatggaccactaccagtgttaccatctaagatgcccgtgccaatatatgcaccgccgatggcctcgtcagaggggcaactttcatcatcgacaggaatgtcatcctcaagtttgacaataacatcaattacacctcgctagggtggcaagttttctcactcataggatatgtatagcaagacaacttttgtcatatctagatttttatccatacccacaagtcgaactacctgcatccctacacctcagttcctttcgcatactttagccggtttgaagggctcatcttcgttaattgctccgtacagtagtattagccatgtttggttcattttacatgttgtacatttacaaattgccgcttgaataggatgtacagctcgtgaggcaattggtttgctctttagagagctgcctaattggcaatatgagtaatgtgttcagtttacatcatgctttcagttttccaaccatttagttattttgtccagaaaacttttccttcaatttcctctccaacaatccaaccaaaccgtccatatctctgaccgtccatatctcttcattaattttctactgaagcagttcttatgcaatcgtctcaaattgtggatatttatgttcagtacatacaccggtgttgattgaacgctgaatcgagaacatcgaagcaaaattgttaacacacaaaaataacaacagccaattgtcagatttaagacataagagattcatgcagcaagcatatcgtccaagattgacatctctgctacttcacagagtgatcaagccaaaatttgaaagagaagagagttggttctgatagggtcagcagtggctttactgctgcaatttcctcaacaaaatctgataggcttttacggtgtttgcattccaaaaaaaggtatagatccaacgctccataatcataggtatcatgtaaaaggtatttaaccattggtattggtgcttaagtactaagggtaaaaatataattttactagtagagaaaaagggtagaattgtctcccaaattagaatcggtaccgcgtaggtactaccatacgaagttaacatttcccctttaccagctttacaggttattatttgcgtattttctcttttgcatggttttatctagatttacgttgtgtttgagttaagtcatttagccagcactagcattacaggttcttaagttgcatcattttatctagagttactccgttctttgatgttctcatttacgtggttttctctatatttatgttgtgttcttataacctgtacatgtcaatcagatcttgcctcctgttcaaatgctcgaccatgccagatcttcttcctcgaccgtgtctcctcatgggtgcgcccgttcgaacactagaaaaacaccataggaggagatctcgtttactatcccacaaaaattccagtcccttatataaggagtttatgaactacatgaataactaatcaactatgtgaataagcataggataactttcagatgcgctagattgagcctagtcatcgaccgggctatcgcattgtcgacgtttgatgtctcgactacggtgtttgggcaatatggagatcgtcggtgctagggtatacgcaagactgaggtaaaagagatggagacagggatttttatacaggttcgggcccctgagctatcaggtaatagccctacatcctgttggccggagccgatgttgctttttattcatgataatcacaccagtacaatgtttggggtagcctatctaactgttgtcgacatggcggtctgacgatctgactcgtagtcgacaacagggtagccttcctcctcgaatccgtgcccggcgagatcagagatagtgctttcgtctctcctgacagtatccggagacaccgtagggtactagccgtgtttatccctgaagtcgatatccggcggcgtgtcttagcgtatgtaggcttctatgttgtggcttctatgtcgattgtgttaggtgttgatcccttcatggtgggtgtatgttgattgtgttggttctccctggcgggtgtccccctgtcctcctaggggggcttgtatttatacccataggtgtccccttgtccaagtagaactagggaaaccaatatggatacaatccgagtagtccttgtcgtttccatgtagaactctggttatctttccttattcagaactccctcgaggttagtttccatataagacatggtatgtggtggatcctgccgagatttagtcaactactattaggtatgtggtatccataaccctgacacgcatctcctcaaccctcaaccatgcagacgcttttttctctgtctccttctagtgaatgttcaaaccctagaacaagaacgaagcgaaaggagagaagaatggagatgcgatctttctgtttattttggtacagatcgaattgatcgctgctaaatcaacagtgtatctgtgatttactttttttcctcacgacgtatcaatctgcataatgatatactgatcgatggatataggtattcaattcacgtataatgcccatgttttactagttaattacgtcatcatattataataactaggaagaaagcccgcgcagatgcgcgggcagttttatgaagacaattttttaaaaaggttatatctcaccatttataagccgagaaatatattgcatactttaatatatttaagtaataaggttatctcctagattaaataaaatcactttgcctctggttacatataaattttcttgttgtcacttcaacctattatcactgtttaaaagccaagtacctattcatagatgaactacgtaatgtatcaataaaataagcctaatatatcattaatacattgaaatatccactacacgtaagtgtttcgtgcctcaccaattttcaaaactatatataaatattgtaaaaataccacttgtacaaattaatagaataacatcaagttatatataaatgcttctctaatgcgtgaagccgattgcagtggcgagactttctttgtccgttgccttgaaacataggtcccatatcgatgtagttgtgcacctccagactaacctggagcacaattttaatgcctaatttactatcacacccttatcgagttgtgcatcggtaagtagtaagttgagcactattggtgactgtggtctccactgggaccgccttaactcccatatgtacatccctgttatacttatagcaacgtagcaaactatgttattcatgcttatgcccttcatgaaaggaaaaagagaagatggaggtgatcaaaagaatgttttttttatgttttgagagtagattcatggtatagagtaggcaccacgtgtttatggtgttaaacattatgcaatttgaaaatgagcgaagttgtaatttgacggtactaaaagagaagatggaggtgatcaaaagaattttttttttaagttttgagtagattcctggtatagagtagacaccatgtgtgtttatggtgttaaatatttatattttgacaaacatctatagtttagcgcttggtttattttcaatacttattgttgataatgacatgagacacctttactaattcgaagaatatatttattttttttaaatttattaataataactaatgcgtgggagtatatgggagttttttattttttttgtatgatactatatacgtatattttttttggttctatctttttttgacacgatggctttattcttttaccgtacgtatgtaggttttattgttccttttcaatcttacgtacttactttttttttggcgaacctattctctctcgtatgtataggtggaaagtattagtattagagatatatatctaatctaatgatctaaataacggatccatcaatttaagtgaaaatcaacggtatagatatagatataatctaatggtctaaaataacgggtccaccaatttaaatgaaaatcgacggtgagattaaacagtgccacgtggcggtttaggagcgtttataagaatgccacgtgtcgtcttgagagtgtttgtaggacgtttaatggacttttagtatataatagatagatagatatattttgttccctaccttgcccctctcttgattaacggtacacattattccatctccaggtacctctaagtacctcgcaaacggtgtaaaaagtctcgaaaagtaattgaaagctcatactgtcagtagagagttcactgtctttttcaacacggtgacggtcgtgcgtgtatgctgcaggctggaactcaggacttaattcggtcttcgatcggttgtactagatgacatcaaagctcaaatttgcggagactctttactccacggccaaaggggagtctttaaagtctttctgcgatccggatcgaattcggatcctctgcggtggaggagaaaattcagaggttgctacagtacccagcattaggagtactgtgggccgtccgatcaagaacggacggatcagaccgttcgctacagtaaaacagtgcattgatgcacagtactttcatccctgtagatacagtaaatcatcactgtagcggtactgttctgtgcattgaaacactgtccccctcacatatcactgtggccacagtgcctctctgcggtaatgcagaggatccgaatccatccggatcactctccatcgatcgatcagtggagttggcacaatatagtttcagataagctgggccattgactgacctctgggctcttgttctgcgtcaaacgactgcatgaggcaaccctgaatatctctcaagtctgaacattacgatttacttacaattatgcatgtttctccgtctctccgatggatcatggagattgtagcagcatcgttaattttggggtattgttcttttcagctcggcatggacaattattgtagtccagctaggaaccgacgctgataaaccgacaattattagttaagtcatcgcaatgatcatttccggtgcgcaatccttttccgtattaaaaaaaaaaatccttccaagttccgacccctgcgaaccaacaagtacagaacaagcaattcaataccaatttggcacagttaaaccatacggaagaactaatagcatttatatgccgtgttaacaccagctgtgttacaatgccttgttagaccaaactgtgttgagtctctctgtgctgctcattgtacttgaggaaaaggtctttattttcttacgtcccttgagttaatccctctcattagagaaatgaaaacgaattatgaaacattaatttcacacctgtcaatccccatctcatgtggattaatcgagcaatgtctttaatgagatgacactcgttttcttacatgccatcaaatagttgtaaaattgtttttataaaaaaatatcataatgcgatatatttgttggattctaccttttcagattgaaaaacaacaaattttgtttcatcttgcatatttgtaaaatgatatcacacatttatctatgttgttgaatcttttaaagatttttctatgaatattgagacaacatatataaaagagtaaaatacacggccggtccttaaagttgagcgcgggtgtcacttaggtccataatcttgtaaattgcacatctaggtccaccatcttgtttaagtgactcattgaggtctaaaagacctctgaccaggttgactggcttacgtggcggtgcagcgtggcaacatatttgcattttgccccctttttgattccccgtgtccgatccaatcccttctttgcgtggcgcacgcaggaacgcgccgacggcaacgtgcgccagcacgcacacctgtggcacccacctgtctcaaccacgctgcgcccgctgacgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccatggagctcgcacccgcccagctcgcgccgaactcgccgacgcctcacccacacacgcggccgcggtaggcgacccctcctcccaggcgtggccggcgacacctcccccgcgcgcgccaagctcaccgacgcctctagcaccaacgaccagcgggaagggagaccgatggatctggctgtcagtgaggcgtgagcgccaccggcacgctagctacgaagactgtcacaccctgaaaattcaaaatatataaattgttgtttaattggaatttttagaaataattttaaaaagtcttgaaaagaagatctaatttttaattaataaatttcaatataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctcttctctctcctcggcccagccggcccagtccgccgcagccgcgcgcgccctcgctgtcgctgacaggtggggcccacctgtcagtcgtcgtctacctttggccgccgccgccgaaaccctagtttcgcgccgccgccgtttccttccaaatccggccgcccctttccttctccggccgaatcaatagaggggaaacaatctccgggatctcctctaccttttctcctttggaatcttcggctaaatcggtttggaatgagttggattcgagttcgtctcggattcgttcttcccgatctttccttcctcgtcgccggtcgccgtgggccttcgccgccgcctccgagcccctttaaaaggacccccggtgtttcctctacccgtcgccaccttcgccttcgcctctcgtcgtcggaatcactctagcgccgtgtgccctagcttcgccgtctccgccgccgctccagccgtgctccgccgccgttccagacgtcgccgtcgctcgggaagaccgttgtcgtggtcgccaagtcgtcgccgtcctcgtccgccccttcgccgtcgctggagatcgtcggagcttcgtcgcggtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctcgcgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaaccgccgcccgtgcgcccggtccaccgaaaccctagccgctgacgcaataatccctcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccgaagagtccgttttcgccggagaagagtttgaagagttccaaggccagcaaggcaagtcacacagatcccaaacaaccctttgagcatgttgatcatatttaaagctattgtttcttttcaactattgcatttattttcgaatgtcattgggtggaattaacctattgtttgttatagcccttttgttcttgattactttattccttgataccttgggatataatttgactagttgagctttatttatattggttcaactaaatattagatataattgcttagccctgcttagaaaccttagcacatttatgggataacttatgattcactattatttcatgatggtttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaaagtagaactgttctcctccctttctcttttaattaaaccaaaataatggcacatgcatttcagcaaaatttcataatctcttttaatggttctcattcaaaatttattccagtgttattattactgtacatctattactgtactaatggctcatttaccagcaaaagttttacaatgttgttttatttaatcttgctgcaataaaataaatttagcatgttgattttataactttccttttatttcttttgaaacctgttattcaaaagcacaaaatttgtaaccttgttttcaactatttcaaattatcttgcaagtttggtttaccttatttacttaccttttactttgattttcaaattttattcaagttaatccaaaaacttgtgctgttaattggatagatgtcttaactctctcctttcacttgtctttagatgccgcgctacaagcctgagtacctgtttggtgttgagggttttgtccaggagttgcgtacgatgtcctttgccattggatttgggactgcccctttttatgcccagattcctcatgatcgtcatgaagagaagtgccgagtcaaagtcaccttaaacagcaatagtgaagatgtcccctcagtgatgttcgaagctggaggaagaaactacatccatgcatgtcaggaagtggcaaggatcgccataggagagctccgtgatcgctacagtgatcagttggccgatactgagtatcgctaccatcctcgtcaaccccagggaagtgaccgtggcagttaccttgagactgaaggaattgagaatgatgctaccacaaggcatttggttgagatgttgtgggctatggatgaaagtcgtgcggagactgtgttagcggctcaagatcgtgaagaccggaatcgtggtaagatttgcaagttagaggacaaggtggatcgtttggagaaggaactcgccgcattgaagggagaagcaccgccgcagaaggccaggattcgtctcaccgcaaggaagagagctctatttgtccctcgctatcaattggcgccaaaggttcgtgtggtggagaaagaagttgccccagctcaagcggatcctccggtcatcatcataagtgatgaagaagaagaatccaagcgcacccgttccaagattgagtgggtagcaactcaagatgatgaagacgagccgaacgagcctacaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaatactcgcagcaacgggaatggtcccaacaaccccaataacaataacaatggagagaacccaactctggcccaagttcttcctcaacagacacagcttatgaacatgatgatgcagcaattccagaatcagcagaaccaaggaaataaccatgtacctccccagaataagttagcagaatttcttcgtgtgaggccacctgttttctttagtaccactaatcctattgaagctggtgattggctgcatgccatagagaagaagttggatttacttcagtgcactgatccggagaaggtatcttttgcatcacatcagttgcatggctctgcctctgaatggtgggatcacttccgcctgaataggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattattctgatttccagaaattagtggataaggctatacgtcaggaggacaagtacaattgcatggaacagaggaaacgtcggattgctcacttcaaggcacaacaggggagtaatcagaagccgcgtcttactttaggaccccagtctatgccacagggaggttcttcgtctgttgttcgtccgccgcgtcagttcttcaacaacaatgctggcaataacatccgcaatcaaactccacgtcctgttgcagctccaacacagcaacagcctgccaagagggagcaaggcagcaagcccgtggtgtgtttcaactgtggagacccaggacattatgctgacaagtgtccgaagccccgtcgcgtgtaggttgtccctgcccagagtaactctgctgtaccagcatcaaaggcccgtgtcaatcatgttgctgctgcagaagctcaagattctccagatgtgattttgggtacgttccctgttaactcagttcctgcaacagtacttttcgattcaggtgctacacattcattcttatctatgagttttgcgggaaatcatgggatggaagtagaagatcttagacatcctttgatggttagtaccccaagtaatcaagcactctctttgcaacgtagcccctcggtcagaatagaaattaaaggagtaccatttctggccaatcttatcttgttagaatccaaagaccttgatgtcatcctagggatggactggttagccagacatagaggtgtgatagactgtgccaacagaaaagtaactctcaccagcaatgatggtcgagttgtgactgttcatgcattgtcttctgagtctttaaggtcaagactgaaccagataactttggaagagattcctatagtccgggagtatcccgatgtgttcccagatgatttacctggtatgccgcccaaaagggatatagagttcagaatagatctggtaccaggaacaactccaatccataagagaccttatcgaatggcagccaatgagttggcagaagtcaagaggcaagtggacgatttgcttcagaaaggatacatcagaccgagttcatcaccatggggagctccggttatttttgtggaaaagaaagaccatacccagagaatgtgtgtggactatcgtgcgttaaacgatgtgactatcaagaataagtatccgctgcccagaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtagtggtctttatagatgacattcttatctactctcgaaccaaagaagagcatgaagaacatcttcgccttgcattggagaagctacgagagcatcaactgtatgctaagtttagcaagtgtgaattttggttgtctgaagtgaagttccttggtcacgtcatctcagcaggaggagttgccgttgatcctagtaatgtggaacccgtaaccaactggaaacaaccgaagacagtttcagagattcgcagttttctaggcctcgcaggatattaccagaggtttatagagaatttttccaagattgctaagcccatgacacgattgcttcagaaagatgtgaagtacaagtggtcggaagaatgtgagcagagttttcaagagttgaaaaatcgcttaatatcagctcctattttgattttacctgatccaaagaaaggtttccaagtgtattgcgatgcatccaaacttgggttaggttgtgttttgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacggagatgtacaccgatcacaagagtttaaagtatatttttactcagccggatctgaacatgagacaacggagatggttggaattaattaaggattatgacatgggaattcattatcacccgggaaaggctaatgttgtagcagacgctcttagcaggaaaggctattgcaatgctaccgaaggacgacagttgccattggaattatgcaaggaatttgaaagattaaatttgggaattgtcagtagaggtttcgttgcagctttagaagcgaagcccactctaattgatcaagtcagagaagcccaaattaatgatccggatattcaagaaatcaagaagaatatgagaagaggaaaagctatcggtttcttggaggatgagcaaggaactgtatggttgggtgaaagaatttgtgttcccgacaacaaagacttaaaagatgcaattctgaaagaagctcatgatactttatactccattcaccctggtagtactaaaatgtaccaggatctcaaggaaagattttggtgggcaagtatgaagcgtgaaatcgcagaatatgtagcagtatgtgatgtttgtcagcgagtcaaggcagaacatcagaaacctgccggtttgctacagcctttgaagattcctgaatggaagtgggaagaaatcggtatggattttatcactggtttacccagaacgtcatcaggccattactctatttgggtaatagtcgacagacttaccaaagtggctcatttcattccggtaaagacaacttattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaattttagtactgcttatcatccgcagacagacggacaaaccgaaagggtgaatcagattttggaagacatgttgagagcttgtgctttagacttcggtggaagttgggataagaatctaccctatgtagaattttcgtacaacaacagttatcaagctagtcttcagatggctccttacgaagcactgtatggtcggaagtgtcgcactccgcttctgtgggagcaaacgggagaacgtcaggttttcgagacggatatcctaagggaagcagaagaaaaggtgaaaatcattcaggaaagattgcgagtggctcagtctcgtcataagagttatgccgacaatcgccgtagagatttgagttttgaagaaggagattatgtgtatcttcgtgtcacgccttttcgaggagttcatcgttttcacaccaaaggaaaattggcaccgcgttttgtgggaccctataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaataaatgagagaagaaccagaaatcgagttatccgtttttgcaaagtccaatggagtaatcactcggaagaagaatcaacttgggaacgagaagatgaattgaagtcagctcatccacatctgttcgccagttcttccgaatctcgaggacgagattctgtttaaggggggtaggtttgtcacaccctgaaaattcaaaatatataaattgttgtttaattggaatttttagaaataattttaaaaagtcttgaaaagaagatctaatttttaattaataaatttcaacataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagt
